United States Patent 12,800,583 (BACTERIAL BIOMARKER FOR RHEUMATOID ARTHRITIS AND RELATED MATERIALS AND METHODS) - sequence listing, part 2

SEQ ID NO: 2 - DNA, 2508948 bp, Subdoligranulum sp.
  misc_feature (1)..(2508948): Subdoligranulum didolesgii strain D8
agaggttgcattgatgttttcccacaaaacaggggttggtgtcaatgccgtttctgaaatattgaacgcagcatttaaaagaggtatttttgacaagacgctgtatgagaagtacaaaattctaacatccaaaggaatacaggaaagatgtatgaaaatgtgctcaagaaggaagcgttttgaagtcgagaagaaataccttttaattagtgtacccgacggctttgaaaatgtatacataaagggcgaaaatgttaacatttctgaagaaaatgtatacatttttacacaaagtaaagtaaaggaaagaaaagaaagtaaagtaaataaaagtaaagtaaatgatgtgccggaagcggaagagtgcaaggagttaaaacacaagtatggaaaatacaagaatgtgttattaacagacgaagagattaaacagctaagagaaaagctgcctaaagactgggaaaagtggatagagacattttcggaaggcctggagcttaagggatataagtataataaccattatttagccatactccagtgggaggagagaagcggacagaaaaaggatgatatgagaaacagtaaatttaataattataaagacaccaacaaaaccgattatgcaagtattgaaaagaaaatacttgccgatatgtatggcaatagttaaagtgataaaaacagagacttgctaatacagaaaaacaaagattaagagtgtaagacggctgaaaattaaagattttgataggccgtgacataattgagagaatggcaatgtaactcattgtcaaaacccagtcatacggtttgttattattaaaatttagcgatataaagatttctgtatatgtaaaataaagcggtaaagcaacaaaacctccggttagcagtatgaagacaagggacgaataatcgtgagtgattttagaaaaataaaattaaaataaaaattcgatacagcaagaaagaatgatattaattttttaagcaaaataagtccaaagtatgtttctgtatataattagttaaattatatatttaataatgtattgataaattttaccggaggtgttggaaactgaataatacaaataaaacagatgacaacaaaatcttgtaaatttttgaaaaatttctttacataatatgttgttaatgatatactataaaaaacatattaaggttttttatagtatagaataaatattatacaggtgcgaacagtaagctcacataaaataaccgggggattcgcaccgattttaagcaaatatatgtattaaaaataagctagcgttttataagaaataagtatattttatagtaaaacagcttaatatagagcgctataattattatatattatatatttttgccgtcgcaccccgcaagggtgcgtggattgaaataaacgcaccagtaccaatatgtgtaacactattgggtcgcaccccacaagggtgcgtgaattgaaatcatgtctcaaaattaatataccgtgatataagtatggtcgcaccccacaagggtgcgtgaattcaaatgatgttaaaattgatgaaacaaagtgcgtgtgccgggaatgaggtgtgttggtaatgtgtttctctcggttattttgacaaaatttaaataactaaaatttttttattaattatttttgtatatatcggtaaggagcatacacttttacttttttggactagaattcaaaatttcaatagtaaagctgtataatactttaactagtgtaattgcaatattttgaattaacagtcgatattataatgctatattataatgttatattataatgttatattaaaatacttataaaaaccgatttgtatatatcggaaaatatattgtatttattacattatgctgaatattataactaaacagtatcttagctttctcggatacgcgggtgttgtaagggttaattgtttatgtgggataaaaatataatgatgtcagtattatgtttttttacatcgttttaaatagggttaataaaaattttgaactgctttatgttccggctgaagatttatatatattatttggttgctcagaagttttgcaaagaattgttttacgctgtcaatgaagaataaaaaagaaattataatctctatagaattatatttaaatcatgtgaaaaacaataaagcagcagcggctatgtatcttgctgattgataatataataatttaaaacaattataaattttaaaccggttgatataaaaatgataaataagtttttgtaaggaatattatatcaattaaacgctatagagagtatagtgtttttttatgcaaaataggtgtgggaatttataaaataagatttaaagtgtaattgcattaagcgcaaaatactaactttttaagttaatattataaaaatttgattttaataaattatttttaaaattcttaatgttttattaaataagtgtttaagtcatactgttctagtctttttagcggttattttatgttgttatatataaggtggtttttattttattatttaattaataaattattgtgaagttaagtatgatattttaaatggtaaatcttaggataatacgttttgcttcgataatccggcagtagtattctgtatcatacggtttttgttttctgttcaaatattattaaattttttagtctctgataaatattataaattgaaatgattagacattattaatatatatacctgattaattaatatgcggtattgtgggtttaagcggacggtatatattatttttatatctgtgtataatttaattatatctttaattatatattacaaataaaatttaatgaatatgtttattgttttaattgttaacatgaaatgtatttcgggaaaatattttattaataatgtataatattgtgtgcattttgtgtgtaatagtgacgaaaaaatatttataattgaaatttatataatataatgatataatgtttcaaaaggtgtttaatgtctctgaataaatttgaaataaaattgttgtctttataaatgccatagttggtttattgtatgagactatgcaaatttataaataggaggtggaatgcgttcttatatataaagacagcagtaattaatttatatggaggatttaatatgtctaaaagattaattagttgtgttttaacattatcggtattcatttttgtatttaattttggacttgcgtatgcaaattcagagactccaatcactgaaaaccaggatttactatcggcggaagaaaattttgaaccagtggaagcaaccgaagtaccaacctcaatacctgtttttaataatgacgataaggatggtacaaatattgatggtttaaaagagtatgtggaagaacatgaaagcgcaaacgagtctaatacttcatctgtgaccgaaaatacagatggttgtgattcagtttgtcaggtagaaattaaagttagaaataccagtggtgaagctattgaaaatgctttggtaaaaatagaagataaagacgcatatactgatgaaaatggaacggcatattttaaggatgttacttttggaacttataaattatatatatccgctgataactatatgtcaaaagctgttgatatttgtgttcagagctcaagtggtgaatctgtagttttaaatgtttcattatttgagaagagcgatgaaacattaaattctgtttcagctttatcaatcgaccctgtcggaagtttatctgattattcggattatgttcagaaaattttatccaagtttccgtcggcagatgattttgaaggttatggagtaacagagtccgcggactgcgatgttgcaacgccttcgttagtggctgacggtaaaatatattgttttaacgatgtaagaacatatgagtatgatgttgctaacgattcgtggtcattttatccgcctattcctacccaaagagaatatttcggcgttgtaaaagcgggtgataagctctatgtaatgggcggctgtattgacagaaaagcagtatctacggttgaagtattagatattaaaacaggcagctggagcacaggtatatctatgcctaattcaagatattcgtttaatcctgaaattgtgaacggaaaaatatactgtgccggcggattttatgagatggcaacaaatagttataattatccgtcagtcgtgagaaggatggatatatacaccgtagattcaaatacctggcagtcaatgtattgtgatgaaattgacggcggcggatatgcatcggcagtatataatgggcaaataatctacataggcgttgaagacagatataccggtcaggagactaagatatatcatcctttaacaaacacgtggtcatatcttacggacaggcctaatgcgcttctaagcaacgaaccttcaagcggcggaacatttttaaatttaggagacgtatatgtatattcaggtcctacagctgttaacactcatgttccaaaatgggatgatgacgatgagggcgaggaggaagagtatcgagatacgtgtacgtatttgtatttcccgaaaacagatgaatgggtaagtattggtttttatgatccgctgttagatgattcttatagaccgcgtcctctgcgcggagttgcatacaatggtttgatgtatcttttgcctgatacatataatggttattcttctctgagaacactttatttgggacaatatgcagaagaatatgtaaagttacaaaaccagaaagcagctgcaggaaataatcacgttttgatagctaaaaacggatacattgaagccaaaggcgacaatttatacggtcagctcggaaactctacaacaacgtcatcggatacatttataaccatacctaatatagataactgtataaaggtagcagccggaggagattcatcatatgcattaacatcagacggtaaactttacgcttggggcgataattcaaaaggacaagccggaggaggaagcggctccgcccaaacctcacctgctcttatacttgatgatatagtggatataagcgcaggaatcaatcatgctattgcagtgaaaaaagacggaacagtatgggcatggggaagtaatacctatggtcagttaggaataggttcgacaggaagttattacagtactccggttaaggtatttagcggcgcttgttctatagctgccggaggttaccattcttatgttatagaccaaaacaataatctatatgctgcaggtaaaaatgataagggacagctgggacttggaaacactgcaaacaaaaacacatttgaatatgtaatcaacaatgtcagcaaagctgccggaggaatgaatcattcggttattttgacttttgacggtgaattttttacctgtggtgataacagtatgcgtcagctggggcgttcaacagcggcggcttcatattcaaatacttttgcaaaagccggcgcggcaagtgatatatgggcaggattgaactcaacggcgtactggcaggataataagttgtaccaatgcggcgccggtataaatcttagcagttatttctctcagatatcggaaatttacggtttagatagtgtaacattaaataaaaaatgttatgctttaacaaataacggcgaagtaatgcaatgggggctgatgtctgaaactaatgaaataatgagcgctcagaatatgcttgtgccccaaaaaattatatctgacaatagctttacagatgttgtcaccaggcggtatcaaaaccttgccatagataagaatttgaaagtatgggcatggggagaaggatattatgctgacggcaccgataaaatggccgtatattattatccaaaacagataggtggtataagtaatgcggttcaggtttcaagaggtaaaaaccataacttagttttggattcgagcggcaatgtttggggctggggaagcaatacaaattatcctatgagcaacagcgtaggaggaaaagccagagtagctacaaaaataacttctatatccaatgtaaaacagattgctgcaggcacggaatttagtatattccttaaaaatgatggaacgttgtggggagtaggaaagaacgacttgcatcagataagcagcagcgctgaagcaaattatccaaaacctgtaagaatatctgacaaatcagattttgttaaggttgttgccggagacacgaaaagcctggcgcttgattcgcagggaaatgtttataccataggaggaagttccggctttgctgaattggactttacatttaccgatggttcgagcacaaaaattacagatatatctatggggcaagatcattgtttggctctgactgataaaggatatgtatacagttggggcgataacagccaaggtcagctgggtcttggcgacaaaacaggcagaaaatcacctgagttagtaaagatatcctcaaattcgattctgaaaaacgttaaaagtatatctgccggatataggcaaagcttcgcagtaactgctgataacaaggtgtatggatttggaagcggaactgcatatcagcttgctataagcaataccggtacagttcggtttgctaccttaataagcgcgttaaataataagtccataactaaagttgccgccggagtagatttttctattgcgcttagcaatgacggaaagatatattcttttggaaattctttaaacggcacgctcggaatatataataccgaggctgttgagatatattattaaggcaattgttatatataaacataagaataataatataatcaatttatttttttgacgataaagcagcacagcaaaatgcttaatgcattttgctgtgctttttatttataaataaaactgaatactgcgtttaaattgttttatattataaatttataagtagtttttccggtataaatgaaataaaaatattttatattttaagaagttgaaaaaatataataaaactatgagctcctgactatagtttggatatttaaataatttggttcagataacaaagttgttataataaaaacggtaaatacatataattaaaaattttttattttgtgttattatatacagtgttttattgaaccattgcaggcatgactgggtgtgattaaaagtgacttgttttgattatcctgcaaggtcaattgtggctacacttttatttaaaagtgtatgttatataaaccgtatagtgtgatataaactataaatgccaataattaacttagttgttatataataatcaaacttaattgtgatgtgcaaacgtagtatgccgcgttagggcgcggtcacggtgatataaaatatataaatattgttctagcaaatatctatttaattattctgtaattgcttactttgctgcgccagccccagtttcgcccgccgagcccgggcaagatcggcttcccaaaataggaagccgattaagataatacttataaataaaattagtaaagtataattaatttcaaaacaggtaatggaaatagatatattaaaaaatgagaagaaagatgtggttcaaaggacacgaattcgaaagtttataaatagattggtatcagtatgggatattttagagtaataaatatcattatatatttggtaaaattcaaaaaattaagtatctgtatttttttataatagtatttatataagaataaataacagacgtctgaaatgagctattatttaagttataaatacaataaaaaatatggaaaaataataatatgaagctaacaaaattcagagtaattactttacataacaatatattaatgatataatataaataattcagtaattcttttaaaataaagataaaacattaggtgcgaattgtaagctcacataaaattgccgggaggttcgcaccattaaaaacaaagatatataataaaaattgtaagtaataattaatcttatattacatattttgtatgataagctaaatatgccagattaaagcaacgcaaatattattttttatatatttttgcagtcgcaccccaccagggtgcgtggattgaaatttatgttatattcaagttggatttattttttatttttgtcgcaccccaccagggtgcgtggattgaaatctataatacgacggtaaaagtgacaataaactatccatgtcgcacctcaccagggtgcgtggattgaaattttaaagccaagtaattacaaagagagtttaaaagcgtcgcaccccaccagggcgcgtggattgaaattaaaaatccattgtcaattaaatattcaatggtcccgtcgcacctcaccagggtgcgtggattgaaatgaatttaccaaaatatgaagacgttatgtatgaaggtcgcacctcaccagggtgcgtggattgaaatacctgtgttcccgttgtcgtaatacaattttattcgagtcgcatcccaccagggtgcgtggattgaaattacgtgtgctttagcaaatacaagttccatatcacgtcgcaccccaccagggtgcgtggattgaaattccctgttctgttaaattgaacgtatcttttgcaaagtcgcaccccaccaaggtgcgtggattgaaatcgaaatccccacgttacattctcagaaatagaagtcgcacctcaccagggtgtgtggattgaaattcataataatgtaatgctaatcggcaaatagtcattgtcgcacctcgctagggtgcgtggattgaaatttggaaagcccaatacggcattatcagtgataaagtcgcatcccaccagggctcgtggattgaaatactttataagcagcagaatcatatctgtttcgcgaaaatcgtcgcaccctacaagggtgcgtggattgaaataggagtttggtcttttgttacaattcccatatgctggtcgcaccccacaagggggaatgggttaaaatgattgtcataatcgtataatttatatacctagactgttacaccattccgagggcgtgaattcagataacttgtgaaaatgtggaaagttgtttgtgtttggatttagtagttatcggtaaaaattgtaggtattacttatttaaaagtataaatttatcagtaattaaaattttataggttacatttagtgattttatttgtactactttaaaaaatcttagtaaaagagctatattatactttaaacggagtggctgcgatattttaaatgattttactttatattcgcgtttttgttaccatagatataaattacattttggaaagttttagagaatttagagagtatagttttgttgtatgtaaatatttttgccggtattgcgattacgttttgccggtgctttgtttccaataattatactttttatttaaggttaattttatatataatttgtgtttaaaaatatgcaaatgggatgaaagttaaaatgtttgatatatatattaaagataacgaaaatgttaggtatgttttaggaacaaagggaaacagaactttatgcgtgtttggaattaacccaagtacggccactgataaaaagcctgacccaacgatttcaagaataaatacatatttaaacaggtatgggtttgacagctttaaaatgatgaatatttatcctttaagagctacagagcccgacagtctgcctatgcagatagacatgaatatacacagacggaacatgaaagaaattgaacaggcactaatcagttcttcagcggtgctttgtgcgtggggaaacttgatatacgaaagagattatttaaaacagtgctttatggatatttctgaacttataaataggagcaaagttccgacatactgcttgggaaaaacaaaactgggaaatcccaggcatccattggcaagaaagccgacgcctgcggaattgacaaagtttgatgttgaaaattatttggaagtaataaacggctaatataaataattcttgagatgcgtatattgttgtgttatcataatcagtctttttatggatactctgttatgggcaatatgtttaaatgaactctatttaaagattttatatttaaaataaaacgacggaaggttacattaaaatagacagacaaattaagtttctgtataaaaaattatataataaaatgtgatatagcaagtctcggcaagtgtgtccctacctgaaaggtgggtgtgatataaattggcttgttttgataaacctacaatgtggatagtcaacactaatttagacaacttatttaaggttagtaagccgatattctttcggggtcatatagtccagtgatgagtgaattctgtgattgttaaaccagtttacataatccgataattcatatcgcattgttccaatgtttcatattcttgaccttttacaaattcagtctttatgattttaaatgtggtttccgctgcgcattgtcatagggacagccttttcttgctcagtgagcggtctatgtggaatgtctcaagcgttttatccagtgttctgtttttaaactcgtttcctctatctgtgtgaaatatctgtattttctccggatttatatttattctgctaaacgccttgactaccaatgcagcatctttgttctttcctgcgctgtaacctatgatttcctaattaaacaggtcgactagcacacatatataatcctacctgtttcctgctcttacatattatactttctattttacatgaccttaacttttttgcccagttttttgtttcctatccaatataattgatatattattttggtgtggaaaacatgaacggctttataaattgtattttcataaattctattaatagagcagttaataatttaaagatatacttaattaattaaataaaaagagtccggtataattccgaactctttttatttaatattgtttttgtttaatctttaaaagtcacttcaaatactgattctttaaatatttaagttattataaaagaatctttttagcagcttcaacatcttttatatctataagacatgagatttccgtctcagctgttgttataagcttaacgcggatattttctttggcaaacagcgaaaacagttcagctgctacgcctgactcagacctcataccatcaccgctcagcaggattttagtgttgtttccgtttatgtcggctttaatagacggggcaagagacttgaactttcctgtaagcccgataacctcgctcaaatcatcctgagaaagtgtaaatgataagtttatcttatctttgtatggttcggtttgactaatcatatctatgcttatgccgttctctgcaataacgctgagaatgtttgcaatactgctcggagtgtttggaatattatttaatgtaacaatggcaacctccggaaaaaactcaatatcggtgatggttttaatcatgtgataacctccaatatataaaatgtggtttatacattcaaactaagactgctcaatcaaatctttcatatcatacataccgcagggctttcctttcatgaaaactgcggcttttacagcgccgacagcaaaaacttcttttgatgaagcgctgtgttttatttctattatttcatcattgccggcaaatataacatcatgttcgccaacaatggtgccgccgcggacagcgtgtatacctatttcagatttatcacgctttttacgtacattatgtctgtcataaatatactcggtgtcaaaacttactgcgtcagaaatagcgtcagcaattgcgagcgcggttccgcttggcgcgtcaagcttttggttatggtgcttttcaattatttcaatatcaaagcttccgtcaagcagcttcgccgctttgcataccaagtcaattaaaagatttacgccgagagacatatttgctgagaaaaagataggcgcttttttagaagccgccttcatttttgaaatctgctctcctgaaagtcccgttgtgcaaataacagcaggagtttttgtcttaaccgagaattcaagtatgctgtcaaatacagacggatgagaaaagtcaattataacgtcaaagggttctttgacttcatctaaattatcgtagacaggaaagtcagagtttttaaccgtgtttatgtcgtatcctgctgtgattttgactttgtcattattttccactgttctggtaacagcgcgtcccatgtttccgttagcgccgcttagtagtatatttgtcatttgtatcactgtctttctgttttagtatattaaagcaaacactttacattattttcttttaaaacatttttaagagtctctaaattcttatccgacatatcacagagcggcattcttagaggaccaaccttatatcctaaacaattcatagcagttttgacaggtatagggttaacttcaataaatagtgtattaataagctttattaaactcaaaaacagttcctttgatttttcagtctctccggtttcgtaaagtttgcaaatatcatgcgtttctttcggcaatatattggcaacgactgaaataactcctttaccgcccaaagacataacaggaacaataatatcgtcatttcctgaatatatatttaggtcagtttccgccgcaatatttgctacaaatgaaagattgcctgtggcttcttttatagcgtttatatttggaatttttgcaagttcttttaatgtgtccagggagaatgaaagtccgccggttctgcccgggatattataaagcactatcgggatattaacgctgtccgcaattgctttggtgtgaaggtataaacctttttgagttgttttattataatacggggtaactataagcagtccgtctgcccctacgctttcagcatacttgctcagttctattgcatgggctgtatcgttgctgccggttccggcgattaccggaatccttttgttaactttttcagcagtgaattttattacagacttatgttcttcgtccggcacagttgaagattcgccggttgttccgcaaataacaatacaatcggtctgatttgcgatatgaaattctataagttcttcaagcttgtcaaaatcaactccggtttcagtaaacggtgtgactatggcaacagcgcttccggtaaaaataggctctttcataacagaagttcctttctttcaaaaaattaattaatcaaaatatccttttgaggccagcagttccgccattaatacagcgccgcctgcagctcctcttaatgtattatgtgacaggcaaacaaatttataatcatactgagtatcttcgcggagtcttcccatagaaacagccattccgccctctaagtttctgtcgagctttgtctgcggacggtcaggttcttcaaaatagtttaaaaactgtttcggcgctgaaggaagctcaagttcctggggcacgcctgagaagtttttccattcctctttgatttgctctatagttggtttatttttaaactttacaaaaacagctgccatatggccgtcgcttgctgcaactctgagacattgcgttgtaatagccggagagctggcttcaacaattttgtctccgtctatctttccccaaatcttaagcggttcaacttcgcttttttcttcttcaccgcctatatacggtataacgttatctaccatttccggccatctttcgaacgttttcccagcgcctgaaatagcctgatatgtgcaggcaagaacagattctattccatatttcataagagggtgaagcgccggaacatagctttgaagcgagcagtttgactttacagaaataaagcctcttttggttccgagacgttttctttgagcttctatgatttcagcgtgctcagggttgatttccggaacaatcataggtacgtccggcgtatgtctgttagcagagttgttagaaactaccgggcattcagccttagcataggcttcttccaaagcttttatttcgtcttttttcatatcgactgcacagaagacaaaatcaacctgaccggttattttttctatgtcgttagcagcatcataaacaatcatttcagacacatagtcaggaatgtcagttttcatgacccagcggccgcctaccgcttcagaatattttttccctgcgcttctcggtgaagccgctaaaagctttatattaaaccagggatgcttatcaagcagcgttataaatctctgcccaaccatgcccgtggctccgataattccaacattatactgtttcaattttaaatcctccttgaattcattggtatacataattatatgacaatattacaattatgtcaaatgcttttttgtattatacgtaaattaaatttaacaaaagataataaagatatatatggctttttgtagaattatgtgttataatatcaggcatgcggcaaacgttcaaatttgtttgcgtttagctgtactgacagagatatttttaagcggggtgacacattgtggataatttcatgttttttaagcggcaaggttttagattgttctctgttttcactgttttggctgtgtttttttgcacacttgcaggatataagacttttgtgtctgctgatgtttatgtgccgtcaaatattaaagtcgggctgttttacggctcgtcggctaaaacgtctgtgaaaatcacaagtgaacggggatattatgcaggagtatttaatgacagagatttttctgaggagaaaattatagaggataccgatgttatagtcagcattgctgaaaatcaggttgtgttatctgatttggatggtaatgtattatattctgaatccggtaataatggtataggtatatgcccgatttataccgatttttgggaagagagactggaaattgatggttcgggatatcgcggaagcctgaattttattaaggacggttcaggaatagctgtgattaatgtggtcaatatggatcagtatttatatggtgttgtatcaagggaaatgagcgaatcatggcctcttgaggctttaaaagcccaggcggtttgctccaggaattacgctgctcagaatttaggcaagcattcttcatatgggtttgatatttgtgcgaacacgcattgccaaatgtataccggtatgtcaagagaagcgcagtctatatatgacgctgtggacgctacggcaggacaggttatgacatataacggagagctttgcgagtgctactatgcggcgtcaatgggttctaccaccgaaaatgttaagtatgtttggggcaacgaggttccatatcttataagcgttgacaatagttatgaagatactgaaaatattccgaatggtatttggtccggcgtattgacagttgctgaagtatctactataatgcgtaacagaggatatgatgtgggcgatgtgcagaaaatagaggtgcttgaatattcacctgaaggccgggtgattaagatgagagttaccggcaatactgcaataaaaacattggaattggaagagtgccgcacagtgttcggcactgtaaccaagagccaaatgtttactgtggtgggtgacggagacgctcaggggcaggcttatgtttctgtgacagacggttcaacacttatcagaagacgtccgacacagcttgaactgcttacaagttccggcaggagtgagttttcgggcgaatctctttatacaactaacggacagtatcaaaaggtatatgctgattcttatgaagaatcaagcgctaatacttcatttacgtttaaaggctcaggctggggacatggtgtcggtatgagccagtatggagcaaaaggtatggctgaagccgggtatacatatgatgagatactgacccattatttcagcggcgctgaagttacaacagtatattaatataggattggagtaagttgagttaaatatgacaactaaggatttttattacgatttgccgcctgagcttattgctcagcatccgctgaaggatagggcaggttccaggctgcttgtcttagacaaagaaacaggaaaaatagaacataaaaattttaggaatataatcgagtatttgaatccgggcgactgtcttgttatgaataacacaagagttataccggcaagactgtacggcgtgaaagaagataccggcggtaaaatagagtttcttcttctaaagaggatagatttaaacacttggaacgttattttaaaacccggaaaaagggcaagaaccggagcaagattcgtgtttggagacgggttgttaaaggctgaagtgattgaggtaagacctgacggaaatagaattgtaaggtttgaatacgacggagtttgggaagaactcttggataagctgggagaaatgccgctgccgccgtatataaaagaaaagctagaagataaagaacggtatcagactgtttattctaaaattgaaggttctgccgccgctcctactgcgggtttgcattttaccaacgaacttcttgaagatataaaagataagggcgttaaaaccgcttatttaaccctgcacgttggtttgggaactttcagaccggtttcggttgaaaatgttgaggaacacgttatgcacactgaacattatgaggtttcgcaggaagcggcagatataataaatgaaacaagaaagagcggcggcagaattatcgctgttggaacaacgtctgtgagaactcttgagactgttgccgaagataacggaacaatgaaagctgagataggagacaccagcatttttatatatccgggatataagtttaaggtgactgattctataataactaattttcatttgccggaatcaacattgttaatgctggtatcggcgtttgcagggaaagaaaatatatttgaggcatacgagcaggctgttaaagaaaagtatagattcttcagttttggcgacgcaatgctgctcaagtaaaattttaaccgggagaaagtagatatatgtatagattgatatcaaagcatggaagagcgagacggggggaattcaagactgttcacggaactattcagacccctgtgtttatgaatgttggcactgctgcggcaataaaaggcgcgcttgatacttttgatttaaaggatattggctgtcaggtagagctttcaaacacttaccatctgcatcttcgtccgggcgacgaagttatacgcgacatgggcgggcttcataagtttatgaattgggacagaccgatacttaccgacagcggcggatttcaagttttctctttagcaaaactcaggaatataaaagaagagggcgtttatttttcatctcatattgacggacataaaatttttatgggccccgaggagagtatgcgtatacagtccaacctggcgtcaactatagcgatggcttttgatgaatgcgttgaaaatccgtgcgaaaggcagtatgctcaggattctgctgatatgacagttcgctggctgaaaaggtgtaaagatgagttggcaaggttaaacagtttggataacactataaataaaaaccaaatgctgtttggtatcaaccagggcagtacctaccgcgatataagaattgagcatatgaaacaaatagttgatttggatttaaacggctacgcaatcggcggactggcagtcggggaatccacagaggacatgtataatattattgaagcggttgaaccatttatgcccgaggataagcctagatatcttatgggggtaggaactcccataaatataattgaggcggtttaccggggcgttgacttctttgactgcgttatgccgagcagaaacgcccgtcacggcactatatttacatctgagggaatcctgaacataagaaatgctaaatatgagagagacgacagacccgttgaccctaactgcggctgtcacacatgcaggaatttttcaagagcatatttcaggcatcttttcaaggcaaatgaaatgcttgccatgagactggcggttattcataacctttatttttataataatctgatggcagaaatccgttctgctctggataatggaaagttttccgaatacaggcaaagcaaacttggcgttttagacagacatatataaaaagagtccgaaaggactcttttattttttagattttattaactgaatgagttaagaggctcacctacattggtgaattggttgtcttccggagacggctcagacatgctgaaatacattttagccgccttagtagttccaaagtcacggtttgaaccggtgttttgcactttgttaaatgcctttttaaacattgtgttgtgagcttcctcacggtttagaagaaagtctatggtctctttaacgcatttgtcatctatctgacggtaaagatattcataaacgacttttgcacgctgttctgacgctatatttgatagtaagtcagcacacaggtcgccggttactgttacataatcgcctgtccatgaatatccggaggcgtttataagtccgggattgagacccaaaagaacgtgtgactgtatttctcctgcctctactttttcataatctacgtcatgtccgttaagcatgtttattgtggtcgctaccatttccatatgccccagttcttcagctgctatatcaagaaacaaatctttgatttccgggtcttttattctgaaactttgagacatatactgcaaagcggctttgagctcgccgtttgctccgcccagctgttcctgcaaaagcgctgcatactgcggatttggtttctcaacgctgaccggatggaaaagtattttttcatgtttaaacatttttaacactcctttcttattctaatttaagtttgtgctatagggattaaaatatacattacatgaacaaaaaatgtttattgttagtatttaaaagaaaaaagacctagtatattgctgggatttgctttctgaattatttaaattgcaccttgaaaacaatgcggtgttatgctataattagccctgcgtgaacaataataaatataaaggattgataataaatggggaattatttacaaaaacccggtttacatataaagaaaaacaggtttgcggttaagttgatgtcctgtataactgctggaatgttgattttttcttcaatgtctgcttttgcgtctgtgctgggagagcaaacaactcatactgaaactgagtacgcccagggaaccacttataataggaatacctttcagagcgacagtgttggacagcagactgaaaattattttgaatacataccaaacagcgatgttctgcctatagtttctaatggagaccaggtttttggaaaacgtacttctgttgaagctaatgaatatttaaatgagcagggaatttttgcggctatgggtatgaacgctgattttttctctttccaaaccggcgtgcctatgagtgatacaattgtggacggaaaggttctgacgtctgaccaggaaaagctgacaggagtgggttttaatgcggacggcacaggctttatttcgcctctgcaaatttatatatctgttgaaacaccggaaggcacgctgtttgatatagaatgtttaaataaataccgtcagccgtatgttatgtatatttatacagatgaattcggagattacaccaatgcggaaggcagcggtaccaatgttgtcttgggaaatgtgagcggcggtttttcgctgggacagccttttacggcaactgttgagtccatcacttcggataacggttcagtggcaatacctgacggaaaattggtaataagtgtagatgacagggtcgcggatgaggtaaaagaccgtttaaatcagctatatataggtcagaccattactgttgccgcaaatgaagtgacaggcgacgcacgttggaacagcgcagtatacggcacaggctgtctgggaggaacattgcttcggaacggacagctggattatgaggacgacagcgcggcgccgagaagcgctgtaggaataaaggcggatggctcgataatattttatactatagacggcaggcagccggggtatagctatggagtcagaaaagaaactttggcacgcagacttttggaacttggatgtgttgacgcagtaaatttggacggcggaggaagcactcagcttggagggactttgcctgaaaccactgagtttaagattttaaattccccgtctgaaggattacggagatgcgctaactttatatttttaaagaagatgaatccgccggacggtataccttataaactgctgacatatccatatggagaatatgtattgtcgggcagcagtgtaggagtttgggtagcggcgattgacaaatcttacggaaaagctgaaataaccgagccaatttattattctgttgagtcggataatacaactgtggggcaggccgttataaacaatgacggttatgcaacattgtacggcgatggggatgtttatttttcagcagttacaggagaggcgtatggcagtactatgcttcattcagtttcaaaccctgacagtattgttattaaaaatgaatcagatggcagtgaagtgtcgtctttgtcagtttcatcagggcagacagtttatttaacagctgactcggtatatcagaatattaacttgacagattcagacgaagcgtatagctggagcgtcagtgatgagaatttgggaacaatttcagctgacggaacctttattcccggcaatgtaagcggaacgggaactataaatgttagtgcgggttcggtctcggcttctgtaaatcttacggtttcagccggaccggaacagataccgacctccacacctcgtcctttggaaactgattatccgacgataacaagttcaaataccggaaatgcttttgtggctaaaatattcggaacacatgggattatagacgaggacaatattaaaatgactgtcgacggagttaaaaccaagtttagtttttctcctgaaactatgactgtcgaatatgtttaccctgaggattttttaaataatcctcatttgatatctgtatccgtaacggatgatgagggatacagcgcttataaaaccttaagcgtcggagatatttctgcattaaccaatatttttgaggatacgaatgaacactgggcaagggattatatctcatatatgactaaacgcaaggttgtttcaggatatgagacggataacgggtttgttttcagaccggacaaaaatatgacaagagcggaatttgcttgtatgataagcaattacttgggattaaacgtttataattaccgtggagttgagcttccttacgctgataaagatgaaatacctgattgggcctttatgcaggttcaggcgatgtactcattaggtataatgacaggtcagcaggatggggacagggttttcttctcgccttcatctaatattaaaaggtcggaatattcagttgcatcggcaaggttaatgccttcaggtctttatgcggctccggtttcagcggtggacgcagaagatataccggactgggcgagaagcagcattgagcttttgctgactcagagtataatgagcggttatacagacggttctgtcagacctaataataatgtgacgcgtgccgaagctgtaaaaattctttacggtataggatagagtgctttaaccttttatttgtaaataatgtaagtttgttaaaaaaagacttgcaatttatatcagttaggtttataatagttagcgctggggggaccgcggttatggcggttgagataagcaatatgcttgaccctttgaacctggcggttaataccgacgtaggaaagcacaaaatctaagagatagaatttattttttagtgcttgcctttgttgtaggtaagcacttttttgtgcgcaaatattttaaaaggagttttttattatggaaagaaattacactacacaaatggatgcggcaaaacgcggcattttaacgccggaaataaaaacggttgctgaaaaggagaatatgtctaccgaagagttaatggaattggtggctaagggagttgtcgctattccggcaaataagaatcataagacattgtcacctgaaggaataggtcaggggctgcgcactaaaataaatgttaatctgggaatatcacgcgacgctgcggatatggatttggaactcgaaaaggttagaactgctataaatatgaaagctgaagctataatggacctttctaattacggaaaaactcatgagatgagaaaaaagatattagagatttcaaccgctatgcttggaacagttcctgtttacgatacaataggatattgcgaaaagaagctgaaagatataactaaggatgattttttaagagttgtccgtcagcacgctgaggatggggttgacttcatgacaatacatgcaggaatcaaccgcgctacagctcagaaagttaaggacaacagaagacgaatgaatattgtttcaagaggcggagcgcttttatttgcctggatggaaatgacaggaaatgaaaatccgttttatgagtattatgatgaagttttggatatattccgtgaatatgatgtaactatcagtttaggagacgcctgccgtcccggatgtattgatgacgctacagatcctgctcaaatatctgagcttatagttttgggagaactgacaagaagagcctggaagaaggacgtgcaggttatggttgaaggtccgggtcatatggcattgaacgagatagccgcaaacatgattgctgaaaaacgcatttgcagcggcgctccgttttatgttttggggcctttggtaacggatgttgcgcccggatatgaccatatcacttccgctatcggcggagctgttgcggcagccaacggagcggatttcctatgctatgttacaccggcagaacacctcagactgcctgaccttgatgatatgagagaaggaattatagcttcaaagatagctgctcatgcggcagatattgcaaaaggagtgaaaggcgccagggagtgggataataaaatgtctgacgcccgccgtgagattgattgggataaaatgtttgagcttgcacttgaccccgagaaaccaaaagcgtatagagcaagttcggttccgcgtgaagaaaatacttgtaccatgtgcggtgaacagtgtgcagttaaaaatatgaataagattcttggcggagaagatataggcatataaggataatttaagaaagaggtgtttgggtttgaaaaatctattaactatagcaggttcggattcgagcggcggtgccggcatacaggcggatttaaaaacgtttgctgccaacggcggatatggaatgagcgtgataacagctgtgacagcccaaaatacgacaggagtttcagcagtgcacaatattccgcctgaaattgtaagagcgcaaatagacgctgtatttaacgatataaatgtggatggagtaaagatagggatgttgtctacagcagatattgccaatgcggtggcagacgcaatggaagtatataagcccaggatattgattgtagaccctgttatggtatcaacaagcggttcaaagctgctgagcgatgaagctgttgaagttataaaaaaccgtcttttgccgcttgcaactatggttacaccgaatattcccgaggctgaatatatgtgcgggcaggagattaaaaatattcatgagatggggcaggcagctcagattattggtgatatgggtcccggatatgtgcttataaaaggcggacacctcaaagaaaacgctaatgatttattgtataacggaagaacaatgacaatatttgaaggcggcagaatacatacacaaaacactcatggaacaggctgttcgatttcgtctgcgatatgtataaatatggcaaagggaatggacgcggtattggcggttggtgaagccaagaagtatgtgaaaaccggaattgaaaacggtttaagcataggaaaaggaaatgggccgattcatcatttttatgatttatggaaaacgtcagacccgaatgtagaaattgaatttaaatgtatagaaaaggaatagttttagaaatttttttaaaagaaaatataaaagtttttaattaaataacaaaatgttaagaccgatatttttatcagtaatgtgaatcattattttatataatataagatgttattaagaagcttgattattagtagataataactgtattgtggcaggtagggctatatttttgaaaaaagctcattgaaggttaataaaaacaattcactttgcatcacacccacctaaaaggtggggtcacagacattgaaggttaatcaaaacaagtcacttagtaacacacccacctaaaaggtggggtcacatccgatgcctgcaaagccacatttttacttaattttctattttagatttatctaatatacagtgtttttagtgaacatcggaagggcgtgcaagcacgcctcgttaggtgagctgacatatcacgcggagcgtgaacatatttaaaacaatatgtttatttttggttaatataaaataccactttttaaatttatgaagatttattgtttgagagattgttaaccggtgagcagatataaaaatgatttatatgttggtaacctcagatgtgaactaattaattttaaaaattaaaacttattatataataacgacagcatagacggaaaggatacataatttagctatgaataaaaatgacaaaatgcttaaggaagtaatagatttaataaatagaatgaaaagcactcgtcctttggttgagtgcttgacaaaccgtgtgactataaatgactgtgcaaatatgctgctagctatgggagcttctcctattatggcagaaattgagtgtgagatggaagaaatcatgaatatatccagcgcgctggtaataaatctaggattgcttgacggtacatatttgtctgctatgaaaacggctgccgaagccgcaaaaaggcttggaaagccaatagttttagacccggttggagcgggggcatcaaagcttcgggatgaaacctgcagagagatgatagaactgacaaaaccggatataataagaggaaatatgtcagaaatacgcgcgctgaccggcggcaatataagcagcaaaggtgtagacgcgtcagatgatgacgctgttaatgaaaccaaccgtttagagcttggggaactggtaagagggtatgcagagaaaaccggaagcgttgtttgtgctaccggagctgtagatattgtctctgacggtgttcaggtattttatttaaaaaatggacatgatatgctatgtgatgttacaggaaccggctgtatgtgcagcgctatgacgggcgcagcagctgcagccggtgagcctcttgcggcagcaatagccgcggtggttatgatgggtattgccggagagtatgcctatgaatatgttaaagagaccgaacagggtattggaactttcagagttaaactattcgattatatttatagtttatcagatgaggattatattaagcgcggagagatttataactaataatttataaattgggagataattatggataaagtaaattatggactgtatttagtaaccgatactaatatatgtcccagagaaaaactgctttctgttactgaatcggcaataaaaggcggagtaactttggttcagcttcgtgaaaaagatatatcaaccagggaattttttgctgaggcttctgaacttaaaaagctgtgcaagcattatgatgtaccattgctgataaatgacagaatcgatattgcgcttgctgtggatgcagacggaatacatatagggcagagtgatatgcctttaaaggtatcaaggagaattttaggttcaaataaaatcataggattatcagcaggaaacgttaatcaagctgttgaggcgcttaatgatggagccgattatcttggagttggtgcggttttcccaacgtcaaccaaaaaggacgcttcaaatgtgggaattgacatgttaaaacaggtcagaaaatctgttgatatacctattgtgggtatcggcggtatcaatcctgaaaatatcagtcagctgtatggctccggaatagaaggagtggctgtcgtatcctgcataatgggaagcgagaacccttatgctgtctcaaaacagctgtctcaaatggttaaggagttgtaaatattatgagaaatgaatcaaatagaaatggcaaagagtttttatcaaagaagaaaaattttatatttgatttggacgggacgctgatagactctatgtgggtttgggataacctgcttgttgattttctgaatcgtcataattatgaaactccgccggaacttttaaaagaagttgcatatatgtcgttagagcaaagctctaagcgcgtatgtgagctttttgaattgcctatgtctcctaaggatgtaaacagagaatggactgagatgatatacgacggttatgctaaagagataaaaacaaagccgggagccgcggaatatcttgaaaatttaaagcgtgaaggaaagacggtggcgctggcaacagcaaactcgaaagaattgaccgaagcatgtctcaaaaataacggaataatggaatatttcgatgttttgacatttgccgatgaagttggagagggcaagtcaagtcctttgatttatactgaaactttattaagagttaatggcgtacctgatgagtctgtgctttttgaagatatacttcaggcgtataagacggcaaaaatgatacctttggatgttgtcattgttgaagacaggtcagcggaaggcgataaatctgatttaatgaaatcggccgacctatatataaaagatttttatgacttaatataaaaatagtttttatttataataacttgattgtaacgatattaattattatatttgttatctttaatttggattatatgagtattataaagggtaacttgcttatatattacaatactattttagatataaaatatttatgtctaaaatggtataggaagataatattctgctcttatctatatattatttttgaaatagttatgtataaataagataaatttttgattgtattttatgatataaataaaaataaataaagtttaatataaaaggctatttttagccttttttttgttttatgaatttatattacaaataaatatatgtaattaatttcctgaaaaatcaaaaaatatgcaaaatcttgttgacaaaataaatgcgctatggtagattataccatagtaatattttgaaaaaaatgttaaaaaatattttatttagaatattaaattgcatatataaaaatgataataaaaaaatatataaaaaataatattaaaatgaaaaggaggatagaagttaagtttaaaatttagtataagtataagttggagggagaatatgaagaaattattaagtctatttttggttattgcagttgtattttctgtttctacatctactattttaattaatgcagatgaagatagtgaaaatgcgacaaatcaaggattatcaggggaacaaacatcggtttctgaacaattagaacagctggcagaagagtatactgacagatttattataaaatataatggggatattgaagaagctgtaggatatgcgtgcgatgaatcaaataaagtaaaacaacaggaattagagacaataaaaggtagtaatgaagaagagtttttaaaaatatcggaaaatgatgaagagattgtggtatctaaaagtgttcgtgatttaatatctaaagagaataccggtgatatatcaaccttttcagatgagcctgtatatgagattgatcaagagaaaagtgtaataaaactatctaaaaaagtagacccggaaatattcactgaaaaaatatacgaaaaggcaagcggaaggatagagtatatacagccggattataaacttgaattgtcggatatagatgaaggaagtaaagacaaagcagaagaggataaaaatatagattcaaatgatagtgataaaactcttttggaagatgagcgaaataaggaagatattcaaaaggaaaataaagaaacagaagatataagtgtggacttagaagttattgaaaatcaggctgagaccagtgaaacagaaagccctgtacctgaaacaactgagacttccgaacctgagaatgtagaatctgagactgaaaatatagaatctgaaactgaagagaatgaagaaattgatacggaatcatatgatgatttacagaatgatatacagtcaggatggcgagtaaccaaaggcacgggagttaagattgcagtaattgatagtaaagtagacattactcatcaggatttaagttcacatgtagtaaacggatttaatatagtaaacaatactgaacttacatatgaagaaaaccaaataggacagtattatcatggaacgcatgttacgggaataatatcgtcaactgtgcccgaagcggaaattataccaatagcggcatttgagaatggacaagcgtatacaagtgatttaataaaagcgatagaatatgcaaaagaacagggagcgacgattgtaaactgcagctggggaagtgcagataataatcaggcattgagagaagcaatggaaaacagcggactgttatttgtttgcgcagcgggaaacagtaggacaaatgtagacgaaacaccgatatatccagcaagttttgatatagaaaacgtgataagcgttacatcattaaatgaagatatgggatttagctactattcaaactacggaaacaatgttgatatagcgatgtatggaagaaatgtaagaagcacgcttccgggaggagaatatggtgagcagagcggaacatcaatgtcagcagcatatgtcacagccggggctgcaatggcagaatcaaacggagttcaaaatataaaagaaacgctgctgaatacagcggttaaattatctaatttgaaagataaagtaaatagtcagcgaaagctgagttatagtaatttaggaaacaatataatttcagatgagataatagaaatatcgccgaaagacgattttgatgtcaacggatatcaaagaacaccggaagaaaattgggaactgtttagctcacttaaaacagtacaagtagaagccggaggaaacaacacagcatttataaagagcgacggttctttatggatggcaggagataacacatatggacagttgggtaatggaacatatgagaattcagctgttcctgttcaggtaataggcttgacagatattgtacaggtcgcagttggtgaaaggcattgtatagcactaaacagcagaggttatgcgtatttatgggggtataacggatataatgcagtatcgttttcagataatagaaaaatatcattgcctgttatgcacacactatcaaatataacttatgttgaagccggctcattaactagttttgtggttcaggggtttaatggtatatatgcccagggagataactcatatggacagctgggaaatggtacaaaagatacattagctatattaacacatatggaaaattctaatggagctgatattgttaaatcatataataaacatacatttttcattaatgttgtaactgtatttgcctgcggagcaaatgaccacaatgttttgggattatcatatgctggcactacacttacacctgaacctgtatcaataagtatagatatagatactggatataaccatgcagttgcaatagatgagacaggtatgattacagcatggggaacgaatgattggggacaatgtggtaaagggatagacggcaaaggatatatagatatatataatgcaaaagatgttaaatgcggcaaagaacatagtatagttcttttagaagacggaactgttatgacctggggatataatctccgcggtcaaatcggagacggaactcacaataaaaggtacgagccttacgccgtaaaaggtatgactaatataacacagatagcagcaggaaataatcatactgtagcattggatgcaaacggtaatgtatggcgttggggagataattcatatggacagtttggaaacggttctacagtatcatcaaacagtcctataaataattattacggtgatttggagcataaaaatataagcagtggttctaatcatatattatatgttgataaagatggtaagttatttacaaaaggcgataatacatacggacaattgggaacgagtgataatgtatcgcgtgaagattttgctgaagtccatgggccttggggaagtaaaaaaatagtgaaagctgaaacatgtgcggatacttcatttgttctgacagaagataataaggtatacggatggggtagaaatgacaaatatcaattacatgacaatactaatattgataaaaatgttcctatattgattgcaatcgcagtaattgatgtagcggcaggattagaacacgtaattgcactttcaaaaaatggcgaggttatggcgtggggagaaaatacttatggacaaattattttagacactatatcaggcagcagttatacacgacttttctcaaatgctaaaaagatagccgcaggggattatcaatcgtatataattgatgaaaattccaatttatatgcattaggaaaaaatgacaagggacagcttggaacttcggatactgaaaataaaagtcagcctgcgtttgttatgaataatgtaaaagatgtgtcatgcggaaataatcatactgctattttgactaacagcggaaagctttttgtgtgcggagataatacatatgatcagttaggtataacattgccaaacagtgcaacatataccagcagtccaacagatacaatgctctttgcaggagagatatttgccggagccaattccactgcatatatggctgatggaaaagtgtatcaatgcggtagtgttgctgatacacagaataaatcatatcaggctgtagaaggtttaagcgacataactgaagttgatataggagaaacatgtttggcagcaaatgcagacggtgagttataccgttggggaaatatggctgccggtaaatctttgaaaaatgatataacagtaagtcctgtagaagtagattatccatatgcagtaaaacaagtagattcataccgcacgcagaccttggcaataaatgaactcggacaagtaatcgcctggggagaaggctattatgcaaacggttcggataaaatggaaacaaaaacatacccgactgtgattgagggaatagaaaatccaattcaggtgagccgcggtaaaaatcataatttggtgctggataaaaacggtgatgtatggtgctggggaagcaatacgaataacccaatgggaacgttgggaggaaaggtaaagaaagcgtctaaaatgaccggaatttctaatgtaaaacaaatagcagccggaacagagttcagcatatttataaagaatgacggaactctttggggagtaggcaaaaacgataaaggtcaaataggacaagggaatacagatgattatttaacaccgacacaaataacggcaatgaagacttttaaaaaggtgagcgcaggagaatcatttgttgtagctttagccgaggacggactgtattcatggggagcaaacacagacggacagattggaaacggaacaacggatgatgaatatatacctgtaaaactgaatgcagaactggaaaacggagaatattttactgatatatcagcaggaacaaacttctgccttggtttaactaactttggcaacgtctattcatggggaaataacggaagcggaaggttaggattgggagataaaaataacagaaatataccaacaaaaatagttggtataacaggaataaaaaatatttctgctggtgatagcagttcattagccgtaaaaaatgacggaacagtatatggctggggatatggttcagatggacaattgggattttttgtaacaggttcaacattaaacccaaaagaaataacgacattaaacggaaaaaacataaaacagacatcatgcggaagagccttttcagtagcaataagcagagatggaaaattatattctttcggtagaaataattccgggcaattggggatatattcttctataccggtaaaagttacatcaaatatgataaatgatacaaaatggttaaatggttatatggctcaatatttatctccgatcgcagtaagtatggttttgccaagcagcgcacccaatggaagcaaaatagtttggaaaagcagcaatacagattatatattggatgatggaacttttattaagcggccagatcgttgcagtgatgatatagaaataaatttgtctgctgaaataagcaataacactgaattatttagcacttgttttagttatataatagaaaaagattcttcactcagtactgatgtttatataagtgcgaaaaagggtgatatatcatcaattgttatttcaaatgatgagaataacaacatgttatatactataacatttgattctgatatttttgaaattgttgatttaattgggattacagatgagcaagatattcttcctggctgtcaaaacggaacaattaaaattgaaagtgttgataaaggtgtaattacttttaggtattcagcaacaaacaattttaatggttatattaactgtttaaaattcaaagcagctaaagacgggaatactgaaattaaaataacaaatattatagaataaagtgagggtattattttgagaaaaataatttcactattcatagcaataatcattttgcttggaatagtacatataaatatttttgccgaaggaaacgtgcagaatgaaaatatagaaatgttttcaatgccgcaggatgcaaaatatgctgaaaatgaggttttaatacagtattcgcctgttggaatgtttgcagatgaatctgatgttagtcctgaattaatgatgtcagaaaatcttgaaagtgtatcaagtgtggaacttatagatacgttaagtgttgataaggaggacggaagcatattaaaacaattacatgtcgaaaccgaggatttggaaaagacaataaatgaaatgagacaaattccaggtgttgagtatgtggagccaaattataaattatatgttgcaaatactgattacgacccgaattttacaaaacaatgggcatataataatccggtgtataatataaatgttgaaaatgtatgggaaaaggtgtataatgataatatatcaaaaacagaaactatagtcgcagttttagatactggtgttgatatatatcatgaagatttaaaagataatatatttaaaaatcaagaagaaatatatgggaacactgaaaaagatgacgataataacggatttgttgatgatattgctggatgggattttttaaataatgataatactgtttatgacaatacaacagattcaactggtgaaaaaacagatagtcacggaacacatgttgcaggtattattgctgccgctaaaaatggagttggaatgcaaggggtagcatatgaaaatgtaaaaattttgcctgtgaaatttattgcgggaaaagagggcggagatctttcagacgctataaaaggaataaaatacgcagagaaaatgggtgcatctattgttaattgcagttttgcaagtaataatgaatttttaacactaaaagatgttatgagaagaagtaaaatgttatttgtatgtgctgccggaaatcatgggactcagctaaaagaatatccggcaggtttcgcagaccttgataatgtaatttctgtatgtgcgttaaatcaagaaggagatttaacatcttttagtaattatggacatgattatattgcagctccaggtaaagcaatatacagcttagcacctgaaaataactatatgtatatggatggaacttctatgtctacaccgtttgtagcaggtgcggcggcattgcttaaaataatcaatccgagtttagattcaaagcaattaaaagacgcattaaataacggtagtaagacttcggagacggggctttttcatggtaaattggatattttgggagcgtacgagaattctcctttgaatcctgatgagggtacattagtcgccggaataaaagaatatggcggtaaaataataaaccatgacaatagtatatatagattggcaggctgcgatgaatccggttttatgaacaatattgctgtttataaacctgatctaggagtatggagcgatgttacttatttgcgtgaaggcagaatatttgcagcgcctgtttttattgacagtactatccggttatgcggtggaagaagtatattaaaaaaagatcttgatacaacatggacatataatatacatagctattttaataatactattaaaactaatacaggttcttattatatttatgctaaccgcagtgccgctgcaggagtaggagcagagggtaaggtttacttttttggaggaacatctgatggcagatatgctaatgatgttttatctgctaagccaacaagcagtagtgattttcgatgcttaatgccggaaagtcgcgggtatgcctgtgctgaatatctaaatggagatatttatctttttggaggtgcaaatgaaaacggatgtttaaccagcacatataagtatgatatatcagaaaattcaataaaagaatgtgcgccaacaaattattatcataataatgctgcatctgctgttattgatggaaagatatatgtttttggcggaacaaatcagtataccaaagacggacatgatcctataaccgaaaataatggtattatttcagatgtacccaataatattgttgaagtatacgatccaaacacaaatatatggacgcgtattgcggacatggacgcggcaagagttggtcactcagctgtgttttataaaaataaaactatacttatgggcggatggaatggagaatatcttgattctgtagaatactattggggcagtgaagcccctaaaaatgtgaagtccgctttaagcatagatatgcagtcaacaatgttgtcatggcagcctgtaacaggagcagattcgtatgagatacagattggagacagagagcctatattcactgctgaaacaaaagttaattatttaatatctgaaccaaatgatgaaaattttaaggttcgtgcaattaaaaacggaggcgttagcgtatggagttcagaaagaaaactctatcctttgggaactaacataaatgatgcaataaaattaactttgaatgtgcctgtttcagatatattaaaatcaaatgaaaattcaaaatattataagtttgaaatagatagtttaacaaatattgatattaaactattcggtatacctcaaaattttgatggtggttttgaaatattagatgaatatggtttgcatatagcaagcggttactcaaaaaacgggaatattatgattgaaaataggctgatgacaacaggcgattatattatcagagtctataacgtgccttcagatggttcagatttaaattatacacttgaggtttcagaatattatactgaagaaaccggtaatcttccgacaagggtatctcaaaatatgttaaactcggttgatatgtcggtttcaaatacaaattatacaattattgatgacggaacacttccggataacagtatgtcaatagaaatggaagaagataattcaggtgagtttggaacaaacaatacaacaaccgtttattcaggaactggagttttaaataaaaatgttttgagtaaggtgtttacaataaaaaatgtaaaaagggggtcactgataattgcagttgtagaaccgccgtcaggatatgcatatgttccatattttatttcgaacaatcttgactcttcggtaggctgtttagatccgtacaataatactaataatatagcatcatcgtcctttttagctaagagtgatggtagttattctatcagagtcgtgtgtagcaatggtgagtatgaccctcaagggggagagtttaaaattaaagcgtttgtaaccaccgatccagaaaaatttgaatcaaatcagtggcagatgggggcaaatgataaggaatacggagacaaatcagctgttaattttaataaaattgaacaagcaattggaacaacaaataagcctacttctggtatagacgcaaaattttctacaacttctgatatagatacatatccaattgaggtttcgcagggtgaaaaaatatctgtctcacttgaagtagacaaatctgaatatgtaggctcatatacgataagttttcagactaattttaaagattttaattatcgtgataatccagatggtgtttcaaaggactttaacataacatatgaaaggactgattgtacaaatccgtataatgtaaaggcatataataattcggcatttgcttcatggattgttcctaataatttagtatcaaacacagcatatatcgtggtacagaaaaataaaaaatcgatggatataggaagcgaagtaggttatcatttgataataacaagagtatctcctgaagaaatgaaaaaagatgtaaatgaaaacagtacatatactccttccggcaagaaagcattaaacggagatgcagaaacatctgcggttacaccaattacccgccgtaatgattttattaattttaaaaataataaaaattcagcgggcaagcttactcagcaagtatccggcaccggtgtgatagacagtcagctcgacgtggattggttccattatgaaggcactgttaatactcctaaccgtgttgtgttaaccactgaagctgataatttgaaactagcgctttatgaaaatggttcaaccagggaacttgaaaatggtgatacagttaattttaaaacttctgattactatataggagtatacgctgaagatgaaacatatggtcaaaatcaagcggcagattatatactttcggtaatagatgactcgaaagaaaaacaggacgtgcatatagttctttatgattcgggttacggaggaaatggtttctatgatggtcaaattccaaggtactatgacagttcaggaaataagttcgaatactcggttgaattctttaaaaaatatcttccgctgctggttaataaggatgtgtatttttcagtttcaatcagagacctggattttgacagggtatttctgcctgttaacaacataggagatttaagaaatgatccatttatttttgataattatgacaatctttcaggcagcggacagcttgagcttgttaaaaacttaactattgacagggttaataatgtatatgataatatgatagcagcatacagaagtctcccgaattatcaaaagccgaaaacaatgcctaaaatatatattggaactccgcactatacaggctggcagattagaaattgggacggtacaaatatagataattatgttttaaaatatgatgaaatagtcagaaatatttatgagggcgtacggtcacatgttattgctaaatcaggaagcgacaatgatatagctggtttatattacggcaaagaggatccggaaccgtataatacatcttttgaatatacaaaaataatgcggaatacttcctcaatgattcacggagagggcaaaaggatgatttggatgccatataccggcggaagtataactagtgtaaacaacgtatgtgatattgccaatacatacaattatgacgggaaaaaactatgtgatgtaatagtaatccagcccggatatttttactatgaggtcagcaatgacggcagaagcgatagtgaatatcctgagtttatgcagtatataagggatatagtgtttaataatgataagaattcaggaacggatttgtgtttccaaatggaatatgattcatctatttttaccggaagaatttataaagatatgtcatcaaatccaaataacaaatcctatcgttttgctaagactcttgatattttcaaatatttattaacaacgcctgaatattcatttggaatttatgctggcgggcctaatgaacagggttacaatatgaataaaatatctgataatgtaaacttacacagtaaccgtaatcatataactctttatgaaaatgatggtcattataaaacttataaagatttaacagatatagcaagtaattataatatggcgtataataccaaaattacatatgatataacagcagggttgttatttaatggatggtcgtcgcaagtcagggataatatacatcgtgtatataatgaattatttgaagagagcagagttacgctttactaaaaaaatgtaggaggagaaatgtatgaaaaaatttataacaatagttgtcttattattaatgtgtttaagtataaatccggtaaaagcacagagagttgaagaagaggagaacaatataggtacatattttcagcttggaacatacgaagatgatccaataatatggagatgtataagtgatgatgacgaaaatggaatgcttttgttgagtgataaaatattgtgctataaagcatataacgcaggtacaaatgttgatgattttttaagtcaggatatgtatggctcagatatatgggaaaacacaacgataagagcgtggttaaatgcaatagaaaatgcaggtaatattatatggccgggtaataatcctcccaatacaaaagtaccattatcaccattcatgccatatgtagatgaagatggatttttgtctgaaagaaattttagcagtagcgaactgtcagttattaaaacagtaagtcaatggcagatattaggaccaaaggatgcggagttatcaactaacggattaaaaaagtgctttcaaacaaactattatccttttattagtccatatggtccatataaaatgtttgactcatccattagaaattttagtcatatagaaggagcaatgtatagattaagtgatacaatgtttctgattgatgaagcacagatatataagttatggacaaatttggggacagtaagggcatatccaactcaaagggcattcgacagtgttaaaaatgataaagattattatgaaggatttgaagaggaatatatgttaaggacatccaacagaagcgcacaatttatatttggtgacgatgattatagttcgggaatatgtgcgtatagttatggagtgagaccggcattttatttagacacaacaaaagccgagattatatcaggaagcggaagtatagaagaaccatatataatagacggacagcctcaaacaaatgcagaagtatactgcaacggagagagaatgcaatttgatgaagaaccggtggaggaaagcgaaagattgctggtgccggtaagggcaatatttgaagagcttggagcagaggttgaatgggaggaggaaacacaaataatcacagcaaaaaaagaagatacaacagtggtaatgcagatagataatccggagatgggaaacagcagagaagtggtaacattagaggtgccgccgaggttggttggagagagaacaatggtgccgctgagagcagtatcggaagcgtttgaagcgaaggtagactatatagaaaacttaaatcgagtagtggtagaccagccgaaactgccaatggattttggagaaagactggaaataccgatggaaaattggcagcgtaaagatttcgagagcatattccccgactatgagccgttttaacgaaaagtgtaaagggtatgagaatatcataccctttttagcggaggaggagaaaaatatgaaaaagtttataactatttaatattattgcgtatctttttatttataggatagaaattaataaataacaacaaataggcttcttaaaaatttataagaagcctatttctatttgtttatataaagacataatttctatttaccaattgggaaatatggcaagaaaaacaattggaacggaacgtctcgaaatatattgatatgataaattaggaaacaatatttctgcaactgtaagcaaacaggacggtacagaagctattacaactcaaaatttgtatgacagccgcggaaatgtaagatttgaaatggatggcaacacaggggataaacaaaaggaaataccacatattatgaatatgatgaactgggaagactaataactacaagccagaatgttgaaggagttttagaaaccaacagatatgcttacgacttatttggaaatcttgagacgcaaaccaatggcgaaggacatacgactacattccaatacaatatccgaaatgaaatgaccgctaaaattgaccatggcggcataggtatagcttcaaagacagaaagctataagtatgatgagcgtggaaatgtgacagagaaaaccgatagaaatggtgtaacattatcttttgtttacgatgtgcacgacaggcttacagatactaaactcggcgataatgtcttaatacataatacgtacgatggagccaacaataaactgacaatgcaggacgaaagcggaacaacaactagaacatacgacaaattgggcagagttttgaccaaggatgttcccggtattggaacaacgacttaccaatatgatataacgccattgataaataacggagaagtatcagaaaagactgttgatccaaagaaaaacgtaacgataaagacttatgataaaaacaacagactgcacactgtcaaggatgcagaaaatgcggagccaacaacatatgaatattatttaaacggcgctcaaaataaaataacaaatgcagacggttccaaagccgaatttgagtataatgacgacggaactttatcaagcattgtgaacaaaacttctgctgatactataataagttcatattcatatgcgtatgataaggcaaaaaatctgatatataaagaagaaactgagtcaggtgcagacaagggtgcaacaaaatacacctatgatgaagcaaacagattaaagacggtaaccgaaccgtcaaataagcagacgtcctatacatatgacaaagccggaaacagaaagactgaaacggttacagaatccggaataatatcattaacaacgtataattataacgaacaggagcgtctgacagacactgttcagactgttggaaataccaaaaagacggtatcatataattatgataataacggaaatatacacagcaagttccaaggagtggaaaaatcagacgacggagaggaaacagaactggaaataaagctgctgggactagatgatgactcagaaataggtgcggtatatgaatatgacgtgttcaaccgtctagtaaaaacatatcagggaagcaacgtaatttccaatgtatataacggagaaggaaacagggtatctaaaacagtaaatggaaatacttgcaaatatctctatgagtatgataaaatagtgttagagacagacggagacggaaaccaaacagcaaggaacgtatatggaacaaatttgataacaagagagtctaatgataaaaagtatacgtatcattataatggacatggagacgttacagcgctaacagaaaagagcggaaacattgcggcagcatatgaatacgacccgtttggaaatatcacaggagagaccggagatatagagaatccatacagatacagcggatacgaatatgataacgagacagagttatattatttgaaatccagattctatgatgcagaaacagcacggtttatacaggaagatacatatagaggagatgcgagtgacccgcttagtttgaacttgtatacatattgtgcgaataatccaatgacatatgtcgacacaagcggacattcatactacgggacaaagtatgattcttttgaagaattatatgcggcgactattgagaatcctcaggaagtagaagaaatgctgtataaattaaatgaaacagaagaagggcgcgaaaatctaggatatataatcaatgcgtatgtatatgctcagggaggtttgcagcagggaaatgacagtgtatttcaggttatatacgcaagcgcaccgggcagatcacgtgatatgactgtaggaagtaatcccagtgggtggataaattcagaaaaagacatgtatgacaactatcagtttacgatatttgatgctctaaactggttaatccaaacagggggaagcggtaactttgcattgcagacaagaactacagatgatccgaatgtagcggcagacgcaatgaaaataatagttggtaagtttatggacgcaagaaactttcttcgttccgctggaataattgataatacagtaacgccgcaattatacataggtacaacggaatatccaactgaaaactatgttgaagatacaaaacagatatatgaaagtattacgggagaatggtggattgatgacagtataataggcggaatatattacggtaatgaggaaggtaacgatgttgatgagatgcgtatgatatctgactatatacatgataagaataagcagttgatatggaagccatatatttcgaaaattaataaagacgttaatagtattctggattatacaaagtataaggataatagagggcggccattattcgattatatatttatacagccaagtttatattattcttctggtaaatccgaaaattataatatgcttgaaactgtttataatgctgtattagaatataatgttgctaataaaaataatgataaagagcataccaaggtcggaatgcagatagaatttgatatgggacttgtgacagggcgtaatgatgcaagcaatacagcaacttctttacaaaagagacaatttcttaatgcatatttaaaaaaggtaaaaacacttaaagctaatggagttcccataagtgtatattccggcggtccaaatgaacaaggatatgacaatatatatggaaataataatacgcataacaatggtaaccatataccatatgaccagtcaccatccggtatgcggtacagtgatttccctgatgcttatacaggcggaaatttaatatatgatgtaaacaattacatatataacggcgtggacaaatggaaagatgaattatcaacatctatttggttgacaaaacctgacaaatgataattaaataaggaggagcaaaaaatgaaaaggttaataattatttttttgagtttaacaatagcaacaggaagtatattatttgtgtcggtaatcgcaaaaagtaattctaatataattgaatctgaaaatttaaaaattgattgtatgcaaatgggagaatactttattttaggaaaatataatgatgagccaatagtatggagatatgtggcggatgatgagaatggtaaactcatagtaagtgataaaatattgtgtttaaaaccatttggagaaaataatttttgggaagaatcttttccaagagcctggttaaattcagatgttgcggaaggcgaaaaagaatggagttgggcagtcaattacaataatcttgttatagatagtgcccaaattcctactaacgagaaaggatttctaaatgaaagtaatttttcaaaaaaagaaagaaaagtatttaaaccggtaacgcaatggactatgctgccgttaaatcatcttgatttagcaacaaatggggagacaaaggtatatacagcgctaaaggaatataggcagggaagttcgatagagccttcatattttaaattctatagtgtcgaagaattgccggaggcatatcatggagcagcgtacgaagtgacggatgctgtgtttttaatggacgaaatacaaatatataatatgtggaaaaacttaggtgaagttaaagcggtattaggagaagattgtgatccattatttacaaagtcgagtgaatataatgattattttttgcgtactgcatcagaagatgaattgggttgcacttctttggatgaagatggagaatatgggcagtattcatgttatttttatggcggaataagaccggcattttacttagatgaagataatgcagtaatattatcgggaagcggaacagcggaagagccgtatataatgacaggaaaagaaatagaagtatatacaaatgggacaaaagcagaaatgagtgaccaggcaacaataaaagacggaatagtaatgttaccggtgaaagagacatttgagaaattaggagcaaaagtaaattgggatgaagcaacacaggccgtcacaatagaaaaggatggaaactacatctatatgttaagagataacaaaggaataatgataaatggagaaatatacgacttaggttatccaatgacaatgatagatgatgtagcatatgttccgctgacagcgatagagatgtcaataacaccgaacgtaacatggaacggcgaacagtatcgaattgatataaattaataaattgtataaaatttttagttataggatttaaatgaataaataatgacaaataggcttcttataattttttaagaagcctatttctttttgtttataaacctaaaatttatttacctactgaatcttcaggtacgtatccagctttgataatttcttcaataaataaatttaggtctataccaccatttattatgatattaattaaactcttaaaagacgggagtcttttcccattttctaaatctgtgtattgacgtggcgatagacagcatttttccgccattttctcttgatttaattttagttccattcttctaaagtatagtgttttactaaagcacttttttaagatattcatcatttcactcccaatctataaaatatgtgaatattctatcaaatatatatttctaaccatatgagatatattgcacatgagccttgtttttcagctatccaagtaagcggagatatggtaagatgttaaaaaaagaacaaatttggaaacagtaagaaacataatatgcgataatgaacaaaatagtattaaaatacaacgatttcggattataatgaatacagggatttagtgaaaagttgggactctaattctaatggtaataaaaacaatgacatcggaacgtatgtaacaacaaatttagacagcaacacgataagagtagaaaaaacatattgggataagttaacaattattattttactgattttaacttcagataatggtaataacggtagaatattagatgaatgttattatatagagtttaacaattaagatcctaattttgatacttattgtcagggcgaaactttacatcattgtctccatttattaattcatagttgtaagatcttatcggtggtttggtatgcaaattgtttttattaatgtctgaataagaaatatctttaatatcaaacctcggtatattagtaacagcaaggagcatatatcaaagaaaggatggtagatgggtatttaaatatcaaaatgaagaaatggtcaagcctcattatggctatgataaaacagaatccgcagtaaaaagaaaacttagagagtataaaaaagaggttgcaaaaggcaattttgaaacacaagattcgtatatgttatttcaagattactgtttagactggttaaatagtgtgtataaaaataaagttgttgttactacattttctgaaagattgcgaacaattccatttaaatcaaaggcaatagaagtaatagaaaagataatataaatacagcaaaaattgggtataacaagtaatagaataagtgctacattaaatgatacatatgtttcttcaagatcatttatatatagaattaatgatttgctgaaaagtatacaatcggaaaaggagatagtatctcatgggttaaggcatacattcgtaacattatctgcggatgctggagtgcctctaaatgtagtttcaaactgggtaggtcataaaaatgttgaaataacacaagactataatcacattttaaaaactcaagtagataaaggggtagcattattagaaaattggtgatgaaaagcagaacggtgtcaaattggtgtaaataataaaatgagactttagaaataacgtttttacggggatgtttgtattttgtgacatttttattaattttgtacaatttgtgttgcattatttgaaattttaagttataataacaattaggtaaaattatctgtacaaatatatttgcagggggtgtcgaatgtgcagggcagagtatttcaaaatacgcttgtacaattgaaaagagaagttcaaaggacgctgggagttattgatgacagcgacacaatcatcgcgtgcagtgatgaggataaaatcggaaatactgttgataatatttttacagttttttctgctacaggtgaagtaaagacggtggcgggagcctgctataaaaaaatagaaacattcagtaagtgtgagtttgttgttttctgcgagggagacgacgatattgccagaaatgcgtgttcattccttgctgtgaactttttgaccattaagcagtattatgacgaaaaatatgacaaggcaagctttgttaaaaatattatcgttgataatgttctgccgggagatgttctttatagaactaaggaacttcatattaatgttgagtgccccagggttgtttatttaatcagggttgttgaggagaccgaccagggataccttgagatattaaacaatcttttccctgataaagcaaacgattatgttatccgtgttgacgagcgggacgctgttgttgttaaggaatttagaacagaacctactaaggaagaaattatggttatcgctcagaatatttttgacactttgggcgctgaagctatgattactccgctcattggtatttcaactcttgttgaaagggttcaggatttgtcccaggcgtatagggagtcaagaattgcgcttgaagttggcaaagtgtttgataccgagaaggatataatcagctatgataatttaggaataggccgtctgatataccagctgcctacaactttgtgtgaattgttcctggacgaggtatttaagaaagaatctattaatgtgcttgacagcgagactatatatactattcagaaattctttgaaaataatcttaacgtttcagagacttcaagaaaactgtttgtacacagaaatacattagtatataggcttgataaaataaagaagcttaccggtcttgatttgagagaattcgacgacgctattatatttaaggtagcgatgatggtaaataaatatttgtcatctcagccaactaggctttagtatgtaatttgtgcggctgaataaatttaggccgtggataatatgattaattagtgggggcggttttaagcgagttttttgtcgctttccgcccttgtggtttattattttgattggaggaattacgatgagtaaaaaggctgtgaaggttactgctatagttatagcggcaatatttttaattggtatttgttcgggcatagccgcgtcatttttgttttaatggcataaatttgtattgggattatttatactaaagcggatgataatgttattcttatgatttaagaatacttttatgatccgctttatgaatgcggataaattttgcagtaaggttctttgattttagtttggtaatatatttttaaggagcagaatatgtatataaaaaaacgggtattgattgtttgttcggttttattaattgttgtgactgctgtgcttaccgtaggtcttgtaaatccttttggatttacaaattatcttgactttataaagttttcaacagttacaaacacaataaaaaatatgtattatgaagacgttcccatgtcggattatgtaaacagctccattgagggatttgctcaggggacagaagacgcgtatactaattacatttacggcgaagaggctgatgaatatatggaagatgtcagcggaagctttgatggtattggcgtgtatatagaaaataatatcgaagacaatacaataaccgttgtatcagctatatcggacactccggctgaaaaagttggtttggtaagcggtgataaaattttaaaagtagcgggagtaagttataccggagagcaaatcaatgaggcggtcagaaatatgaaaggacaaaccggaacgactgttgatattgaggtcttgaaggccgagtcaggtgaaacggtaagccttacggtagagcgtcagcatattaacgttaaaacagtaaagtcaaaaataattgacggaactaatataggctatatatcaatatcacagtttattgaaagtaccggtgatgattttaataaggctttgagcaaattaacttctgacggagctaaatctttggttttggatttaagaaataatccaggcggatatattgaagctgctgtggatgtcgcatccaattttgttaagagcggtgaagatgtggtatacactcttgataagaaaggaaacagggaagattataaatcaaatggaaagcagtattatatacccgttacggttcttataaatcaaggttccgcatccgcaagcgaaatagtaaccggggctttgaaagattatggattagctcatgtgataggagaaaaatcttatggtaagggaattgttcagtctgttttcggtttaggtgacggaattgtttctgtaacaattgcgagatattatactccgaacggaacttgtatccataaacttggtatagaacctgatgagacggtgcctatggaattaaataagtacgctaatcttgataacttaactcttgaggaggatgaacaattatctgcggcagtgaattatttgaattctgtttcaaaatagcttttagaaagaaataatactaagattggtggagtgaactatgtcattttttaagttcatctcacaaaagataaaagatttatattattttataaaaaaactgttttataataaaaaaatactgattgaacagcaagaccgaaataagcttacggaaaaacagactgcagagtatccggttaaagtgccgattggctgcgataatattgaaatatcaattaaatatgttttgagtcttttgaatactcccgggtttaaagcaggagcaggtataatcgttgacgatgtcgatgatttaagagggcttaacacagtaatgaatttggtttgcagagagtttaaatatgtaacgatatataccaagaatatttcagccggcaataagactgcagattatgtttattcaaaatttggtcttccgattatggtgctggatgtttctgaatcacaaaagtgcagatatcaggtaataattgatttcaataacggtaagctaagatgcggaagagatttatgcgttaccgggaccgcaaaggataagaatggtgataccgtgggattatatttgggtgagcgtttggtgacagtataaaaagacataaatataattaatgtgtattgacattttatagttattaaagtataatttataagttaatcatagaaggtttagttgatatataaaaatatcggaggtaataagaatggacaataaacaggtaaagttgactgaggacggtcttaagcagcttgaggaagaacttgaatatttaaagactaaaaaaagaaaagaagtttctgaaaaaataaaagttgctcttggatttggagatctttccgagaactcggaatacgatgaggcaaaaaatgaacaagctcaggttgaggcccgcattgtctctgttgagaatatgctgaaaaacgctatagtgattgatgagagcgaacgcgatacgtcaaaagttgaacttggcgtaaccgttactattcacgatattgaatttgatgaagatataacatataaaattgttggttctacagaagctgaccctgatgagggaaggctctcagacgagtctcctcttggcaagtcacttatgggaaaggctgaaggcgaaatgattgatgtggacgcgcctgccggagttattcaatataagattttaaagatttcttaattttctgagcgtatcagaataatagttggagggaaaaatgagcgagaataatcaacaaaagaataatactgaaagtgatttgaacgaggttttaaagattagacgtgaaaaacttgcagtgctgcaagaaagcggtgctaatccttttgaaatcacttcatatgaacgaacagatatggcaggagacataaaggaaaattatgctgattttgaaggcaaagttgtctcaatagccggccgtcttatgtctaagcgtgtaatgggaaaaatgtcgtttgcagatttggcagatagaagcggaaggattcagctttgtgttaagcgtgatgaattgggagacgacgaatataaggtatataagaaatatgatataggtgatattgtcggagtgacaggagaggtgtttaccactcaaaagggcgagatatctgtaagagcatctaagatagtgcttctttctaaatctttgcggccgctgcctgaaaaatatcatggtcttacaaatacagatttgagatataggcagagatatgttgaccttatcatgaatccggatgttaagagaacgtttgaactcagaagccgtataatcagagctatcagaaactatttggacagcagaggttatatggaagttgaaactcctattctcaatacaataccgggaggagcagcagcgcgtccatttattactcaccacaatactttggatattgatatgtatctcagaattgcgcctgagttatatttgaagcgtctcatagtcggcggttttgaaaaagtatacgaaatgggaagacttttcagaaatgaaggaatggatgttaagcataatcctgaattcacaacaattgaactatatgaagcatacaccgattatttgggaatgatggagcttactgaagatcttattaaaactgtagcacaggaagttttgggcacaacaaaaattacttatcaggatgaagaaatagatttaggtcagccgtgggcaagaatgacaatgcttgagtcaataaaaaaatatacaggtgttgatttttcacagactaagacggcggaagaggcggaagaacttgcaaaatctatcggcgttgaatgtgacgctgacgcgcctaagctttcccgcggtgaaattatcagcctagtgtttgaggaaaaggtagaagaggaacttgttcagcctacgtttatttatgagtatcctgttgagatttctcctcttgctaaaagatttgcggacaaccctgaatttactgagcgttttgaaatatttattacccgcagagagtttggaaacgcgttttcagagcttaatgacccaatcgaccaaaaggaacgttttatgagtcaggtcgagaagagagagcagggtgatgatgaggcaaacatgatggatgaggattacgttaatgcgcttgaatacggacttcctccaactggcggtctgggtataggtattgacaggcttgttatgctgctgaccgacagcagttcaatacgtgacgtcttattgttcccgacaatgaagccgcttgattagcagttattttatttattagtgtaaaaagggatatttgcggagttaaatcacatacagaggtggtattatggacagagatgcccgtgaggctaaagctatgacaaaggaactgccggttaaagatagaatggcaaacttttggtattataagaaatggtggataatcggaattgcggcggcattaatagttgttgcaattactgtatttgagattgtgaatactccgcaatatgatttatatgttggctattattcagagacagctgtctccgatgaaactgtaaaccgcattaaggaaaccatgttggattttgccaatgatgtaaatgatgacggagttgtgacaatatctttgacgcctatgattgccagcagggaagaggagagcgacgagtttgttgcggttcaaaccagacttatgagcgagcttgattccggcgataatatgatttttattgttgacaaaccatatagggattatttgatgagcggcaataatgcagactgctttgattatgagctggatttaaataccaatcctgttattatggagaagataggttacagcggtgatttatatttgctggttaaatctttgtatgaaagagaatccggggattttaagaaacgagcttctcataataatgctgtgacaatttatgaagcgttttcaaatttttcgggttagaaatcagtgtttggggatgatataatgattattaattttaatgaaatagaagaaactgttattcctaattttaatggcggagaaaaaagtgttgcatcacatatgtttgttgacaaaaacaataaaattatgtacggatgtttggaacccggagcgtctattggattacatacccatgatacaagcagtgaaattatatatattttaaatggcacaggaaaagttttgtatgacggtgaatatgagagtgtatctgagggattatgtcattattgtcccaaaggtcacagtcatagcttaattaatgacagtaaaagtaacttagtgttttttgcggttgttcctgaacaataatatatttagggagatgtatttatggaggatgagtttgaaacagaaggaaaacttgatgagaagcagacgaaacattcacaaaagttattaaatgataaactgatttcaaatatatcatcattttttaaagttttgggagacgaaacacgtgttaaaattttgtatgcgctgtctcaaaacgaaatgtgtgtatcggatatttccgctatgcttgatatgtcgcagtcagctatatcacatcagcttaagcaattgaaattgggcggacaagttaagacgagacgtgagggcaaaagtatttattattctatagatgacgaccatgtggttgatataatcaacaagactttatcccatgttgaacataaaataaaagacggtcagctgctgtaaaagcagctgaccgtctttttgtatcttaacttgttttttattttgtcatgaaattatatatcattattgcagcgtctgcgcgggtaagctctccttgaggattaaatgtattatcagggtttcctcctatcaaaccaaatcctctgctaagcgctacatatccttctattcccggagatattaaatctttatctgcaaatttgcagtcaaaaatgtcgggcagttcagcaatgttttggtatccgagtgctctgattatgaacattgttccattctctcttgtgcatattgtttctgcgtcagcaatatctttatagtctacaatattgttattctttgcaaaacgataaattgtttcataatttaaaggtcttgggaatctttgacctttaaggattgaagcaaaagtaatcatttcaccttgagtgattgcttcatcgggtctgaaagaggtttcaccttcaggaagaataattgcattatatgcaagcaaagctgtgatttgtttttcagcatagtggccgcttatatcatcagcagtattggagttttgtgtttctttgtactcgtctccattataatttacacgtttgcctgttttagctgaaatataataattgcctgaacctttaagtttataaactaaatcagctgtgcaagttttgcctgctgacagattcgaaacataacagagttcaatgccaacagtattcattaaagcttctgcggcctcttcagcagaaatcatattctcagttgattcaaactcagttttgtcactccattgtttattaaaagaaattatttcgtttgtcagcttatcgacttttacactaatatattcaggtgagtaattaaatccgttaacctttctttcaaatgtaaaataatagttgttataataatccaatgattcgtcaatcttatctgaagcttcaaggtcgctgtcggtattaatatactctttgttagaatacttatctgcgaagcttttggcaatatcaagagcctgagcctcagtatattttggaactttatcaccataattgctggaatcagaataataatttaaaaattcaccggtagcggcattaaaagatatgcgcttcctgctttgtttgttattctcgtcatatttaatatatgttaagtcggcataataatcaaattcagactctttataagatttgtatactcttctataactgcatgacgcataattatcactttcaagattaagctctgtcattccctctgcaataccgcgaagctgttcggttgacattagattattcatctgtttaatcccctcaagctccttctctgtcaagccgctgtcactggcgctttcagcagccatatttgaaccgcctccgctacctccggacattactttgctatttgagtcagtgtattctttatattccccgccgttttttgcgtcaatttctaaatattgatttttgggctcataaacaaggattgctttattttcaccgctgctgatatatttagccgtcattggagacagattgttaaaatgtccgatagcgtctgattctgaaattaaattatcaggcattggaacttcgtcacaatatgttaaagaaatacgcatactggatatttcaccggttgatgtgttggtatataacgaagctgtatctccgcagaatggtaaaccgtttatgtaacgatgaaatattacagtcgtttcaggataacttatacttatacctgaggttttgccgctttcgaaactgaactgagatatcaaatcggggtttagcttttgtaaaaagtcgtatccaatttgtatcagctgttcttcagtataatttggcagtttggcgtctccgttataatagtagttatttctttcgcttgtagaatattttgttatatttccatattggtcgatagtgatgttaatatatttggtttcatcgttttcatctttcagtgtcgaccattttaaatcatagctcgtgacgcctctgtcagacatcaaggtatcactttcaaactctgaatactcctgtggtatctcaacccttgattttacggttagaatagcagattccagcccgtcaatattttcagcgtaagccggaatcacagcaatagataaagccataaaaattgataaagcaaaacataatagttttttcataaataacccacctttataatataattttttaattgttctctagttttatcaagatatatatttgactgttttattatactatttgttcccgtttttgtaaaatataggacattatattttttaaatattttaaaaagctattgacaaatatagtaaggggtgttattataacattataaacatatgaacaattgttcatatgttgaataagatgtatatagaagaggtgaccaatatgaaaaaagcaaatttgccggaagataaaaaattatatgagtgtgattgcggctgttcagtgcaggaaggcggcggtcatatacatgaacatcatatgtatgacgataatacaagtaatatccataatgaagattattctttagataaagatttaaaaggcgataaggctgagaacaattataaaaatttaataactaaaaaatatactatagataatttggattgcgctaattgtgccgctaaaattgagaggatgtccggtaacattccgggagtcgtcggggtcaatatatcgtttcctttaaaacagattacggttacggcggaaaatccggataaactgcttcctgaaattatacgggcggctcagaaaattgagagcggagtagttataaaagaagacggcggaaatacaaaaagcagaggacatataaaagaaaaccgcaaagatattatttctattgttaccggtgcagtgctgtttttaggaacgttaatattcaaagccatactaggagttgaggattacaatattgtaacggtttcgattcttatcatatcatatttaatacttggcggcggggtacttttaacagccgtgaaaaatattacaaagggtaaagtgtttgatgagaattttttgatgtctgttgccacgcttggagcttttgtgattggcgagtatcctgaagcggtaggagtaatgctgtttttccgtgtcggagagctgtttgaaaagattgctgtaagcagaagcagaagtcaaattatggacgcggttgatttaagacccgagactgttaatcttgttgcagataaagaagtgaagattatacctgcagagggtgcagttcccggcgatttggtgctggtacggcccggtgacagggttccgcttgacggaatagtggttgagggtgagagccggcttgatacatcggctgtaaccggcgaacctgttccggtgaaagttaaacccggtgatgaaatagtgtcaggatgcgttaatacatccgggctgttaaaagtgaaagtaagtaaagttcttggagattcaatggtttccaggatattaaaatctgttgaggaagcggctgcaagcaagcctagaattgaaaactttataacgcgttttgccagaatttatactccgattgttgttgctatagcggctttcacggcgatttgtatgcctttaatactgaatcaggatttttatccttggatatataccgcgcttagcttcttggttatgagctgtccgtgcgccctggtgctgagcgtgcctcttgcttatttttgcggaataggcgccggttcaaaatttggaattttgtttaagggcggagtggttatggaatctctgtccaaaataaaagctgttgttatggataagacaggaacagtgacagaggggaattttgaagtacaaaatattcatacggttggcagccttaatgaagatgaagtgttgaaattatctgcttcctgcgagttgaattcaactcatcctataggcgaaagtatcgttgcagaagccaaacgcagaggacttgatatagtaagaccaaataatgtacatgaactttcaggaatgggaattaaggctgatatcgaagataagtcattaattttgggaaatagaaaacttatggaagcaaacagtattgatatttctaaatataatccctcgggaggaggttcagaagtattattagcgatagacggagttttgcagggatatattttgattgcggatgcaataaagagcgaagcggctccggctataaaaaagataaaatctcagggcgctgtgactgctatattgacgggcgattcagaagaaactgctaaacaggttgccgaatatacaggcgttgataattacagtgcaaaacttttgcctgaaaataaggtcagtgaactaaaaaagataagacatgagtatggaagtgttatgtttgtcggagatggaataaatgacgcaccggttttagccggcgcagatgttggagcggcaatgggaagcggcgcagacgcggccatagaagctgctgacgttgtgtttatgaattcaaatatggatgctgtccctaaatcaatagcaatttcaaagaaagccactgcaattgcaaaacaaaatgtagtgtttgcactagcaattaaaattatagtaatgtttcttggactaacaggtatttattccaatatgtggctggctgtttttgctgatacgggagttgcattcctatgtataataaattcacttagagcattatactcagtaaaataaaaaattgaattatatgatacagtagttaaccgaaaattatttccaaaaaactagttgatttatgtagaaatttatggtaaaataacaacatattttatattaatatttttataatcaaaacttataagggcggaggtaaaaattgtgttaactattgttattcaggtagtcgtttttgcagtatatcttttgtttatgcttctgattggatttggattttataatacaaataatactcttaacgactactttttgggcggaagaggtttaaacaaatgggttgcggcaatgtcagctcaggcatctgatatgagcggctggctgctcttgggattgcccggcacggcatttttggtgtttgggggaacaacagaagcactttggacagctattggattgcttataggtacatatttaaactggctgtttgttgctaaacgccttagaaagcagactgaggtttccaataactctattacaatcccggtgtattttgaaaacaggtttgaagataaaactcatatactcagagttgcttcttcgctttttattatgtttttctttttgatttataccgcttctcagttcactgcaggggctaagctgcttgaagcaacgctgggcgtgccttatgttgtcggtttgattatcggcggcgtaattattaccggatatacgttcacaggcggatttaaagctgtcgcatggacagatttgattcagggaataattatgttttttgcgattatagctattccgattattatcgtttgtcagatgggcggatttgaagggacagcaatagaatttaaaggactggaagccgcaaagaatgaagtgttttcatggcttccgaaaagcgccggcggaacgattaatatactgcttttggtctcaagcttaggctgggggctcggatattttggtcagccgcatattttatccagatttatggctatcagaagccctaaagaagtaagacccgccagaataattgcaatggtatgggtaattttaactttaggtgctgcagttcttattggtgtattaggaaaagtatatgttgaaaatggtatggttgcccaaaactatgttgaaatggtaaacggcgacagtgaaaaaatatttatggttttaatacagaccatattcgggggctctaaaaacatctttatgataatcctcagcggagtattccttacagctattttagccgctataatgagtacggctgactctcagcttttggttactgcatcaacattcggagaggacctttacagactgttttcaaagaagaaacccagcagtgattcattggttagaataagcagatatgccgttgtggttattgcacttattgcaatatttatttctctaaacagaaacagttcagtattcgagttggtatctatggcttggggaggatttggagccgcgttcggaccatgtatcttattctcactctattatagaaagaccacagctcctgctgctatagccggtgtgcttacaggaggtattgttgatattatatggtacttcttaaagggtggtatatttaatgtttatgagttagttccggcgtttataatttcatgtttggtgatatttgttgtgagccagtttactaagtgtccagagagtgtttcaaaacagtatgatgaagctcagacaatagaaattaattaaactgataagccgcagtttgctttttatacagcgctgcggctttataaaaatgatggagttagataattatgaactttgatgaattatataagatagccgctgaaactgtgaatgaaagaaaattgtccgattatacatcggctggttctgttgcggcagctatcttaacggataaaggaaatgtttataaaggcgtttgtattgacgctccgtgctctatggggttttgtgcggaacatgcagcaatagcggctatgattactgccggcgaaagcagaattataaaaatggttgctgtgagcgcatgggatgatataattccgccttgcggccgatgccgtgaatttatatatcaaataaataacgaaaatataaactgtgaagtaatgttgaaagataaaattgttactcttgattatttgcttccaaacagatggtcataagagcggtttttaatggggtaggttggtgtgtttaaatcgttttacagcaatattaaaaataaaaaaaataatattatgaaagatcggctgacagttgttgcggccgtattttgtgttatatttataggtttatgtatattatttttgaactattgtaaaattcagaatgagttagaaagccaaaaatatattaaagaaattgcggaaaacagcaagacaaccgttaataagcagatagaggatgactttcaaaccttagacggcgtcgctaaaatgattggcggacttgaagagattaattatgatactattttgcctgtacttaaaactataaatgatgataatgcttttatacgtatgggatttgttgataaaaatggtataactatgggagtggatattgatggaacccaatataaagatatagatatttcagacaaaggatttgtagagaaagtctatgcaggagaaagagttataactaatactcagaaggctgaaataggcgatttatacgtgaatttctatgctgttcccataattcgcggaggcagggtgataagcgccctttgcgctgttcgtgctgccgaatcgcttcataatatattgaataactcagtttatgcgggaaatggatttgcgcatatagtagatagtcaggggaattatgttataaggtcaaaacgtccaactgtggatcaaaattcacctgatatcataactccttataattatgatgatagttcaaaagaaaagttaaaatcagatttaagaaatggacaagccggaaatattgaatattattacaatggagaaaagcgctgggcagcatacacgcctataggtgttaatgattggtttgtgttttgtgttgttccgtcagcagacatcagcagatactactctaatatgattattggaatagtagggataattttaggatctgctttactgtttttatttctgctgatacgcattagaagaatgggagagcgcagcagaagggaattggaaaagctggcgtttgttgattcgctgacaggttatagaaatgaacaaaagtttatgatagacgccgaagaggctattaggaaaaatagtgaagaaaattatgctattttatatgcggatataaaaaattttaaatatgtgaatggaattttcggttatgatgtcggcgataagctgttaaaatattgggcagacgggattaataaaacaattagagacggagaagtatttgcaagattcaatgttgacaatttggtttccataagaaagtataaagttaaagatgagttaaaaggtttttttgagacagctaaaaaacgtttgtgtacatatccggatattcaaaaatataaatttaaaattgagatgtatatggggatatatttgataaatcaaaatgacaatatatcactaagggacatgcttaacagagcaaatgttgcggtaaaagcgataaaaaattccggtgaaagccgaatggtatattataatgataagatgagggaagaacatttaagagaaattgaaatggaatcccgtatggaaaccgctcttgataacggcgagtttaaaatgtatctacagcccaaaatagattgcaggacatataaagtcgcgggtgctgaggctcttgtaaggtggaaagaccccaataaaggtataatccctccatcggaattcatatctttgtttgaaagaaacggttttattgttagtatagaccgttttatgctggaggaagcatgtcggttttacaaaagatgtttggaaagcggcgatgtgcccgggccaatttcggtaaatgtatcaagaaaagggctgtggcagcccgactttgttgaattttataccgggacgaaagaaagatataatattcctgacggaggtattgaattagagtttacagaaagttttgtgtttgaagattataagctttttattagttctgtatctcagcttcataaagccggattttcgtgttcgctggatgatttcggcgccggacagtcttcgctgaatgttctgaaaaatataccgatagatactttaaagttagatatgttgttttttcgggaaagtaacaatagtctgcgggataaaaagttgtggaaaagtattatagaaatggcaaaggctcttgatatgaaaactgtgtctgagggcgttgaaaatactgaacaggttgaatatttaaaagaaatcggctgtgatttgattcagggatttgtattttcaaaaccattgccggcagaagagtttataagttttataaaaaattggagaaatgacggtgataagcaatgattgagacggagagactaatactgcgtccatggaaagatgaagacgctgaatctttatataaatatgcgagcgatccgaaagttggtcctattgcaggttggccggtgcataccagtattgaggacagtgcgggggttataaagggagttttatcagcccctgaaacttatgcggttgttttaaaagagacaaatgagccggttggatctattggattaatgataggtgaaaaaagcaattttgatattgaggatgatgagggcgagattggatattggataggggttccgtattggggtatgggtcttattccggaagcagtcagggaattgctgcgccgtggatttgaagatttgaatcttaaaacaatatggtgcggatattttgatggaaatgacaaatcgcgcagagttcaggaaaaatgtggttttacttatcatcataccgaaaatgataaggtatgggttttgatgaatgataccagaactgagcatatttcaaggataaccaaagaagaatgggaaaatactaaaaaataggttttaaaattaaacatgaaaaggcaggttatgaaaatgccactaaagacggaaagactagtattgcgtccatggaaagatgaagacgctgaaaacctttatgagtatgcaaaagaccctagagttggtcctgaggccggctggtatgcacataccagtgttgaatatagtctgaatgctattcgaggtgttttatcaaatgatgaaacatatgcaattatcttaaaagatgaggataaaccggttggcggtatagatttgatgataggggataagagttatttggatattggttctgatgagggagaactcggattttggatagcggttccttattggggcagaggattagtaggcgaggctgttgacgctttgcttcgtcacgcttttgaggacttaaaccttaaaactatatggtgcgggtattttgaaggcaataacaagtctaaaaaggttcaggaaaagtgtggatttaaatttcatcatgttgaaaaagataaattttggcctattacaaaagaaataaaaacagaatatgtaaacagaatgacaaaggaagaatggaaaaatagatttaaataacttaagatttaataaagaatttggagccgtcagatattttttaagatattgatttaacgttattgtgttaatcaaagtaacttaaaatatccgacggctccagtctgttaccatctgctgttctattatttatagtctataacttctttagccatgtttacaaagtcttcctggctcataccggtttcaaatcccataatgttgtaagttattccttcctgaacccatgagacgctttgaagttcttgagtttcaatatcatcagaaccataactgaaaactaaactgccgttttcttcgtctatcttatcctgctcagtaagtttataatcaggaggtacgattttatttatatagtttgtatagtaaatatctatattctgatatttgtcggcaagaatagtatgggtgccttcaccaacctcaaagttatccgacttatcaatacttagcgtaattcgtttgtcaccatttttatatttagcgctgaagcttttaaactcttcggtaatatcaccgttttcatccttactcttgttgtcaactatatttccgcctgtaaattcaaatccattgttaaagttttcaataatattagcgctgtatcccagctttttatccagttcttgttcagttggaatagagtaataatcaggtatagatgatgaacttgaatatatcatcgggaccagcttgcctgctgcaaatgcagtggttcctattaacaaaacagcggcagcgcagattgccaatcctcttttaaatgtttttcttctattcataatataaatctcctttttttcaggcagctcatctaatgtaagctgaatttttgaatggaatttgcttgtagattttggaaaggaatttttaattttattattatctatattcattatttttctccttttcatggttaatcaaaacacgacaaatttgattttagagcttttcggccttttgccaatcggctttttacagtgccggcaggaatttttaaaatatccttaatctcatttactgaatatccttctatgtaaaataaaacaactgcaacacgtattttaggtttaagttccattatagcctgatataattctctcacctcagaattgtcgagcgtttgaatatcagctgttatttgttcttcatacgggacaaatttggagtttcgcttttttagcttatagcattcgttgatgagtatgcggaccagccatgttttaaaatactcttcgttctttagagaggatagctttgtatacgcgtttagaattgcgttttgaaccgcatcctcgcagtcggtgtctattataagaatagactttgctatgttatataaggtttgttcagcgtctaaaaccttttgcgtaaatgtgtaattatccatgttatactttctgcctttccaaagcagttcaacagcgctgttgtttttgctttacactaattagatacatttgaaattaaaaaggttcatttttgttaaaaaattttttgattagcatataaagataagaatgtacgcctgtgaattattatattattataaaataaaagcccgtcactttacgtatgacgggcttaagacaacaaaagtcaattataaaattagtctccggtttccgaatcgattgacggcgcggtttggtctttaatagtgttcttttctatatcggctttagtaggtgttttcctttcatctatcggcgtatattcaagacgtttaaccgcacttttgtaggcggggcgaataattttgttgctggtggttacttcttcaattctatgagcgcaccagcctactattcttgccattgcaaatataggtgtaaacagttcttgaggtataccaagcatttgataaacgaaaccggaataaaaatctatatttgcacacataggtttatcaattccctttatttctctaaaagcgatcggtgcaagttcttcaattgcagaataaagagcaaattcatcagagtgaccggtttgttctgctaaatatccggctctttcttttagtattatggctcttgggtctgaaatagtgtaaaccgcatgaccaataccgtatataagtccgtttccgtccccggcttctttgcgcagaatcttttttaagtattcatatatttcatctttatcttcccaattcctaacattggctttaatttcattcatttgggacatcattttgtcatttgctccgccgtgctttggtcctttcagtgaaccgacagcagcggaaatagccgagtatgtatccgttccggttgatgaaagcacatgcacagtgaaagctgagttatttccgcctccgtgctcggcttgcagcattaatgccaaatctagaatctcagcctcaagctcagtgaacttattatctgccctaatgagatgaaggaagttttgagctgttgaatattcaggcacagggttgtgcagaatcagactttgattatcaaaatagtggcgttttgacgcgtatgaattagcaataagcacagggaaacgagcgataagtgaaaaactttgcctgagcagattaggtatagagatttcgtccggattatcatcataagaatagagagccagcacgcttcttgccaatttattcatgatgtttttactcggagccttcagaatcatatcttctgtgaattcaggcggaagaactctgtaacttgatagagaccttttaaactggtcaagcaaagactggcttggcaggaagccaaacataagcagaaaagccacttcttcaaaaccaaatcttttttcagctctgcagtttgcaactatatcttcaacgtcaatacctctgtatctgagtttaccttctattggtgacttagtgccttcgtcaataacataaccatgaacttcgccgattgatgtaagcccggcaagaactccggttccgtccgcatttctaagaccgcgcttaacattgtatttggtataataatgtgaaggaatcatgttccatctggaattttggcttcttataagctcaatatatttatcaatattttcatagtcaaaaccattaatattgttatccataaatctaccgcctttccgttagtgtatttaaaacattatacactaaaacagaaaaaccgtcaataataatatgtgcataaattattcatcatcattttttctgtctttatttatttttagaattgaaccgccggttttctttatattagtaagtgattttccatttgagttattttttgatagttcggtaaatttaggaactatacattctataaacttccctttggctctgccgattagatataaatagcctattattgagaatattacagcgcctaaaaagtttatcatcatatccttcatcgtatcaataaggccaatatcaaggtatccgttaattccataatccgacatggcaatcattccgttttttgcaagcgctccatctatcaatagatgattgccttttaaaattacatcgtcaattcctgaaaccaagattgatttgttgatagaaatatcattcattgttatagaagaaatactgttcactatagcgtccttctgcatatctgttctaaggatttgatcggcaaagaattcaaaaaattcccagagtactccgatagtcatagaaaagcaaaaggcgaccataacaacaaatgcaggagataggtggaactgaacgcggtgactttgattaagtatatctatcaatgagaagcctacgcctgccattaagaatccgttagacatgtgaagcattgagtcccaccagggaaacctttgataaaaaccgtttacttcccctaaaaaatccgctgcaaaaataaaaaggactataattacctcaagggttctgggcaagtcgattttaaatctgtaatcgataaatctaggtatcaaaaataatattagagtgagcacgcaagtgaaaacattttcgtatctttgatattttatttgaaaaattatagaacttataacaataagtatcagaataatatacagaccaagcataaatctatttttcttatattcctgatttccaaatagattgaatttcatgattttaacttccctccgtgtttaagaacaatagtattaatagagcacgtgttatcacgtgctctatcaatatggttattatatatttattcaattttgtcagactatatgaaatttataaagaacatcccataataatgaagtttataccttcaaacagcagtgaaagagcaataaatatacctatagctacaaatgttataagcggatgacaaactaagaatatcccaagaataagcgttagaatccccagtgctaaaacaaaaccccaggagcttccaatatcttttaaggcgaaagcctcaaatattctggctatacctgcaataataacccatgctccgaaaattgacgccataacaacattagcgaaatcaggcttaaacatgagtattaaagccaatatgactgttaatataccaaaagccaatgaccatccgcttttctttataaaactgtcttcaccctggcttacgaaatatgaaacaatcatccatatccccgcaagcaaaattgatgcagcaattatatatgtaaagacatttgctgtaaaaaccggagttataaaacataaaatacctaagattaaataaattatgcccataacaatagacaatactttcatttctaatacctcccttaaattatataatattttgaaaatctattattggtaatattttaacatatcaggaagaaacagtcaataaattttgaatataatagtataaaagtaaggtttttatataaatgttttttaattgtaaaaatatatgttttcagagatttcatcaggagtttttcctgatacaagcatgagggttacaagttcaagacagggatatatattttccgcctttttgtcccatccaattttgaattcttgaggaaggattatttcgtcactgccgcatgttgaaaaccccctttgtatacaatataaaaaaccggaatcatcaatgctggaggctgtaacactggactttaatgaaagtccgcaggttatgatatccaaatcatcgataataacgtttttaatttcatttggagattcagcgtttataatgagactgttatttattcttatcataataatccctcccggaatgattgtcatttaagactattattagcttctgtcaagaataaattcaaaaactgcataatattttaatataaattattataaagataaggtgaaaatatgtgtgaccagaattttgtaaatataactcgaaaaagcggaaagtatgaaatgattcccaaggaaataatgaaacttatgaaaggaaaatcaatgccggaaaactcgatagtcagttatgatgacctgagttatttaagcgttccatattatgatttcagttttaaaatttgtttaggtcatttgattatttcaaaagaacttaaaaacgaggtgttggagatatttttaaaattatatgatttaaaatatccgattgaaagaattgagttaattgactatttttataatggaaaagcggaggatttggatttagaatcaatgaggcataataacacatcagcattctgctgcagaaaggtgagcggcacggaacggatttctaatcattcgttaggacgggcgatagatataaatccaaaaataaatccttatatctctgagacgggaacggtactgcctgagaacggtctaaagttttcagacagaggtttaacttatcctgatatttcagaggttgaggaaaaagctatgatacataaaggagataaagtttatgatatatttaaatcatatggctgggactggggaggtgaaatttggcagggaagatattacgactatcatcattttcaaaaaataaaatataaatcttaaaaaaattttaaattagtccttgacaaaataatttggttattatatacttaataaagttttgtgaacttctatatagtttgcagtaagacaattatttgagagattttttaataaaaatctttattcaaattgtaaattctgtattttgacagcaatggcgctgttgagatataatatatagatttttgatacgataatttgaaattttattatgttctatgacgcacaatggggtgtggctttattagctgcactctttttttgtgcagttagaggaagtttatagttttttgttaaatctaggcgtatgagtataaaatccttatgcaaaatttctgttgatatgaagcagcggattatgatataatgtaacgaaatgtctatattggaaattaaatagactgagatgtgcagatatttatggaggtgtagtaatgtataaaattgttagaaaagaagtgcttaatccatctgtttcactcattgaagtagaggcaccgtacatagccagaaaggcagagccgggtcagttcataattttaagagtggatgagaaaggcgagcgtattcctttcacaatagctgattatgaccgtgacaaggggacggttactgttattttccaaatagtaggaaagagcacggaaagtttgaacgaactcggtgaaggtgacagtcttcaggatatggtagggcctttaggagtcgcttcaaattttgagggtgtaaaaaaagttgctgttatcggcggcggtttaggtaccgccattgcgtatccgcaggcaaaaaagcttcattctatgggcgtttctgtagatatgattaatggattcagaaataaggatttaataataatagaagatctgtgcaaagctgcctgtacaaatttatatacaatgacagacgacggatcaaacgggaatcaaggatttgttacagcaaaacttgaggaacttataaattccggtgaaaaatatgatttagtagttgcaataggtccgctcgttatgatgaaagcggtttgtgacctaactcgcaaatatgatataaagacaatagtgagcatgaacccgattatgatagacggaaccggtatgtgcggaggctgcagaataactgtgggcggagaaactaaatttgcatgtgtagacggacctgactttgatggtcatttggttgacttcgacagcgctattgcacgctcgagaatgtttaaaaatcaggaggcagagtcgagagaacgcgcgcataaatgtagattggagggaatgaacaatgcctaatatgtcacttgaaaaggtgccaatgcccgagcaggaaccaaatgtgagaaataagaattttaaagaagttactttgggatatactgaggaaatggctgtagaagaagctcagagatgtcttaactgtaagcataaaccttgtatgcaggggtgtcctgtaatggttaaaattcctgaatttattgcgcttgttgcagaaggcaagtttgaggaagcatataaaaaaatccaggaaaccagttctcttccggcggtttgcggcagggtttgtccgcaggaaaatcagtgcgaaaagttctgcgtcagaggtattaagggcgagccggtagctataggccgtttagaaagatttgttgcagattggtatatggaaaattgtaaatcagtttctgaaaagcctgagagcaatggaaaaaaggtagctgttgtaggggcaggaccgtcaggcttgacatgtgccggagaccttgcaaagcttggctataaggttactgtatttgaagcttttcacacaccgggcggagtattggtgtatggtattcctgaatttagacttcctaaagatattgttgctgctgaagttaataaattaaaggagttaggcgttgaagttatgactaatatggtcataggcaaggtgctttccgttgaggagcttcttaatgaagaaggttacgacgcagtatttataggaaccggggcagggcttccgagctttatgaaaatagagggtgaatctttaaatggagtatattctgcaaacgagtttttaacaagaataaatttgatgaaggcttataaattccctgagtatgacacgcctgtttatgttggtaagaatgttgttgttgtgggcggcggaaacgttgccatggacgcggcgcgttctgcaaaaagacttggggcagagaatgtttacatagtttacagaagaagcgaagaagagatgcctgcgcgtcttgaagaagttcatcatgcgaaagaagagggaatagagtttaaacttcttaacaatccggttaagataaacggcgacgagaacggctgggttgatagtgtaacttgtataaagatggagcttggagagcctgacaagtccggaaggcgcagacctgtaccggttgaaggcagtgaatttgatttggatgctgatgttgtagtagtagcaatcggtcaaactcctaatccgcttataaagaatactactcctgaccttgagactaaccgatatggatgtattgttgctaaggaagagaccggagagacaagtaaaaccggagtatatgccggcggtgatgttgttacaggagcggctactgtaattttagctatgggagccggaaaaactgctgctgcgtcaattgacgagtatttatcacagcgtaaaaaataattaattatatatattataatgaaaaggagaattatgaacatggcaatttcaaacggttatttaaagaatgtttttgagcaggttcaaaagagaaacgcaaacgaacctgagtttcttcaggcagttgaggaagttttagaatctttggagcctgttgtagaagcgcatcctgagtatgaagctgctggacttattgaaagacttgttgagcctgaaagagtaatttatttcagagtgccttgggtagacgacaatggaaaaactcaggtaaacagaggtttcagagttcagtttaacagcgctataggtccttataagggcggactgagatttcacccgtccgtatatcagggtatcatcaagttcttaggatttgagcaggtatttaaaaactctcttacaggtcttcctatcggcggcggtaagggcggaagcgactttgatcctaagggtaaatctgatggtgaagtaatgagattttgccagagctttatgacagagctttctaagcatatcggagctgacactgatgttcctgctggagatatcggagtaggtgcgcgtgaaatcggatttatgtatggacagtataagagacttagaaatgaattcaccggagtgttgacaggtaagggtcttacttacggcggttcattggctcgtactgaagcaacaggctttggactttgctactttacagaggcaatgttaaaagctaacggtaagtcgtttgacggcaagactgttgttatctcaggttcaggaaatgttgctatttatgctacaaagaaagctactgaactcggcggtaaggtagttgctctgtctgattccaacggatatatatatgataagaacggtattgaccttgattgtgttaaacaaatcaaagaggttgagagaaagagaattaaggagtatttaaatactcatcctgaggctgaatatcatgaaggctgcaagggaatttggactgttccatgtgatattgcacttccatgcgctacacagaatgagcttgatgaagaatcagcaagggctcttgttgctaataactgtttcgcagttgctgaaggcgcaaatatgccgtcaacacctgaagctatagctgtattccaaagcaatggaatactctttggccctgctaaggctgctaatgccggcggtgttgctacatctgctttggaaatgagccagaacagcatgagatattcatggacatttgatgaggttgacgctaaacttaaaggtatcatggaaggtatttttgaaaagtgcgacagcgcttcaaaggaatatggcaaagaaggaaactatgtgatgggcgctaatattgccggattccaaaaagttgctgaagcaatgatggctcatggtatagtttaatataaatataagtttataaatttgatttaaaaaatataatatataatgaaagcggctaaaaagcggcgacctctatagttagacatgaaatctaacagtaggtggtcgtacacaaaaaatcagccgcttttattatatttaatcaaaaatttgtatcagtctcaaaaactagtcaataacattccatttatttttcataatattttaatcttataattttttattaagagaatatacttttaaatcagagtattcacctataagaggagccatttgcctaaaaccgattttacctccgtctaaaacttttccatattcattcccatcatcctgccaggaaaatatattaagctcatctatgaagaactcaattctgcctttatattttataatttttaattcataaaattcttttgcgtcttcgcagttcggaagcgggtctgctccttgacacacaagatgaaatccgttgctcttacgtaaattacatgtgtggaaacagcgctctctgtcccatttgcgcctaaaatatgatatatgatatgtatttatatctccatgtgtatattgcccatattgtccgtctcggggagaaagcgaatagtcgaataaatcttctccgttaattcctttcgcagataaaaacattatgcagagccccggctctttaataggacgaaacttccacgatatttctatatctgacggaaactcttccgggcaccaatatacaaaatttgatttttgtccttcattttcagaaagtctattcttcatacgcattttttgatttacaaaataaacatctgccttgccttccattataaaatctttgacatcttcaggacatgacagaggatttttatatattatctgcttttccataataaactccttttacagtatatttttaatgttttaatttatatatttcttaccttgtgagtaattttctgctttttacagagaatagtgatacggttgttaatactgcgataaaatcacttatcggctccgccagaaacagaccccaaactcccagggcgcctatttttggtaatattagtgctaacggaagcaacaatattagctttctttctatagccaaaaacactgattcttttgcctgccctagagcaaggaaagtctgctgacaagcggtctgcatacccattaatgacattgataacataaagacccgaattgcgtttttacctatttcaattatttgtgcgtccgatgtaaacataccgataaaaaattgtgggaataattccaaaattacaattatcgacattgaaaatacgagacataaaataaacaattttttgaatgctgaaaaaacgcgctcattatttccagcgccgtaattaaaactaattatcggctgaactccttgggcaaatccctgcataggcatccataccaactgcataacactaaacaatattgacattaatgcgacatatgaatcattgccatacttaagcattccgttattaaagactaattgaataaagcagtctgtggactgcataacaaaaggtgaaatccctaatgaaataaccaaaaatacaatttgttttgaaagacgaagatttttaatgcgtatttttatatgcgtcttattccctgtcagaaattttaaaacccatatacaagaaattccctgagatattattgttgcaagcgcagcaccttgcacacccaaatgaaaaacaaaaataaaaatcgggtcaagaattatatttaaaactgcgccgatacaaattgttatcatactggttttagtaaatccctggttagtgataaacgcgttaagccctagagtcagctgtaaaaacattgtcccgatgagataaatagtgatatacgaagacgcatatggcagtgtgttttcactggcgccgaacatgattagaattttatctttagtaatcataaaaaagacggataagattatagaactaataataagcatcatagtacagtttccaagaattttttccgcacgctcattatcattgcatcccattgctatggcggctcttggtgcgcctcctgtgccaagcagcgctgaaaacgctcctataaatattattatcggaaatgttacacccaatcctgcaagagcaagtgagcctatttcatttatgtgtccgacaaaaatacggtctacaatattatataataagtttaccaactgcgccaaaactgtaggaatcgcgagttttagcatcagttttcctatcggtttgcttgcaagaatattttcactttccattataatatttttctcctccttatattttatacttaaatataattatactgctaggctggaaaatttactagtcaaaaaatataaaaattaactcaaaaagtataaagcaaatagcgtatgttttgatataaattttttatgattcatggcaagcagtattaactaaatatattttatttgaggaattaaaaacaggttataaatttattagaaaataataattaatatgcagggacagtcattatatgaagaatttaatttcgtgtatatttaaagcgataacctacaaagataagaattaaaatataagaaaataacatgtattaagctaacaaatatattagaagctcgataatataacaacacctgttataggcgacgaagagctataggtttaaatttgataaccggtaaaataagaagacaattaaagtttaaaaaattaattatttagttataaagaggaaatatagtttttagaaacatcatgtatccaataatgtattgcaacattattggatacatgaaataattgattttttaatatcgttatacatatatagtgttcccaatattatcagtggtgtatttgatttattggaaaatgaaacagctgaacttacagctttggatatatcggtttgatattccgaattgacgttgttctttttaaacaaatctgataattctgcgccgtttaaagctctttgattatttggggtaacggtatagacttgatttatatatggacttataatatttaccatttttttatagtccttatccgccataacccccatgattaaattcactttcatgccggagaaatattcttttatactattaacagttgcagtcattccctgaggattgtgagagccgtcataaattattggcggattgtccgagaatatttcaaatctaccggtccattcagtgaccgctaatccgttatatatagaatttttggaaatattaaagcctgacttgtttaaaattttgattgaatcaatagcgaccgcagcattgccgggttgatacagtccggctaattttatttttaagtttgtgtattcattataattgaaaacagacccttttaaacctgatgagataatttcagcgttttctcttttagtcaataaaagagatgaggaaagtttattagctgcggtttggataacattaagcgcttccgggttatttccgccgaatactgtgggacagcttggttttattattccggctttttcagaagaaatttctgaaatcgtatttcccaggtaatccatatggtcgagggcgacgtcagttattacagaaagaacaggcgtatctgagatattggttgcgtcaagtcttccgcccataccaacctctaaaattacaacgtcacattttttttgataaaaataccaaacagccatagccgtttcaaactcaaagctagtgggcttatcatccatattttcctcaacagtttttatatgagaaacagtttcagaaaaatcggattcagatatattctttttattaattctaaaacactcggtttcggaatcaatacacggagaggtaaacagtcctgttttatatcctgcttctgtcagaacgctttctaacattctgcatacagaacctttgccgtttgttccggctacatgtataatttttaatgatttttggggttcgcccaaaagttttagaatttcaagaatgcgagacagcccggggcggctgcctctgtttgatatactttttaagtaatccagcgattcattataattcatctcatttgcactctttccagctgatttgcgaaggttttgtttttcataagaagataaattatatatccttcaacggtgccaattactatatagagaggaattctcattaatattaacggcattggatagctgaaatagatatataagcctatagactttataatcatagaacctattatatgagcaagacccacagcggcaataagctttaatttagggttgtctttaaacatataaaaataaattgaacctgaaatcaagcctatagaagccgcgccgagcgtaactaatggatttatagcatacccgacgataatacagccgataacatcggcgcatattccgaccgtcataccaaccagcggaccaaacattattcctgccattaaaatggtcaggttttcaaagctgattcgtatcggacccatagtgaatgataattgtttgcccagcacaatgcttaaagcaatgaacaatccggaaataagcaagacttttaaatttccgaataggcggattccgcccagagatttgtaactttcgtttttagaaatttgcataaaaataacagcctcctttcacctcactcatatagcaaggaaagaagactgtgaaaaacagattcaaaactttgctgtatgaagcgggatgcagaacacgaaccgcaagtcaaagacttttcgtttgcctggcaactccccgtccaagcaacacttaacgcacgcattcttactcttcaaataatttcgtacccattatagcatattttagaattttgtcaacagtaattttataattaattttaaattttaaaaatcaataagatttatctgtaataaaggattcaaaaaaatctgtttcaggcaaaggagtgctgtaatgataaccctgaaccgtatcaggaagatatttttcaattatatttaaagactcttcgttttcaacgccttcaacacagattttgattttgagtgagtgacataggtctgacaagtgttttaaaatatcccggtctattttgttctctgaaacctgcataacgaaactttggtctatttttatccagtccgcaggaagagcttttaatatatcaagagacgaatatccggttccaaaatcatccagagcaatttcggcgcccaaacggtggatagcatgtacaaagttttgaatagactttatatctttaatctgatatgtttcggtaatttcaaaggttatatcagagccattaagaccgttcttttttatctcatcagcgataaaaagcggcaaatcataatctcctatctgaggcaccgcaatatttatattaatgtgcatgtcaggcttgcattttttccattctctaagatgtttcaaagctgtggaaattatccactttccgagaggaagaataagacctgtggattctaaaacttttataatattttcaagaccatacttatatgaagccggattttcccatcttaaaagagcctcagcagagcggatcgtatctgttttagggtttattatcggctgaaaaaataagcaaaatgagtcgagattttttactgaacatattaactcgtcataaaagtcaattttttcaatagcctgtttaaaatcattttgtgaaaaaaacagcggaacgtcatacattttgttcttttttgccaaatcagaacagtaatttaatcctttataaatattgcttaattccggcggtgaaaaatctttgactataactgcagcgcaggataaattaatctcaagcttatcatatttgtgctcattttttatttgttcttgaactgtgctttttatgtttttaaataaagttaaaacatcatttttatcagcttcgggataatataacagtatatgatttccttgaccgcggtatagtttaccttttgtagggcataaaagagtaagttcgcgtgcaaaaatagaaaatatcccgtttacaaaactataagaatattttatattcatctttttaatatcggcgattgaaaaatccattattgcgcctgttagcatatctaattctatatattggcacatatcccgtttaaaagcaaaaatatctaaaagaccggtaatattgtcagaaccgtaatcagcaatgagatttttaattacacctgtcattatttccggtctgccatctcctgttcggttcacaaatccgcggctttgtatccaagtgtatagaccgttaagattttttattctaaaatcacatctaagattattactttttccgttatggatattattaatttcatcagtatacatttttatgtcgtcagggtgtattattttcagccaataattttgtgcctgcgatatttttcttacgttggatatatcagttatgtttttaatttgttctgaccaaataatttcatccgcctcaaaatcaacaacgaaaataatgtcatcagtacattgtgacagtgatttaaaaagtaattcataattattttgtgcttttaaattcattgaaatcacctgcggtctaaatataaattatgttgttatgtaaaaatttttataattatttccttttaaaaaattcaggcgttgaaacaattaatgacggtagtgcaaaggtaaaaacacaaacggtgatgttcggcggaaacgaagcagaagcagcattgcggaccagaggttttcttattgttccgtctatagccatactgaaaaaataattatcagattatatttagttttaacataattctccatactattccatttcgtataacttgattcttaatcattttaactatattacaataattaagaatttcaataaaaaataaatatataaaaaataaatatataaaaaataacaaatgaactttactcttatgaaatagaagatgatatcagaataattaaagttttttataattacttgactttgaaaatgtaaactgtcagatcaagaagtcaatttataatagaaatctcaggtgagtaatggtttgcggatagttacatttgttataaaaggcgttcaaatcaaatataagtttgtagcataccatatacttagtttaattttatattatagtttgtattttatctttaacgctcgaatatatatttacaaaatatatttgatattatattttataatttttatgattacttattaaaaacttacaaataataagaaagataaaagttaatcgccaaattacttgattttttttacaaattgtggttaaatataaagatagattattatggtggattatgcctaaaaattatattgatttttaggtaatagataaagtaatcgtatgaattaatttttaggatttatagtgattttaatatagtactattgtatttgaaggagtgttttaatgatatacgaggaaaagacggtatcaacagaagaaatatttgacggtaagattttaaaactcagggttgaacaagttgaaatgccgggcggaaatcttgctgttcgtgaaatagtggaacatccgggcggagttggaatcgttgctgtgacagatgaagatgagattatattggttaaacagtttagaaaacctgtagaaaaggcaatatatgaggtgcctgcagggaagctggataataatgaggaccatagagcatgcggaattcgtgagcttagcgaagagaccggttacagtgctgaaaattttgattatcttggatttatgtatccatccccgggatttgctgacgaggttacacatttgtatcttgctacaggtttgactaagggagaaaatcatcttgaccctgacgaatatctcgatgttgaatttattcctatagacgatgttaaaaaaatgattatggataatgaaattaacgatgcaaaaactgtgtttggagtatttaaagcgcttgaagttttagggaaataatttactctgagagatgaaagaggttgtactatggaagataacacaaagatggaagtaaaaattaataatatggaatataccatcgtcagcaatgagtccgaggagtatgtccagcgcgttgcgctgttggtgaataagaaaatatctgaggttaagtctcagaacagccatttaagcactgcaatgcttgccgttatggccgctatgaatctagctgacgagcttttaaaaagtgaagattcggcaagcaaactgcgtactgaaataggcgagtatatggtggaatccaggtcagaaaaagccgagcttgacgagaaaaaacttgaagtagaaaaccttaaagaagatatgcataagttggaaattgaacttgctaaacgtgaaacagagttagaaaatctgcgttcatctcattcgatgactaggggagccggttctgtaacccaaagcagtgtctcaagacagccgagaagcacatctgttcagcctggaatgagaagcgcaggagcggcagaaaacttagtcaaaagaactgtggaagatgagcggactaaaaaaactggatatccttatggtaacgtaataggacgcggtgatggtataaagaaagactgacgatttacttttgtaattaatattttatctggaggattttatgtctcttactggtaacagtgcttcagcagccagcagtatgaaaaaagaaaaaaatattttacctgaacttttgtctccggccggaagttttgaatctcttgcggcggcagttaacatgggagcggacgcggtatatttgtcgggtaaaaatttcggagccagaagttacgccgataactttgacaatggccagcttgaaaatgctgtaagatattcacatcttcggggagttaaggtacatatcactgtaaatactcttataggtgataaagaatttgctgaacttgaagaatatttaaagtttttaaattccttgcatgttgacgctttaataattcaggatttaggagtattaagtcttgcaaaaaacttaggtctttgtatgcagtttcacgccagcactcagcttactgttcataacttaagcggtgctttggcggctaaggaattaggttttgaccgtgtggttctatccagggaactttcttttaaagagataaaatatatatcggaaaattgcggtatagagacagagatgtttattcacggcgctatgtgtatgtcgtattccgggcagtgccttatgagcagcgctcttgggggcaggagcgggaacaggggacgatgcgcccagccgtgcagacagttatataagtcgggtgagaataaagaaaaatattttttaagtctaaaagatatggctttgattgaacgattggacgatataaaagaatccggagttacttctttaaaaattgaaggaagaatgaaaggtccgacttatgttggatgcgtaacgaagatttataaaaagtgtctggaagaaggcaggcagccatctaaatcagagataaacgatttaaacaggatattttttagaggaggtctgagttccggatattttgataataaaaaaggcagagcaatgtttgcttttaataaaccggacaatccttataaaaaagaaacgagcagtttagaaacaaaaattttagatgaaatcaaggatagggaagataaatttaaaattcatctgacagccaaagtaaatattgctgtaggtgaaaagattaaacttattgtattatataaaaataagacaattacggtgaggtcgaataatactgttgaagcggcatcttcaaatccaactgaaaaggaaagggttattcagcagatttcaaagaccggaggcagcgtcttcatatttgattcaatatcggttgaagtcaccggcagagcgtatgttcaaattaaagatttaaactacatccgccgcgaagcgctgaaaatgattgaagatgaaatattgtctgacagcattgatatacaaaatagaaatgaatctatatctttaaatcattctgctggatgcgacagcagtttgagcggtatgacagcttcaatattttcatatgaacagttcactgctgttaaggagtttgaagaatcgacagggaaaatttttagatttatatatgtgccggttcgcttattagaggaagattataaacggtttatctctgataaagacaggatagttatagagcctccttcaataatacatgattctgagtatgaaaaatatattgattttataatgaggctgtttaacttgggatttaataagatcagagtacacaatatatctgaataccgcagaatttttgatggttttaaaatttttggatcttacagaatgaatattacaaacagtaattcagtaaaattgtgttctgttataatggggtttagctcggttatgctgtcacctgaactcagtatccctcagataagggatatagcaaagggcgtagatataccgacagaagtatgcgtctatggttatcagccgttaatgctgactgagaattgtattcttaaaaatttggacagcaactcttgtaagtgtaatagtattggctgtattactgacagattgggaaaaaagtttccggttataaaagatgggaaaaattgcagaagtgtgctgctgaacagctgccctacatttatggcagacaagatggaagagctgaaatgttataatattaaaatgtataatttaaactttactgtggaatcaccgaatgaaattaaaagaatttgcaaagcctatctttgcggtgaaaattatagaccggaagagtttacaagaatgcacttttataaaggaatattttaggttcacattaaatataataatttagttttaagaggttgaatatgagatttatattagcatccgcttctccgagaagaagagagattttagaaaacatttcacttgattttgaaataattgccgatgaatctgaggaaataatgatcgaaggcgaaaaaccatacgacaccgtaaagcggctggcgatgcaaaaggcaaaaaatatagccgcaggaattgaatccggtgaaaacaccatagttatcggagcggacacagtcgtttcaattgatggaaagatattgggcaaaccaaacgatgaaatagaagctaaggacatgcttttgactctttcgggcagaataaatactgtgtataccggtcttgctgtaattgaaactcagagcgggaaagaggtaagtgattttgtttcaacaggcgtaaaattcagaaacttgagcgaaaaagagatagaaaactatataagatccggtgaaccaatggataaagccggagcatatggtattcaaaaaataggcggattgtttgttgagtctataaacggagattattttaatgttgttggtctgcctctatgcagattaggagaaatactttcagaagagtttggtataaatttgatataaatacctgattttatatagctttcaggagggatatatatggcgattgatttaggcatagattttggaacaagcagtactcaaatttataatgcgaatgaagaaaaaattatagttgacgaacctactgttgcggttaccagaggtgagagccgtgaagtaattgccgtaggaaccgaagctttagatatgcttggaaaaacggccgacagtttgtctgttttaaatcccgttaaagacggaggaataacaaactttgatgttgcggttggcctgcttaaaaagtttctggacaagaatttaaacaatgtattttcaaaaataagggcggcggtaagtgttccgtcaggtattggagacgtggaaaagagagctatagaagaggtcgtaatatcagccggtgcaaaagaggtatatcttattgaatcaccgcttgcaggcgcaataggtgcaggagtcgatataaacgagcctaaggggtatgttatagtagatgtgggcgccggaacgacagaagttgctgttgtatcattgggcggcgtagttgtttccaaatcagtacggtcagcaggtgacgctcttgataatgatattattcaattaataaagaaaaaatataacgttgaaattgcaaagtctacagccgaaaaggcaaaaataaagctgggtgctgcaatggttgggctcactactgatgttgtagagctaaaaggcaaggatatgtatagcggagtgcctaaaggcgttgcgattagtgcgaacgagataaactctgcaatgcgcgatgatataaactttatattggaagctgtgcgctgtgtcctggaagaaactcctcccgaactggcttctgatttaatagaaaccggaatagtgctgacaggcggaagcagtaatatgcgcggtttaggaaagcttataaaaaacgctactggcataaatgtttatcaagctgaagaccctgtgtgctgtgtagcaaaaggggcgggaacagctatggcaggaaaaggcggatttagaaatatgctgacgcaggcgaccagaagaaagaattattaactcaggtggtgcagaatttgaaattttttaataaacataaaatggcgctcatcctatcaggatgtacgcttttggtagtggctttacttatatttttaggtttcaacagcggtaattctactgctgttgaagatgcaataaaaacaaccacgtcccctgttcaaaagttttttggaaatattgggagtggtttatatgatgtgactcattgtttaggtgagttaaaagaactgagaaataagacggatgaactgtcaaaaaagaatactgaacttgaaaaacagaataatgaaaatgctgaaatggcagaagaaaatgacaggcttaagcgaatgctcgaactaagacagaataatcccgatttagatttggccgccgcaaatgtgacagctgatgagccttcaaactggttttccgggtttacaatagataaagggaaaaacagtggattggaagtggagcaaaccgttatatcttccgatggttttttgataggaaagatttctaaggttggtacgaattgggcggatgttgaaacaataattgaccctgggttttctgccggagcaatggtggaacgctctaaagatttgggggttgttgaaggtgacagcgagcttagatataacagacagtttaagctgtcatatttgtcgcgcgacacagatattgaaattgatgattacgtaaccacaacaggcctcggcggagtttttccggcaggattcagattaggaaaagtcgcggaaattaaggacgatacggttacgatgaccagatatgcggttgtaaatgcttgcgttgattttcgtgatatcagacaggtatttgttgtaacaaacaatatggatgttgttgctgatgaagaaaatgctaatatgaaagccgcaagggagagagcggaacaggaacaaaaagaaattgacgacagatcgtctgcaagtccaaatcctgagcctgatgaagaagatgaagattcaggaggttcaagtaaaaataataattcctcaaagtcaaaaaagtcaggtgattttgaagacttggatgaagaaaatgaagattaataagcaggtagggagatatatatgaaactgttacatcatgttgtttggttaatattaattgcaatcctccagcccgcgcttataaatgctttgtctgtgtttggggtaaacggaaatgtttttctattatttattgtcttaataggatttttttgcggaagaatgcaggggatgctctgcggaatattatttgggttggtttatgatatatatgttgggagatttataggaaccgatatgcttatttatttgtttataggctatttttctgctgttgtaagcgacagattttatggtcgtcctaacatttatgttttttctgcaatggcggcaggagccacaatagctgcagaaataatttatctaataccatattctatgttttgcgaaggttcctttgtgtggatttctgctgtgaggattatatttatagaaacagttttgaatgctgttttggttttgcctatgctgtggtttatagaaaagacacttgtttggtttaagataaaaaagtattgataaaattttggtgataatagatgaaaataaacgatattacaaggcggactataattatcggcgccattgtcgctgttttagcgattagctgtataataaagctctttaatctgcaaatagtgaatggcgaagagtataggatacaggctgataaccgcacaatacgaacatacgctacaaaagcgccgcgcggagaaatttttgacaggaatggggttccggttgttgaaaataggtgcggatacagcattcagatatttaaaactgatatttcttcagaggagttaaataaaaatataaacgatatagtaaaactgcttcacgaaaatggagatgagtatacctcaactttcccgatagaatataacgaggaagaggagatccctgaatataactttgaaaaatccgattcagcagtttcctcagctgatggtaacaaaaataaagaatcagatgaagaaaaaaaggatagagaaaagaaaatccaagaggatacggcaaaaaatattgctgagtgggaaagccaaaataaagtcgatacatttaacactttaagagaaatagtaaaatactatgcggaaaaatatgagatttctgatgatttcaatgaaactgaaaagctggatattatggctgtcagatatgaaatggagcaaagaaaattcagcggcagcaatccgtttgttttggcaacagatgtaagcaatatagtcattcagaaaatcaaagagacgtattatccaaccggttttgctgatataatagccgatactatcagaaattatgcaaaaggaaatatggcggctcatattttaggcagaacaggtataatatatgcggaggagtatgaaaagttaaaagacagcggttacggcatgaacgacataattggaaaagacggattggaagctgttttggaaccatatctcaaaggcactgacggttataaaaaggttagaatgacatctgacggcagatatggagacgtggtagatgttaaacctgccaaagccggaaattatgcagagctaacgattgacgccgagcttcaggaggcggcggaaaaatcgttgaaaaaacggataaatgaagcggtcggagataatggggcaggtgcagcgatagctgtggatccaaacacaggagaggtgttggctatagcttcgtatcctgactatgaccctgaaaaatttaatgaagaatatgaggagctggttaataaaaagtctaatccgctttttaaccgcgctttgaatggaacttacgctccgggttctacatttaaaatcttgacgtctgttgccggtttggaaaccggtttaatagaccctgacacttatataaccgacaggggaaagtacacctattattcagattatcagccgacatgtcttgcatattcatctcagggagttacacatggcacaataaatgtttcggaggctataggcgtgtcatgtaactatttcttttacgatatcgggcgaagaatgggcatagaagcgcttgatgaatactgtgataaatttggccttggaaagacgacaggaatcgagctggctgagagcagcggcacggttgcaagccctgaggaaagagaagctgcaggaggagaatggcatcccggtgatgttcttcagacagcgattggccagtctgataatcttttcactccggcacaaatctcaagttatataagcacagtgttaaataaaggaaaacgttatagactgcatttaattaaagaggttgcggattatgataccggtgaagtcataatgcaaaaagagccggaagtaatttcagataatccgataagcgattcaacatttgaagcggtaaaagaaggtatgagacaggttgtcgcagatggaactgccgcaaaagtgtttggtaacagcgagttaaaagtcggaggtaaaaccggaacggctgaggtgtctgacggaaaagataatgtcttgtttacaggttttgctccatacgacgatcctcagatagtggttgccgtggtaatagagcatggcgccagcagttcatttgcggcgcaggttggaaaagacatatttgacgcctatatgaaaataattcaataaaattaataattttatgaaaaaactactttactttttgtgaatgttgtggtatagttttaaatgcagggatttgaaaagatgaaagttatttttttgaatttgtatagataattgccctgtttgtatttttgtaatgattttttatcggtactatatttttgttggtattgcatttttattggttgtggtgaatcaatatttataagacagatgcagtgtgccgtataagatattgcaaattttagtatatgacgcagataaagattgtttagaaatttatataggaggcataggaaatgaacatagcacttattgctcatgataagaagaaggatttaatggttgatttttgtatttcatacagtgctattttaaagaagcataatatttgtgctactgggactaccggtgctgttgttgcggacgctacaggattgccggtaaagtgttttcttccggggattgacggaggagaccagcagattggcgcgcgtattgcgtataatgaaattgacgccgtgctgtttttccgcgacccgttgacgcagcagaaatatgaaccaaatattgattcactgtatcgtttgtgtgatgttcataatgtgccgcttgctacaaatattgctacggctgagcttttaatcatgggaattgagaatggtgatttggattggcgtgaatatgttaattccaaacgtatagtgtaatatcaattttgtacaataaaaatatagctgaaatttaattgagtttatatatttatgttaaagatatagcgttttatatattgccccggtttgtactttttgtgcaagccggggtattttatttttaggagtttttacttatttaaattttgcaaacaaatttagtgattatagaattctacagtatataaaaaccgtttttatctctgcgctttttgcagaatgtacgataaggtcacgctgtgtcacttcctttggtatatcatagaaatgttaattcagacttgttggtatgaattgaatatttaaaaagagtatgatattataatggaaataataaattgagtcaaacccgatgtgatcggtgcggtcgtccatttaaggatctgaacgccaaatacggctggcggtgtgcggaaatcatagcgcctggcggaagcttaatcattgatttatcagcaattttcgctatgcttgaaaaatacgctgacttttcttttgaatcacagaatgacttgtttgatatttctgagatattcgagaagatgctgacactgtcgtcagcgccgtattctatgcaggcagaaaatgattataagggaattattcggggcaagcatcgggtacaagagcaggaaaagtatatgataattatgattttaaattgccaaccatggatagcagaggtaattcgataacctataaagaattcgacgttaacccacccacctctggaattggtagagatgcatcgcgatttgttactggcagtgatgggtcaatatactatactgatagtcattatggtcagagtgtaagtccaacgggattgccaccatttataaaaataaagtagaggaggttttaatgtggaaaatagaatatatcaaattacaaaagatgaactaaattcaattaaacaacagcttaatagtaaaagcaatacatggattgcagagattgatggtgacaacatctcaacatggcaagattatgcagatgaaattgaacgtgtttttaaattccctgccaacattatagaaatgcatgtaaatggactgagtatcgatggatatcttgattggataactgatttaagttggttaaacgcaaacggctatgcactcattatcaacaattttgatatctttatgtcaggagatttgcgaaaaaaagaaatcatcatagaatcttttgaaaaaaatgttttgccgtggtggcaaagccaagtagagcaatatcaagttggaggtaaagcaaaaccattcaatgtttatgtagtggattgaatatgcaatctcaagaagtactgcattgcaggacttcttgcttaagtaatgttaaatctgtttttgcattacctcgacagcaattctcatgcccaagcataacccgttaacaatactatccgctatggagattcagcgcaagtcactttgtgcttttgagaaattctcaaacaaattttttcctctgcatttaagcaagcgagaagttttttctcatcgtcacataacgtgcgtaggattctatcgtattcggtgctgcgagtgaaaggtttgctcgtttaggttaatattgtcgtagtagaacagggtgctttgcattaaaaatatagctgaaatttaattgagtttatatatttatgtaaaagatataacgttttatatattgccccggtttgtaccgtttgtacaagccggggtattttatttttaggagtttttacttatttaaaattttgtaaacggatttagtaattatagaattctacagtatatataatcatttttatctttgcacattttgcaaaatgtgcaaataaggtcacgctgtgtcacttcctttggtatatcatagaaatatcaattcagacttattggtatgaattgaatattttaaaaaaatatgatattataaaggagatgataaattgagtcagaaccgatgtgatcggtgcggtcgtccaatcaaggacccgaacgccaaatacggctggcggtgtgcggaaattatagctgctggcggaagcttaatcattgatttatcagcaattttcgctatgcttgaaaaatacgctgatttttcttttgaatcacagaatgacttgttttatatttctgagatattcgagaagatgctgacactgtcgtcagcgccgtattctatgcaggcagaaaatgattatgttgaaaagggagcagccctcgcttttgcaatgttttcgaactatgatgagttaggagataaagcgagaaaatctgccgtatcgcattttatagaagaaatgcacagagcggaagaaacactgccgccgccgagtttaaggtacactttggcagaacaaatgaacaacaagttaattgattattacgaggaagaaaataacccgaacacaaatgatacagtagaagacttcattgatgaattatttggaaacatacctctgtatcattacataaatgcgatgtttgcaagaacagaagctgagtttgaagacagcttaataaaaggattagaagggtcactcaacgcatttatgagtctgccatacgcaagttcaatgatgggcgacatagcggttgtagaacctcaaatcgcatttgttccggaaccttacgtccctcagcccgaaggcgcagggagtaagattcctaaagtatctgatttgaaaaatagtggtactgttcaatcccacatggatgattatgttaaacatggtaaatacaaaggtgaaccggcaagaccatacattgatactaatggtacaaataccttagttgatgaaataatgcaaggcggtacacctataaaagacgcacatttgcctaatggattacgttgggatgtaccaggcagttttagagatgcaaacggtacataggaattggttgtcgatctaaacagtaatacaattgtgcactttaactttattgcaaactaaaaaggaggatgtataaaatgattagactttgtgctgatacaaataaaccaatggctgatggctatgtgttttataatttaagtgaaaatggaatggatacttatcctgagaagaattctgaaataacgctactgtgcacatacattcaaactggttttgtctcaggtgattctgatgatactaactatgtaaataatatgtgtgctaatcaaatatttggacttgcaccatatcaatcttggaaagccataaaattgaatatacctaaagttactcataaatgtgcattacgtctattagatgtatttgattggggaactaagaggcttgataatagggacgatgaatgggaaatgttctttgactctagctctggttggttttgcgttggagatcctgattttaaaggaactattaatgttaatttcattgaaaatgctattgcaacattaaacagtcagggtgaaattaaagctttatggattaaacctgtattcagggatgatatatctttaacaatttagtttatttaaccacaacacaacgtacaaatatataggtgttgtgttgtcctcatggttaaaactgtttaccaattatatcaactgcaatccacatatccaagcagaatctgtaaacaaaaccatcagcaatggatatacagtgcaagtcaccttgtgcttttgagaaatttacaaacaactctttttttctgaattcaagcatttcagtaacttttcttcattggcgcacacaagacgaaggttttattgtactccgagtttcttgtaaagatttgctcgtttgggttaatgttgtcgtagcagaactcatgtaagatgctttgcattatctttttgcttgtttttcaagacaatacaataccctaaattcagtaatgtagctattcacagaactcaacaaaatcgagcggtgaaaatatattataataaagattaaaaacgtaaaatatggctgatgattgggttgctaacgggaaggttttaagacaaagcagcggaaatcatatttacattaccagagaaggcgctgttgtgcttaataatgccggcgaacttgtaactacatatccaaaagctgactttgatgcaaatatggtaaacactgtcgagcaattatttggagaataggaggaaaatataatggtagaagaaataaatgttataattgatgaatgggatccgataggtctatttccttttgccccaaaagatgagtatttagacgaaagtcaagaaatttgtaacgagtataaaaatggaatgggtacaaaagaattagctcatgttatttatcaggtatttttgaatagctttgggttaaatacttttacaaaaccaataagtgaatgtgaagaagttgcagaaaaaatcgtaaagagcatttagaaaagcaaagtcatacattcgtccattatggacgggtgtatgactgtcgaaaaactgttttttgccttacacatttgtgggttcttcgacggtttgaacactccgtttcacggaacgtttgatgtaaattcgggcacaagtgctccatggtttgatcaaccgggtggtggaacacaatatcaattgcctatgtcaattcgagaattacgtagatatggttatatcaaaataattaaaaaatagagttatgaggaaataaaagtatgagtgaaatatttgatacaaaaacattggaaaaccatgttttatctttatatacaagagcagtaccagtgatgaatgaagatggtatatcaatgcctctaaacactttttttcgcaaaaatacacttaatgatattcaaggtgaattttgttttgcggatgaagatggatatcattatagagttttagaaagagacattctatataatgatgacatcacaaaaagtttgtctaaaataacttattgggctatcaagggggcaatttctgatgcggccgctatttatgaagcaaaaaatcggattttaggtcaagattttcggcgtataatgttttctaaagagttacagtatttaaatgctataggtaaggaatatgcagaaatggctgaattagagtatgataatattttgaaagtaaatccattccgggattgaaggaacaaatagtgtaattattttaggatgacaaacacataatcacgaggctgtatttggagatgtacttgatgttcggttacctgatggaactggagtacgatggtctgctgatggtaaaacatttataggtttcttggaaaagtatacaaaataaaaactaaaggattgaatagaaatgaaagaaaaaggtgtttggagtgctgattttggaaacgatccatacgatgattacaacttaatcgtagagatactctacaatgaaaaagatgtggcaatcattcggaaaattgatggccagttaattctccaatggtatgcgaaagactctaacttggaagttcctgtggattggtttttgggtttactggaggaagctaaagtgagattaagctatgaataagtaataagacgcaagacaaacaacctcattttatataggggtgtctgttgcgttatttttaaaataaaggtgaaataaatgaattcttttaaaaaacttattgaactttgtcaagcgttttcacaagggaagattacaatccaagatttccaaagcagaattgaaacattaccttatcctgatgtttgttcaaaacaatattataatattttacataacgctgtcaatcgtttagaagagataatattttgtaattctaaatccgagtatattcaattagggtcagaagtagcccaaggtcttattaaagaaacaaatatagaagaacagaggattagaactacaaaatttaataatcagtaaataaatatttgatttgatactcattaattcaaagatatcaaatacttgacaatttggttgataataaactaaataagatgataaaaatagataataatagaggaaataatgatgccggtaattaatgattatgaaaaaaaacttatattaaaaaatactgaatttctatttaaaaaaggttttattataattgatgaagacagttattgtttaatatattctaatggaaaagtcaaattttccattttttatgaacgttatgaagaagcaagtgatatatcagtaaagtttataaaggaaaacgagtcctttagtgttggatggatttcacgaataatggataaaaataaacaagttaattataaacaaaaaatggagaatattttttatttacttaaattcattgaacaaaattataatagtgtaactaatattcatgtgtgtaaaagagtaatgagtgaggtagagaagctttttagggacgataaattttaaacataattgattctatataggatgatatatttttataaaaatagcaacaaatttgttttcaatagaaactttatttaaatacaattacgcgatgctcattgacacttgagaacagctcatatcattctttactgtaaaactcccaataaaaccactttataaataaaaagcgccaaatgatcatggtataggatttttgaagttggaacatatgaagtaaaagagatgaaaggaactataataatgataaaccaaaatgactggagattaactaatcaaatgaactatttgtttgaaaaacaaaaatatgtatatttccagaaacattcagaatcatggaatcatgagcattgtgaattttgcaatgaaacaatttgcgatgataaaaaaatggagtgctgtacaatagacaattatcattggatttgtgaaaattgttttaatgattttaaagatatgtttaagtggacagtagtttgatttataaatataaagaaaacataactatcaactttaagtattgtgttgtacatttgggcgaatttgtttactcattatatctcagtatgaggttgtgtggaggagtctgtaacgtcaaataaatagaatgtgtatgggatattacaccttacaagaatcataacaccgcaacaaagaatccaggattaaaaggcgagccaaactcaagtgtagatattttagatgatgctggaaatattaaaacacgcagatggtttggagagaacggtgaccaaataagagatgtaaatatgaccaaccacggcaatccgaaaactcactctgaatggccgcatgaacatgtatcaagataatatagaaagagagtatgtatatgaaaaaaattagttttaaagattttgagtgtatcatgtcatacgatgttgctaaaaaacaagacccttgcattgaaatagagttttgtgttgatggatgttttgagtatcaatcatcatggctaggaaaaatgattgatgaggaaactaacaaatctatatattggtttggattagtggaagacggttcacaagcttatgattttgattcatttgagcaacttgtaaatgccaatattttttatggtaaaagtatcaaggacatatggaatttagtaacattgctttccatagacgcttgtgatgtgcaagaacgactgccattttatttagggtaatgcctaaagaatcgcagcactcagattttttgagtgttgtaatttgttttactaaaactgtttttgtatgactgtaacaatagttttcttaccaaagcaaaatccatccaaaaatccattaataagattttacatgattcatgtgctcttggcggtggatttttaagagatgaatgggaatttcttgagtcaacgttaaatcttacagactcaaatttattctttgaaggaggtttttggtatgttaaataattacttaacagactgggaagcagtagaaaatattgatttaataaagaaaacagctttacaagtctggggagaaaatattgaatttggtgaaataaaaggcagcaactcaccttatcctgagtttgagtggcagatatatctttatagtaaatttatcattaaactggattatgaccgttcaacactaagcataggtgttccaactaaagaaggatatgtagtattaagcagccttacaaatgaatcagtttttgggggatttgatggcatgaaaccggagaacttgctgcataattttcaagtgcttgatcgtcttattcagacgcagaaaattgattaaagttgaacaatgcaatacaaccgccggaaattgggcggttgtattgatgcttttggttaaaactgtttccatattatatcaattgcaatcagcttgtggtacacaatataaattacctatgtctgttgactgattggaagttccacaataaattcagtaaatttatttggttcgctttttagttttatagttcccttatgtgaaacaacaatagactttgcaatagatagccccaggccgtagcctccgctttttctgtctctagatttgtccgaacgataaaacctgtcaaaaatctttgatatatcttccggcggaattccattcccggtgtttttaattataaatctggctgttttattatcaagtttttttaacgtcacttctatcgttccgccttgattagtatatttaatcgcgttatccaagagaataagcactagttgttttatttgactttcatcgcctgatatatatatttcatcgtccaaatcctcaactaaatttaaacttttctcatatataacagcttcggttgtaaggatgacattttcagcagcagaggaaaatgaaaaatttgattttattatattattttcggaactgtggtcaacttttgctaaataaagcaggtcgttggttagttttgccattcttgaggattcgtctttaatataattcagccactttttttcttcattaatagtgctgtctccatgcgtcatgagaagatcaatgttagtattaattgtggttagtggagttttaagctcatgtgacgcgtcggcaataaattgattttgtttgttccaggcgtcttctattggttttattgatctgtttgcaaaaaataagcatattaagaatactaaaattaaagcagccaaaaggacaatagataaagtaataataagtttttgcagcattccgatttgagtattaatatttgagatgctaagataataaacggctgtttcatttccgcttgtatctgtttcatatgatgatatgattaggtatttccaataggaatcatcatattttataatatgagaagtttttgtgttgttattagaactattacttttaattcttttgattgcgttgtcttttattgttgtatagaattcatcatcatattcatacggtgaccgcgtctgcattatattgccgtctaagtccagtttaagcgagctcggctcatccggcgcaggaccttcgttattgggaatatgaggaaaaatttcttttctgttcatgtttgggtctgattgaaatggattaaaaaatctttggcctttgggctgaatattagaaatacctctgtccaattgtatgtttacggcagtgttgatgttgttgtaagtcatcataaaaacaacgcagaacgcgctgacaagtaatatggaaatcataatcatattaagcgttaaaaatttatttctaagttttttaaacataatattattcctctttcaatgagtacccaacgcctctaactgtaactattgaagtttttgaccctaaatattttaacttttttctaagaaatgatatataaacttctacgtgattggcttcagcctcagagtcaaatccccaaagtttttcaattatcatatcttttgaaaggacggttgatttgtttgttattaaatattctaataattctgactctttaagggttaagtttatttctttggaagcgcagcttaaagttaaagctgatgtgtcaagctcaatatcaccaaaagtcaaccctgtgggagttgtaacttcgccctttcttcttcccaaggctcgtattctagccagtaattcatcggtgttaaagggttttgcaagatagtcgtcggcgccgctgtccagccctttaactttgtccataacttcaccttttgcggtcagcataatcaccggtgtatcatttccggtctccctcatattctttattatactcagtccatccattttgggcagcattagatctaaaacgacaacatcatatatattgctcattgcatagtcaagtccgtcttcaccgtcatacacactatcaacagtatagttctgcttttttaaaagctgaacaagggcttcggctaaatgtatttcgtcttctacaacaagtattctcatgatattttagtcccttcgttttggaatttaataaataaattcacaattatatttttataataacataacgtacgtctgttatcaataaaagaataatagcagaacagtcttaaattaatcttaaaatattatatattattgaaagaagtttttaatatttcaattttgaaaaagttttaaaaaataattgattttttaaggttgatttaaggtaataagattattataatcacatcaaatttaaacaggttgatgtgattggaggtggatacatggcaattgaagtctttaacagatttgaaaaaaagttttttatgaattcaaaaacatatttcagagtctctgaagaactcaaaaaatatatggagttagatccatacagcgaggttggaaagggatacacaatcagcaatatatattatgatacaagtgatgacttgcttgtaagaaggtctctaagtaagccagtttataaagagaaactgaggctgagaggttatggagttcccgaggaaaacggcaaggtttatttagagataaagaaaaaatttaacggtcttgttaataaaagacgaactacattatatcttaatgaagcatatgattttataaaaaccggaaaagttcctgattataaggaatatatgaatttacaagttcttaaagagatagaatattttttgaaatgttacaaactggttcctgccgcatatgtagcatatgacagggttgcctattttgaaaaagataatcctgatttaaggatatctcttgatacaaatttaagaaccaggcgctatgaccttgagctggagttaggcgattatggagaacctctgcttgacagcgctgatttatggctgatggaagttaagacaagcaaaactatgcctgtttggcttactgatatattgtcaaattataatataataccttgcagtttttcaaaatatggatatggttttaaaaagtcagtcggcgcttatactcctatgcttaagcgtatcaccgcaaaagcaggaagctatgttgaagcaaaagaaaaatacagtgccgtcagggaatcgggaaatattataactgcagattttgaacaaaatttttctaagggttacaaaactgcaaacgcctgatataaatttttgaaaggaaataatctatggaagctttaacaaatctttttaatcaaacagttattgacggaacatcaataacatttatttcagcttgtgctaccttgttttccgccattatatttggtctcattatatcggttacatatatgattactacaaacgaggtagttccaaacagaaactttgtaatgtcgctggttcttataccggcagttatggggttagtaattttgcttgtgggaaacaatttggtaagagtgtttagtttagccggaactgtgtcgctcataagatatagaagcgtaccgggagacccgaaagatattgcgtatatacttttatgcgcggcggcagggcttgcggctggaataggattctatttatatggtgcacttggagtggttttactatgtgtacttatgattctgctgaataaatttaactttgcaagtagttttgagacacagaaaatattaaaggtaactattcctgaggatttagattatcagggtttgcttgatgatttgttcaaagaatatacgaccgccagtgttatgagcagagtcaggacaactgatttaggttcgctgtatgaagttatgtatagtattaaaatgaagaaagacgttaatgagaaagactttattgatgctgttagatgcagaaacggtaatctgacagttaccctggcgcttgctccgacggagtacggagcttgatattgttaattgctttaatgcaattaaagtttttcatataatccattcattgcgaaagagccgaaacatattgtttcggctctttcgcttggttccgtattatccaattttttgctggacaaagccgcattattctgttatactgtcttttccgggaggttgtcccgagataaattaatcaaaggagaaaatatggaacaaaatcaggcgctagataaaaatatatcttttaaaatgcttattaaattttcattgcctactataatttcaatgatatttatgagtatatattcttctgttgatggtgtttttgtttccagattagtcggaaccaacgcactttcttcagtaaacatcgttatgccgatagttttgatgattatggctatcggaacaatgtttggttcaggcggaaatgcgctgatagctaaaaaacttggagagggaaagaatagagaagctaaagaaaatttctcattgttgatagttgtagcgtttataataagttcattgattgcggtgatatgctatatatttttgaatcctttgcttcattttctaggcgcagatgattctataattgaatattgcagagattatgctatacctattttggtacttaccccagtttctatattcggtatgatatttcatatgtcatttattacagccggaaaagctcactttggattgattttttcagttataggcggtatagttaatatcattctagactatttgtttatagcagttttgggaatggggataagaggagcggctcttgcaacaggtattggttattctgttccgtcggtcgtagggtttatatactttttattcaagcgaaacggctcaatatatattataaaacctaagtttgatattcaggttattttaaaaagctgttcaaacggagcttctgagatggttaccagtctatcgaatgcggtggtgacaattctgctcaataatatattgatgcgtttggctggttccgacggagttgcgtccataacgataatactttatacccagggtcttcttgcttctgcatatatgggttattcttttggtatatcgcctataataagctataattatggaaaacaggacagtgagcgtttaaagaagatatataaaattagcttaagaacaattttagttgcttcaattgtaacattttcggccagtttgttatttgccggccctcttgtgaatatatttacacatagcggaacaaacgtttatgatatggctgtgagaggtttcagaattttttcaatctgcttcctgcttatgggatttaacggtttcgcttcagcaatgtttactgctcttaataatggaattgtttctgcgattctttcatttttcaggacgctggtgtttattgtaatttcagctttgcttcttcctgctgtgataggaatagacggtgtttggctgtcaataccggttgcagaggttttaggagttctaatgactatatattatttcaaaaaaatgaaatctgtttataattatgcataggaggctttaaaatgaatagtaataaaaacggtaagattataatcacaatttgcagagagtatggcagcggaggcagacagattggtgaagaggtagctaaaagactggatataccatattataatagaaatcttatagacatggttgcaaaagagagcggttttgccagcggttatatagacaaatttgaagaacatgtctccagtcctcttatttggggaatacctatgcccagagctaatatggcgtttgccggtctcgcagtgcaaaattactattcaaatgaggagaaaatgttcgaagctcagagtaaaatcattagggatattgcgaaaaaaggttcatgtgttattgttggaagatgcgcggattatcttttgaaggatgaccccggatgttatagagtgtttatccatgctgacaaggattttcgtatcaaacgagcaaaggaagaatacggtttttctaaagattctgaggcaaagcatgccgttaagacgatagatagaaacagaaacgcatatcataaaaaatatgcaggctatgcgtgggacgattgccataattatcatctgactgtgaacagcggtttgcttggtatcgaacgctctgttgatttaatatcagaaatggtgttttccagatagaaattttaatgtgttttatatttgcaaaaaagtgaaaaaccaacaaaactgtcataaaaaatagttgaaaatttattgaagttgtgttaaactaatttataggaaaaaacaaacaatttgcaagggggaaatattaatggattcaacagagcttaaagatttgaaaattcatgcggctcacgtcagaaagatggctttagaagccgtacacagcgctggcgccggtcacccgggaggttcgctttcggttgctgatattcttacatatttatattttaaggaaatgaatgtaaatcccaaagacgcaaaaaatcctgagcgggatagatttgtcttgtcaaaaggtcattgttctccggctttgtatggtattcttgctgaggccggttttatcccgaaagaggacataaaaggatttagaaatataaatagttatctccaaggtcatcctgatatgaaaaatgttaatggcgtggacatgtcaaccggttctttgggtcagggtatcagctgtgcctgcggtatggctcttgccggaaagctggacaacaagtcatatcgcgtctatgcggctatgggcgacggcgagatagaagaaggtgaagtttgggaagccgctatgtttgccgctcattacaagcttgataaccttacggcattcttagattataacggtttgcagattgacggcgatataactaaggttatgaattctttgcctattgataaaaagtttgaagcttttaattggcacgttatccatatagacgctcatgattttgaacaaatccaagcggcggtagaagaagctaagcagacaaaaggaatgccaactcttgtattggcaaaatctgttaagggcaaaggagtttcatttatggaaggtcaggccgcatggcatggcgcagctccaaatgacgaacagtatgctcaggctatttcggagcttgacgcttatatcgagaatcttggaggtgacaaataatgaaatataatattggtgataaaatagctacgagacaagcgtatggagacgctttggttgaatacggcgccgacccgagaatagttgttatggacgctgacttatcaaaatccacaaaaactgacgggtttaaaaagacttatcctgaaaggtttattaatactggaattgctgaaggaaatatgatggctactgctgccggtatttctacttgcggcaaaatagtatttgcaagttcttttgctatgtttgctgccggacgtgcttttgagcagataagaaactctattggatatccgcacttaaacgttaaaattggcgccacacatgcaggaatttctgttggagaggacggcgcttcacatcaatgtcttgaagatattggcttgatgcgtactattccgggtatggttattttaaatccggctgacgcggttgagtcaaatttagcagttaaagccgctattgactatgatggtcctgtttatttgagatttggaagacttgctgtgcctacaatatttgatgacagctataaatttgaaataggtaagggagtagagttatccggcggaaccgatgtaaccttgataggaacaggacttttggttccggcatgttctgaggctaaagaaatgctggccggagaaggaataagtgctagggttatcaatatggctacaattaaacctatagataaggatattattataaaggctgctacggagaccggggctattgttacagctgaggagcataacgtaatcggcggattaggcagtgctgtggctgaggtgttggttgagaacgcgccggttccgatgcaaagggttggaactcaggatgtattcggccgttcaggaaagccgtatccgcttcttgaaatgtatggacttgatgcgaagactattgctgaaaaggctaaggctgctattgctatgaagacaaaataatttaaaaagtctttataaatatgataacagaataagctaaaatttaaataaagaaataacctcctatgatagaaaatatcacgggaggttttgttttattataaagtttatttcaaagccggtattattgatgttttatatttatataattttaaactggaacaaatgatttttatttataaataactgtttaaaaggtgataattaaattttatattaataaatttcacagatgttgatttatataaaatgtcatatattcaacttataaagtctgcaataaattggacagacatgttaaggtcatatatcataacaaaaaatattaaaattaattaaatgtggttttgcaagcattggagggctgtgatcacactttttaagaaaagtgtgtgttatacatacatactcatttctttatagcctacaatgtctgtgcccctacctttacaggtggaattacatctaccgatgttcactccaaacaccgcatttgggataatagttttaaaattgtgtttaacaagcttcggcaagtgtgatactttataggtggggtcacattaaaccacaactaagtattttattatattacaactaagttaattattggcatcaatagtttgcataatacaacattgcttatataacatacacttttaaacaaaagtgtagccgcaattgactttgtagattaggcaaaacaagtcactttgtatcacacccaacctgaaggttgggtcacgatacatcacatttaagtcactaattgacataaacggtttttaaaaatttcatcaaaaacaaaacgggatatttggttcaaaaaattggtttgaataactgctgtttttaaagtgtgcaaaatcttatacggagccggatactgtgttttattttaacgtcagaatgcgtctttcaaatatgaattttataataaagtttatattaaaataatataaatatttgctgatgtaaaatatataaaaaaggtataaaaattagtgcaaatttatttatttgctctccaaaagtgttaaaatattgattatcatttaaaaagtataattaataagtttgctgaacatgttaatctgcgtttattgtttaaaaatttctgtaatttagaaattatctgaaacagttcacatgtacgtataatcattatattgataaaatattgaatatattgtcgattggaggagaatgcattgaatttgataaaagtaaatataggaaaaatgttatattcaaagcgtatggagctgaatctgagccaggaacaaatggctgaaaaatgctgtatatccgtcagacaatatatagacttagaaaactccaaaagaatacctatgcttgaaacttttataaatataactattgcatgtgatatggatataggggtgtttattcataatttaattgagtccggttatgaaattacagatgataaaaatgcgaggcaagagaaaaaatgagagaaaactatagatattcatatttaaaagaaagatactatcatgaggatataggaagctattattcttatgcgataaaaataaataattatgttaagcaaagtattagtattctgccggatatatctccggatgaggagatagtaaaaaagattgtaagaatatgcaatgagattcagttggaacctgaatacatagatgaagtttttgagcagtttgtttaattgatatttaaaaatagttgaacagtaaaaaacagagctgatgaaatcataaagaattaaaagcagtttgattattaaaaattaagagtagtttatatattaagaattacaatatgtttttaattgttatcattttgataaacagcgttatttaaatactgatgaaaactaaccgatttataaccggatgtcaaaaatgaatatattgaaaaggcaagcacgctcaaaagaagaatgtgcttgcctttttgattaaattgtgtgaaataaatttagcgtctagagatttatgattattcttgtcaaagtattattttatatagtttgatttcttaacccaaatatatttgagcctgataattccattgtaaaataccggacaccactatttgctgtattgtaaacttaggctttatgttgtacttttcgttggctgtttgtataagtttgtctaaaatgatttttctgttttcttcagtacaataagaacacaaatatttaccgccgggcagaatttttaatccttctatatccgcatggcgtatacatacagcgaataatcttgatattccgttctccgtatagataccagccaaatcttcaaacgcaaactgttcttttagcgacggctcaattttatcataaaaatggctgagatagttccaaagattatctagtgttggcgtctccatagtatctgaaagcataattacacgttcgggaaaattatatacaaaattattttgaatattttgccgtcctttcagttttctttcgtagtccgctttagctaattgaatttttgatttgctgtattgaagcgccgctattttttcatcggcattcttttctgcttctgtcagaaatttaataattttttcaaggtcgttatattccagaacagttttaattttctgtaaaggcaaatccatcatctgcaatgctcgaactgcgttcaaacgtataatatcctgctgtgtataatagcggtattttgtctgctcatcatatttgctcggtttcactaaatcaatccggtcataatggcggagagtctcgcttgtcatattaaccattttggcgacttctccgattaaaaaatattttttcatttttttcacactttctcttgacttatgtgtaacacaaaggtttataatttattatagcaaataaaatcataaaaatcaaaaattattttgataagaacgagggggtaaaaaagcaatgaagtctgcaattatttttttataacgttattggaataaaagaaattgttgtttaaaaatacaagtttaatgaaagaagtgaattatatgaaaaaagttatagtaattataatgtgtttaacatttggagcaattcttttaatgggatgttctgagagcggcgaggataattttgagaaaaaatactatacttcaaatggagaagagatagcaggattaaatattgacgttcgggatagagaaataaaaataacgttttcaaatgataaccaagtacatattgactattttgaaagtgacaaggaatattacagtatttttgtttccgatgataaggttcttcatatgaatgcagaagacggtaaagagtggccggattatattggaggaaaaacgacagccggcaataggaaaatatatgtgcagctgcccgccgcgcttttaaaaacgttgtttttgtcaacgtcaaacggtgatataacgctgccgagtttaaatgtaacggattctatatccatttctgcaaacggaggaaatacaacatttgataagcttaatgcgggaaagagtataataataaaatcaaaaaacggagatataaacggttcggttaaaggaagttatgatgaatattctgttgagagcaatataaaaaaaggggaaagcaatctgccgccggacaaaaagggcggtgacaaaattttaagtgtgtcaaataacaatggtaatactaatattgattttgtcagcgattaaattatttattttaaaaccattatcccaaatgcggtgtttttaagtgaacatcggaagggtgtgacccccacccaaaggtgggtatgatacaaatcggcgtgtctatataaaccaatgtttctgagtgaacatcggtagggtgtgcaaagcacaccgcgttaggtgagccgccatctcacgcgaagcgtgaatatacatataataatttgttataaaataaaaattgccgggactgcgcgcctaacgcggcagatttcatcttcattgagtattcataataatgacactgtaggctatagcaaaataaaatcatatgtataacacacactttttaagaaaagtgtggtcacagccctaccgaagcttgctaaatacaattttagaactattatcccaaatgcggtgttttggagtgaacatcggaagggtgtgcttgcacaccgcgttaggtgagctgccatctcacgcgaagcgtgaatatacatatggcaacttgtcataataccttactatataactataatgagttatataacatcaggctcctcgctctctagagcttcaggttcaatttctatcagttcagatgtacaatgaggacactttgtcgcatttatgtctatttctgtgcagcagtatgggcaaactttggttgtaacaggctcgtctgcaggtttcttttttccgaaacttatcacactgttaactattttaacaaatatgaaaataactacggccataattaaaaagtttattatagcagtaataaatgaaccatatttgaggttaactcctccgatagacaaaaccatgcttgaaaaatcaagacctccgaataagccgagtatcggtgaaattatgtcatttgtcagtgaatcaacgatggtcttaaacgctccgccgattataacgccgactgccaagtcgagcacgtttccgcgcattatgaattctttgaactcgcctataatttttttcataattcaacctcctttttaattaaaacaaattatactacaaatttttacaaatttcaataagaaatttccttgatattgttagaattatatgataaaatatttttacaactgagttaagaagtaacccgccgcaaatgcggcgtgttcgcttaatattttaatggacagctttttttgccaatgaaaacgttgaatggcggcgcagtgcgccttattgaaaagtggtaattataatgaatatacaatttttaatcggaccggttattgggcttattatcggatatgttactaacaatattgcgataaaaatgctgtttaggccgctgaagcctgtatatatcggcaagcggcgcgttccgtttacgcccggtttgataccgaaagaaaaagagcggatagcgaaaactatcggaggagttgtcagcactgagcttttggacaacgataccataaacaagacgcttttgtcggacggtataatatcaggtataaccgggctggtggaaaaactgtttaataaaatgaaactgagtgagaaaactgtccgtgaggagctttatcagaaacttgataaagatttggttgataatatgaccgaaaaggcggaggaagatatagccgctctcatacacgccaaactttcaaaatttaatttcggaactgagatatccaaaaaagttatagttaatatcagaaatcaatatatagaaaagggcaggataaaagccgcatttgccaaattggtggatgacaatatgattaacagcctggcggaacctattggaaagaccattgacaaaatggtttctgaaaattcggaggcaatagtaggcgacttaataaaaaatgagaccggcaggattatggacacaaagaccagtgaaattgctgaaagatattggcattcaatacccaaaataaagtccgcggttcagtctgtatatatcagaacagtaaaaaatgatttgcctaaggttatggaaaaacttaatattgcgaaaattgttgaagataaaataaacggatacaatattaaagagtttgaagatttgttgttttccataatgaaaaaggaattaaacgctataatttggctcggagctttgcttggatttgtcatgggatttctaaacgcgtttatatccataatattcagctgattatacaaacggaggatttttaaatgaaaagaaaaatttttcagaaaacagctcttttattatctgtagttttaattatatgttctttatgttttgctctgagttcctgtactctgactcagtctaacctgtcagacagcacgagtaaaagcatagatattcgtgaggacggaaattacagttcaaaagaagaggtcgcgggatacatacataagtatggaaagctgccgggaaactttataacaaaatccgaagccaaaagtttgggctgggacagcaaaaaagggaatttatgggaggttgctccgggcaaaagtataggcggcgacagatattcaaactatgaggagactttgccggttaaaaagggagtaaaatactttgagtgcgatataaattacagcggcggacatagaggagcggagagaatcgtgtattccagcgatgggcatgtgtattatacaaacgaccattatgaaacgttctctgaagtttagcaaagttttatattgagcataatatataggagataagacaaatgaaagaaatagtaatcgactgcggaccaatgcagaataaaaaaactatgcacaagtgtttggcagagagcctgaacgcgcctgattattatggaaataattttgacgccttgagcgatgttttatctgatatcggcggcagtgaaagagttatgattgtttttaaaaatatgtcggattttttaaatgataataaaaaactatgcgcaaaattaattcgtgttttagcagaagcggaagaagaaaatgaatatttgtccgtatggtttgatgttaaatagtctgtaatatattgtgttatattgacaacatctgccgtcaggtataaaattaataataatacttaataaaaatttaaaactacaaaagaagggcagtgaatgacatgaaaaagattatggcagtatgcttaagtttaattttatgtttctctgtgattccggtttcaatttttgcggctgaaacatcaggggttttcagctcaggcgttagctgggaatatgactccggcagtcagactttgtcaatttcgggaaacggtgatattaatgattttaaagatttggtttcaataccatggaagtcatattctaaagagattaagaatatcaatatatcagaaggtgttaccgggattggcgattatgctttaagctggtgtgaaaacgtgacttcaattgttcttccgagtacggttgccagaataggtgttgacgcattcggctggtgttctaatctaaagagtataaccttgtctgataatcttaagacaattgattctgaggcttttgcctggtgtaaatctttggaaacaattgagattccggcaatggttaacgatatagacagtaaagcttttctttggtgctattcattagaatctataactgttaattcttcaaataataaatataagtcgtttgacggcgtgctgtttgatacagaagaaaacagtttggtttcatatccgcccggaaaggcaaacgacgaatatactgttcctgaaaatattgcagaaattgaagaatccgcttttatggataataaaattttgacaggaataactataggaaatataaaggaaataggggataaagcgttttttggctgtgagaagctctacgatgtaaatatttcaggagtggaagaagtaggagagctcgccttttatagatgttcgtctatggttaaaataattctgcccgaaaatacaagagcagtaggaaaaaatgcttttaaaaactgcacaaacctagaacttgcggcattttacggcaatgatacaaagtttgataaagacgtttttgaaggagcttcacaggcggcgatagccgggaatgaacattcttctgtaatggaatatgctaataataatgaaatcccgttttatcaaattgttaatgtaatatacggcggaaataacgttaattttgaccctatggcttttgttgtgaataattcaaccaccttggttcctatgagagcggtgtttgaaatgctgggcgctgatgtagactgggatgaaaccagcagcactgcgattgcttcaaaagatggaataactgtttcaattcagattggaagcagcattctttacagaaatggtgaggctattaccctgagcgaagcagggaggttgacagcagacaaaacctatgttccgctcagagcagtttccgaagcttttggaaacgatgttcaatgggacggcgaaaccgccgcagttataataaattaacaaataagaaaaaactggaaaaaagttgtaaaaaaagtattgacaatggtttttatgtgtgataaaatcaaaatgtaataaagaatgggttgtttcccattataattattaaattaatctaatatttggcaaaggaaatgaaagtttctgacgcaaagttaagagtctaagcttctgtttttgaagtatgattgtctagctgcaatgtttgagcaaaaacgctcacaatattgcagctttttaaatgtccacaataaagtgtttatcagctttattacaggtaataatattaatatgattgttttataaggagatggaaattatgaagaaattattgtgtattgttttaacaattgttctcggtatctctatgttttcagtcacctcagtctttgcagcaagcgtaacaaatgatattcccgggacagacagcaaatgtccgctttatgttgaaaacgaggctcggtttattgcgagcggctcaatttacggcggtactgcatatgtaaaaaacggtccgttttatgcaaacggcggtaaggataactggtatatagacggcagagctttagcagataaactaatgattggcgaaggcgcagaaattgatttaaaaaataatgatgttaaggaattggccaatatcgaacgctatgttcctgataatacttcctttgaagcttttaggtttgatacggacaatatcccgggaagcgaattttttgaaggcagcaaatataatgacggaacgcgcaatgtaactatagggtggagccaaagctcttggggaaacaacgatacttatcagtctaattatacactttctgaaaattcatattttaatgaactgacaataagtgatactcttgatatgaacatatatgttcctgaaggcgagataagaattataagagcggaaaaggttaactttaaaggagctttgaaaattcaaggcggaggcaaagttataatctatacaaacgacattttcggcggcggaggttatcctaattctaactctttaataaatgcaacaaacagcgtttatggaaatcccgacagcttgacattcgtatatacgggaaacgttttaaatctttcaaactttgcaaagatatcctgtaatattatttcattgtctaaaaaggtgaacgtcagcaatattgacttcaacggaaacatttattcaaccggtgatatgaagttttcaggaacgtctgttgttcacggtatgatttacgctcctgaatctaatgtgacggttacagctcagtcgataatatacggcttaacagtctgcgatacagcggaagcaagcggcaccggaacatttgcggttggcgacgctaaaactatagacagtgaaataatagatacaataataaacggcggagaaacaaaacccgaacctactgaagccccggcgactgaaccgccgtcagcaacggaaaatcctattccgacagatagccctatagataagaatacagccagggttgtaagatatattgttgaatcgggtgagtattcgctcggtactatgagaataatggatcatacgcctatcggacatgaagacctgaaatataaagttttggacgaatcttcttatgtgataacaggtccgcaggatattgacggttatgatgttataaaacataaagttcagcgtatcttgaataccacagacgatgtttttgttcagagagaaaatgaaatcgtttacagccgtttcggcagggtagactcaaacggttatgacacgtctttaactatagctccttatgttgtgccgcagattgatgatgaggttaacacaatgtggctcgcattcggcgacagaaacggcaaggttcaaacagtttggatggtaatagaataagcgctgatgattgaatatctgacaattcaacaattattaatttaagtaattattgcagagactgctctttaaaacgggcagtctttttttagtaaaatttgtttgtaattagaggtttaaattaattgacacaatttatataataatatataattatccaaatagcaaaagttaacaaagggtgagaaatatgctgaaaaaaattgattttgaccaaggattaaataatataaatcttataaagacgtcgcatgcgtcacaaaaagcagctgcggagggaattgttcttcttaaaaatgaaaatggcgtgctgcctttaaaatccggaatgaaaatatcggttttcggcaggagccagctggattataacaccggcggaaccggctcgggcggaagcgttaatgttttatatgtggctgacatattaaacagtctgagaaaaaaactgaaaataaaggtaaacgaagagttggcggctgtgtatgaagaatggataaaaaataatcctatttcaacaggcctgggcgtgtgggccgcgagacctcattttcagaaagagatgacagtgacgagtgaaattgccgctaaggcagcagagcattctgagactgctttaatcattatcggcagaacagcaggagaagagcaggacaattttaacggcgaaggcagttaccgccttacccagcaggagcatttaatgctgaaaaacgtcactgatgtttttgataagacggttgttctgcttaacacgtcaaacataatagatatgaaatgggtcgacgagtataatatcgacagtgttttatatatttggcagggaggtcaggagggcggagaagccgttgccgacatactctgcggtgataagtgccccagcggcagactgactgacacaatagcgaataattatactgattatccgttgtctgataattttggcagcaaggaagaaaatgtgtatagagaggatatttatgttggatacagatattttgaaacctttgcaaaggagaaggtaaagtatccgtttggttttggcttgtcgtatacggattttaaaataacatgtgctgatttcagaattgaaaacgatatagtaaagtttgagacggcagtaaaaaacgtcggcaaagtttcgggcaaggaggttgttcaggtttattttactccgcccgaagggaaaatcaataagcctaaaatgcagctggcggcgttttataaaacaaaaacattgctgcccggagaaagtcataaaaagacggtttcgtttcctatgagccgtatgtcttcatttgatgattcaggacatacaggggcggacaataggttctgctattgtctggaaaagggcgagtataaggttctgataggtaaaaatgtcagagacccggagttctgcactttttcttttaagcttaatgaaactaagatagttaaaaaatgtgtttcagcactggctccgcaccaaaagtttacatgtatgaagggaaagcccggaggcgggtacgactatgtaaacgtaccgcaaagagaatatgatatcagaaaaaggatagaggacaaccttcctgacagagttgaactcactattgataagggatataaacttgcggatgttaagaatggaaaagtgagcatggataagtttataggtcagctcactattgaggatttggcttgtttagtccgcggcgagggaatgggaagcaagagagtaagaccggggacgggatgtgcgtttggcggcgtttcaagcaggcttttggattttggaattccggtggccgccggaaccgacggaccgtccgggctcaggttcgacaatggtgacgcggcgtcgctggttccgataggaacaatgcttgcgtgcacctggaacacaccgctggttagagaggtttataaatgtattggcggcgagatgctggcaaatgatattgacctgttgctagggccgggtatgaatatccacagaaacccgctgtgcggaaggaactttgaatattattccgaagacccatatataagcggagttatggcgggggcggcaataaatggtctgagtgataagggcgttatgggaacgctgaaacatttggcggcaaacaatcaggagacaaagaggaagcgtgttaattctgtagtctctgagagagcagtaagggaaatatatttaaaagggttggaatatgccttagaatgctcaaagcctacggctataatgacgtcttataatccgttgaacgggcagtggtgcggctcgaattacgatttaaccactacaataataagaaacgagtttggatatagcggagtaataatgactgactggtgggcaagcatgaatgagattggcagtcatgtggcgacaaaggaaaatacagccgcaatgctcaggtcaggcaccgatatttatatggtagttaacgatccggagcataacagcggaaaggacaataccattagggctataggctccggcgatttgaccttgggagaactccaaaaagcggccaagaatatctgcggactgcttatcaacctgccctgcatggaaagagaatccatagttcaaaggggacgcggagctttaagcagaataaagaaaaaattaatttggtggaagtgttagaataattttatagtgatttatagttcatgatttattgataattataaaagggcagggagtgtgttttatgaaaaagacaattctgttaacagcggttgtatttattatttttcaaagtttagcggtttgcgcttccggcgatattgaagataacagcgtgtttaatgatatttatgataataacacaacgtttgtcagcgatattgagtattggcaaagcaaaggcgttatagaaggcgatggctttggcagatttgagccgttagagagagttactcgggcagagttggttaaaatggccgtgctggcagccgaaaaaacagagatttcgggaggggcggaacctgaattttctgatgtgagtgaggacaactggttctatccctatgtcaaaattgcttatcagaacaagattattaaggggaacgaaaacggttcttttgaacctgacaaatatgttgattttatggatatcggcactatttgttaccgtgcgtttcaaaagccttcaatggtgtcctttttcggcgatactccaaggcgctgtgacgctgttcatgttttaagtatgtttgaaagttctgagaatacactaattcaggttgacggagccatagagaaatctttccctgaatttggtttgtacaaaacggtttcagaagctctccgggcagcgcctgaagctgacagtgaagaaaacagagtgtatatatacataagccccggaacgtatcgtgaaagaatttggatagacaagccatttttgacgtttgaaaaaaatcctgaatacagagacctgccgaatgaggttttattgactttttattacggagcttcaagaaattataaaagctatgataatttaagccctgaaatggaatatccggctgattgttcttctgatgaagaatttgcaaaattggtaaaggagtatgaaagcaaaaagtcattgctgaacggaaagccatatgtcaaatctgacggatatataagcggtgtgggaacgcaaaacagcgccagcgttacgattacagaaaatgcgcatgattttatagctcaaaatataacgtttgaaaactcatataatatttacaagtctgacgaagagcaggaggatatatatgagcctgtcagtgaaacagacgttttgctgaaagaaaatttggatactaaaaagcgcaatgaagcttggtaccaatccgccaaagccagaaaggctgatgtgactgtgagcgaaagcaaagacgcgcagacccaggctgtggcagtcagatgttcggcggacagaagtttctttaacaactgccgttttatagggcggcaggacacactatatattaaggataaagccagatgctattttcttttgtcatatattgagggaactgtagattttatattcggagatgcgaacgcagtgtttaattactgcaatattcaaagccgcgcatatccaaatgggggatatataaccgcaggttcgcattcggaacagcagaccaggggatttctgttttattgctgccgcttaaacggtgatgatgagttatcacagctggaaaacagcggcaaagttaaattaggcagaccgtggaagcagggagcaatttctgtattttataaatgttatatgggcgaccatatagcagtgggagaagaccgttttgcggacatgggcggcagtaaaaaggagaacgcccgtttcatggaaatgagcagccgtgatttagacgggaattatcttgaaggcgtatattcgagttatgaatacactgaagactgcagatataagtatttgaatgacaaaaaatatgtttcatccggttttgataagaaaaacaatgccgctatggagcctgataactggaatccaggaaaaggaataattttggaaatgtttgatgacggcgaaatagtagacggcgtacccgtatggtatgataataataatgaatacttcatacctgaattataaaaatgaatttgatataatttagatacagtatttttataatttattatataattaatatctaacatacggtgttaatagtgaacatcgttaggtgtgaccacacttttcttaaaaagtgtggtcacagccatgtcaaagcttgctaaatcacattttttataagaaatttttaggaattaatatcttcaaaacagtatttttggtgaacatcggtaggatgtgcgtaagcacatctcgttaggtgagcaaccatctcacgcgaagcgtgaatatactaataacatttgtcataatccttttataaaatctgttccgtgactgcgcgcctaacgaggcaaactacgtttgcacatcacaactaagtttgattattgacattgtaggtttattaatacaaagtgatttgtatcacacacactttaaaaaagtgtggtcacagccctccgaagcttgctaaatcacatttattggcagcgaagtatctttaggactgctgtcaaccattatttcaaaagtatcatccatatctaacgcatataaaccaatagattttaaaggttcattggcagcgaagtatctttaggactgctgtcaaccattatttcaaaagtatcatccatatctaacgcatataaaccaatagattttttcttgtttcataagacttttcagctctaaaagcgtcttctattgtcattgcaaacgcttctccatattgtttttctatataactttttatttttagttttgtcgcttctacacttaattgtttttaatatacttacttacgaataaaaaactgaaacggagttatatgtatttcttaactatttaaaaaggaagtatttaatggatttttattttaaatagttaattatttttatatggcatttgtccctgtttgcggagtatgcggtaaagacctgtaatagaacgagtatagcctctttgacgaagcttaacccaaaacacaacaagtccggcattaggattacggcggcgcatatcagtaatcaatttcaactcatcagcggtatgctgattgggatgatggtgaggtttatgtgatttatcggctaaggatacaacataatcaaaattatgtgataactaagttcatcttatcaagctgtcttagatgaaccgaaccactttccatggtatatatccgcgttgtatttatatttgtatgtcctaaaatgtcggctaaccttgataaatccttttcttctgaataatatatttttgcaaaaagatgcctgagattatgtggaaaaaccttttctgattttactcctgactcttcacataaatttttcatctctctccatatatttgaccggtctattggttttccgctctttgttataaagatacatccctttgaaatgctttgtctttttatatatatttttaaaattttacaaagtttcacaggaataaatattattcttctttttcctttattgttaatttctgctttacctttataaacggcttcaacagttatataacttaactcagagaccctaattcctgtagcacatatagtttgtataataagagatagtcttttattatttaatttttcagcagtcttaattaatctaaaatattcgtttttagataattcttttttctcatcgcaaaatatatttttctgaatctttaacggttttatttttaaatcgccccaaccgttatattctaaaaaaccgttagcggcagctaatattgtattaacgcttgaagcggaataactttctgccaatagctttttccattcaataagcagtattttactcaattctttttcttcaaaatatttatacattctttttatatcttgtatatactttcttattgttgacaagcttttttcttgttccattaaataaacttcatattctttaattttttctgaccttattattctttcctcagcagttatcatattttttacctccttaaatacttattttatctaaaataattgaaatacatactaaagatttaatatgaagtccatttcatactaaagtttttattttgtcaaaaaactaaacttaaaatttgataatttttaaaaaaactaatataaaaaaacaattatttaatttgaaatacaaaacatactgttcttatacaacttaattcaaaacataaaaattttttattaaattatgaaattttttaaaagtactattgacaacactaactgtatatgttatagtcacagtataattgtatttaaaaaagtcacagtttataaataatgaataggagtaacaaaatgacgggaaatttctgtgtagctgttcacgcattggtctatctaaaccataaaggtgaaactgtatcaagtgaaaaattagctgaaaatatctgcactaatcctacgcgcgtccgaaaagttatgtcaatgcttaagaaaaaaggtcttgtaaagtcgcaggaaggccttgacgggggttatattttatcagacaaaaaagaaaatatatctctaggtcaaatactcgacgctataaatgaaaaaactgtctgtcttaattggcacagcggcgatgatgatatggattgtttaatagcctcaggtatggccggaattatggacgacattgttgaaaacttaaattgttcatgtaaagactatctggataaaacaacaataaaaacaattgacagcaaaatatttaaataaaaacacggtatgttaatccatttaagtataattaattataactaagataacaatataaaatgttatgctaatttaataaattaactttaaaaattataataagaggtgaatttatgccattttcattagagcagggaatttcaattataactgtattttttcaaggtattataagttttttctctccgtgcacacttccgctaataccactttacataagttatttggcaggaggaagcaaatacaccggcagcgatggaaaaataatttatcccagaaaaaaaatatttattaatactatatgttttgtattaggtatcagttttaccttttttctgctgggctttagtttttctatgctgggtcagttttttaataaatataaatatgtttttatgataataagcggattaataatgataatattcggattataccaatttggaatatttaaacgccgtaatattatagaatcagaacaccgcctgccctttaatatcggaaagtttgccatgaacccgctgaccgcgtttgttttaggtttcactttcagtttcgcatggacgccgtgtataggtcctgtactcagcagcgtattattaatggtatcggcttccgattcaaaacttatcggctttttactaataggtgtatatacgttaggatttattataccattcctgcttgtcggtctttttaccggcactgtacttgatttgtttaaaagacatcagaacatagtaaaatataccgttaaaataggagccgttttgttaattataatgggaataatgacaataacaggattcatgaacggtattaacagttatatagcatctgtcacaaatacaagcagctcagagaaacaaaccgaaaataataattctgctgaaaataatataacctaccaaacaccaaatcctgaaataactcctgctcctacaaaaaaacctaaaaagaatacctcactggctcctgactttgaattaactgatcaatatggacaaactcacaaactgtccgattataaaggaaaagtagtatttataaatttttgggccacatggtgcggatattgtaaagaagaaatgcctgatatagaaaaattatatcatgaatatggagaaaacagtcaagacgttattatattaggcgcggcaaatccgcgttcagaaaaataccctaataattcagatgtcagtcaggaagaaattcaagagtttcttgatgagtataacttaactttcccggttctcatggataaaacaggagatgtttttaaatcgtacagtatcatgagtcttcctacaacttttataatcaatagggacggaagcgtttttggatatatacccggcgctatgtcggctgataatatgaaagatgctataagcaaagcaatgcaataaataaaattcataaactttacaatatatctttgatatgatataattcaccacaatataacaatatatggaagtgataaaatgttaaaactacaaaatataaattggaccctagaaaacggaactcaaataattaaagatataaatcttgatatacctgatggcaagctgatagttataaccggaccgaacggcggcggaaaaacaacgctggcaaaaattattgccggaatagaaaagccgacttcaggaaaaatatttttagataatacagatatttccgactatgatataactgaacgtgcaaaagccggaataagctatgctctgcagcagcctgtcaggtttaaaggcataacagtcagaaatctgcttgaactcgcttcaggaaaagaattgtcaatagatgagctctgtgaacttttaggaaaagtagggctttgtacttatgattatatagacagggaaatcaattcttcactttcaggaggagagataaaaagaattgagatagccagcgtactggcaagaaaaactaagctgactatttttgacgagcctgaggcaggtatagatttatggagcttcaccggacttataaaagtttttgaagaactaaaatcaaaacataaaggcacgcagataataatttcacaccaggaaagaattttggaaatagcagatgaaattatagttattgccgacggacttgtcagaacaaacggtcaaaaagatgagataatgccaatattgctggaaaatgaatatggacagcactgtcctgaaggaaaggaggaagtgtatagtgaataaaattactgatgaacttttaaaaattgtttcagactttacaggtgaatttaaaggcgcgttcaatatcagagaaaacggtgagtgtgcaggaagacaatcaagtaaaaatattcagattgaatccaaaaaagatgctcccggtcttgtaataaaaattgctgaaaatacaaaagatgaaacagtttatatacccgcctgcgtaacgcacggaaactttgacgatttagtttataatgatttttatgtagggaaaaatgctgatgtcactatagttgccggatgcggagttcacactgatacagaagaagacgcaagacataatggtatacacaagtttattcttgaggaaaatgcaaaagttttatatcaggaaaaacatattggaaccggaaaaggtacaggagctaagaaaatagaccctgtaaccgaatgtgaattaaaaaagggttcttcattaactatggatacaattcaaataggaggagtggataaaactacccgtaagactacagcaagcctgggtgaagatgcaaaactgataatccgtgaaagaatcatgactgacggtgatgaaacagccgatactgattttacagtatctctgaacggaaaaaattcagctgctgacgtagtttcacgttctgtagcaaaaggaaattcaaaacagagttatatttctaatataattggcaataatatatctaaaggacatactgaatgtgacgctatacttgttgataacggtacagttacagcttcaccgagactgacggcaaataactgtgattctgaattaattcatgaagcggcaattggaaagatagcgggagaacaattacttaaactcagaactttaggattaacggaagaagaagctgaacagaagataattcaaggttttataggtgaataataaacgaccatactattattgttatttttataatgattttagtatggtctttataataatatataatatatatatttatagttgaagatgctgttgttggtacggtgagaaatgtagataacttatttttataaacgctgtaacttaattttaacatgttgataaagtgtttgtaaacgaattgaaatattaacattttataccacaaaaagtgggtttaatgttacacacattttaccaacatattacaaatattacaaatgtgtataactttgattatatttatgtaatattttatttaatttaaatctagtgttttaaatctcttaaatagtcaattaatacaactaacatccacagcattccaagggaacctaggatatagtaaaggtgttttactaaatatgcaaagtttatcatagaaaacggcaggattattacaaaaagtaatatggatattattattcttctttttagagttattatgttaaaataagataatattccatatccttctgatacagcggtggtaaagatagacatcatcagacagattgagtagatactttcgaaatttttgtctattaaacctgcaagtttttgcagaggaaagctttcataccaaacagtgctgaaattcataccgatagcaaaccaaaccaagaatataagcagaccgattatagaacctgctattgctgaacttataagtattgtttttctgtcttttacctcttttgtcagcggtgacagtacagaagccgctgtcagggtattatagcttacatagcacacagcaagaaaaatcatatttctgcctgaacctgataaaaagtctgttaaaaaaaatgttggggagtatattttagacagtattgagaaaattgatataaaaagtatagttaccgtgataataggaactaaaataatatttattgccgcaatacctttaatgtcaaaaataaaaactataaaacaaagtgcagacaggataacagcccctgcaagttttgggataccaaaaacgtttgtaaatatttctccgcatgatgaaagcatgacaataagaccgcatgtcaagtcgaaaaatattaatacaagaaagaacttttgaagtatcttagagaaactcaaagtatgttttacatagtctgatatagtatagagttcatacttcattgacttttttaatatagcgtaacaaacaaatataaataaaatggacgctatacatacacctgtatagtcagtatttgaacaaaagttgaaatattcacaaatttctctgccggaagcaaatccggctccaattataaggcctatataaacaaaaataattttaagacaattcatattatcaccactttgtataaagttaaaatcaatatattttgtatgagcttttataatataactatatatagtggacatgcttttatatgaataaatatgggaatttttttaaaaaatattattgacaagcgtagaaatttgtgttattattgtatctgcctcgtgaaagaggctttatttgtgttaggaatttgaggtgataattatgcaaacaaagattacattagcttgtaccgaatgtaagcaaagaaattacgatactacaaagaataagcagaactgccctgacagacttgagcttaaaaaatactgcagattttgtagaaaacacactgtccataaagaaacgaaataattagaggtgtagagaaatggaacaaaccaaaccgagtttcttcaatagagttgcaaaatactttaaagaagttaagtctgaaatgaaaaaggttatctggcctacatttgcaaaagttagacagaatactcttattgttatgctctatgttgttatagttggtatagttatttggggacttgacgctctctttacttggggtatgtcacttatcattagtagatagcaaaggtgattttttatgtcagacaaaaataaagcgaaatggtatgttgcccatacatattccggttatgagaataaagttatggacgatattttaaagaccgtagagaacagaggaatggaagatgttatccaggaagtccgcgttcctatggaagaggttatcgaaataaaagataacaaaaagaaagtctcagaacgtaaagtatttcccagttatgttatgattaagatgattatgaatgatgacagctggtacgtggttagaaactgccgcggtgttactggatttgtaggacccggatctaaaccggtagctctcacacaggaagaggttgagagtatgggacttgagcatacagtgataaaatttgactataacgttggcgacaatattagagtaaaatatggagctcttgaaggatttttgggtgtaatcactgagataaatcttgataagaagaaggttaaagcaactgtttcaatgtttggaagagatacggatgttgaacttgagtttaaccaaatagaatcaatagcataaatttgttacccacacggattattccgtttatatataccgaaattaatcggtctgtgggaggggcctagtcccgataataccacgcatgtgtacaaggaggtgtaaatcacaatggcacagaaagttacaggttatattaaattgcagattcctgcaggaaaagctactcctgcaccgccggttggtcctgcacttggacagcacggtgtaaatattatggattttacaaagcagtttaatgagaaaacaaaaaatgacgctggcatgattatccctgttgttataacagtatatcaggatagatcattcacatttattactaaaactccgccggcaccggttttaattaagaaggcctgcggtcttgataaggcgtctggcgttccgaacaaaacaaaggttgcagaacttaaaaaagcagatcttaaagatattgctgagaagaagatgcaggatcttaacgccgcttctgttgaagccgctatgtcaatgattgccggaacagctcgttctatgggaatcactgttgaagagtaattattagttccgaataagacggataagtttggtgggaggaatattattattctgctgaaccacaataggaggatatagaatgaagaaaggcaaaaagtatcaagaagccgctaagcttgttgaaaagggtaaactttatgaccctcaggaagctttaagcgttgtttgtaaaaccgcaacggctaagtttgatgagacaattgagcttcatgttaagctcggtgttgattcaagacatgctgatcagcaggttagaggtgctgttgtacttcctaatggtaccggtaaaaaagtaagagttctcgtgtttgcacgtgacgataaggctgaagctgcaaaggcagccggagctgattatgtcggtgctgaagaactggctcagaaaatccagtctgagaattggtttgattttgatgtagttattgcaagccctgatatgatgggtgttgttggtagaataggtagagttcttggtcctaaaggacttatgcctaacccaaaagcaggtacggttactcctgatgttgctaaagctgttgaagaggctaaggcaggtaagattgagtatagacttgataaggcaaatattattcattgtcctatcggaaaagcttctttcggacctgaaaagctgggagctaactttaacgtattgatgggagctattataaaggctaaaccgtctgctgctaaaggtacctatttgaagtcagttactattgcttctacaatgggtccaggagttaaaatagctgcaaataagcttgaaaactaatttattttaggttgacaagttatagatattgtgttaaaatatcgacttgtcagaataattaatttgtaaaattatcttttatattccgtagacagcaggtggcagacgccataaatcctgccgaggatgatatgattatgtataattatgtccctcgcatgtctgcgagggatttttttacggaaggaggatttaaaattgccaagtgagaaagttttagaaaataaaaaagcgatggtaaaacagctgacagagagactgcaaaatgcacaggccggagttttggccgattatagaggtcttactgttgagcaggacacagaacttcgccgtaagcttcgtgaggcaaacgttgaatatacagttttaaagaacagtattatccgttttgctgctaaagaagttggtcttgaggatttagacagcgttttagaaggtcctacagctattgctacaagtaatgacgacgttatttctccggctaaggttctttgtgactttgctaagggaaatgatttgcttgaaatcaaagccggttttgttgaaggaaaagttatttcaattgatgaggttaagcagtatgcttcaattccatcaaaggaagttctcatttcaaagatgatgggttcattgcagtcacctatcagcaaacttgctcgtacattgcaggctatcgttacagaagaagctgtaccgggcggaaaagcagaagaaacagcagcacctgctgaagaggctcctgctgcagaagcgacagaaacacctgccgcagagtagtaaaatattaatttgtataaaataagctattaaatttagataatggaggaaaataaaatggcagatataacaaaaattcttgatgaaataaaagaacttacattaatggaagtaaacgatttggtaaaggctttagaagaagaattcggcgttagcgctgctgctcctgttatggttgcaggtgctgccggagctgctgaaggcggagcagaagaaaagtcagagtttgacgtagttcttgctggagcaggcgctcagaagataaaggttattaaggttgttcgtgagattacaggtcttggtcttgctgacgcaaaggctttagttgacggagctcctaagacaattaaggaagctgtatctaaggatgaagctgaagaaatgaagacaaagctcgaagaagttggagcacaaatcgaacttaaataattaaaaaattaagtttataccgctgtgattaatttcacagcggtttttgtttgatgagttatggtataaaaaaatttattaacaaaacttttagaaaaaatcatagtaatagtaaaaaggttaagggtcgaaaatatatcatttaataaaaaacatttatattagaatctcaattacatgataatttactattcatatttcacctgcttgaattttgatttaaaataattttctacatttttataacttatattttagttttattcttaatttgtttaccagatgtatcaactggatttttatcatttgtccatactataataagtaaactaactttatttttaataattgctacttaaaattcataatgtatataccatcatttaaattattatttaataaaaacttatattattatagagaaataaatgtcatacaataattattaagttatattatatagaaacatattattttataatccgtttccatcttccaaaattagagtaaatggaccatcattaattaattctaccttcatgtcggctccaaaaattccggattcaactttcttaaatttctgttttgcatattcaataaaataattatatattttttcggcatgagatggtgaacctgcgtttataaaacttggtctgttaccctttttgcagtcagcgtataatgtaaattgtgaaacaacaagcagttccccatctatctctattgatgataaatttgttttaccattactatccggaaatattctcagctttgatattttatcaactgctttttcagctttttctttatcgtcgttatcagaaattcccaaaagcgccaaatatccgttttctatcttgcctgttatcttatcttctacggatacactagcttttgatacccgttgtaaaactattttcattttatttgctccttctgttaattaaaaaatatacaaagccaattgcattttgtggttttaattactctatgttttgtatgtttctttataaggatattatcacccggagatagtttaagaatatttaaatctccatcatcgctcaatatttctaattctgcatatccggtaagaagacaaacaaactcatcctgatcttggtcataccacccggttgtatggccgtctgatattattttttctattctaatgtttgtactgtttaatagagtattaactatttcattttcaaacttatatgttggccggtcaaataaattttctatactaccaaatcctttcatattaatagattatattttatactttttttgtcaatttgtaaatatattaaattagagctttaattaatgttgtagattattaaagtttatatacattattttctgctttttgagactacgcacttaaagaggtacctatcggagctcttccgatgtttgctgaaaacaattttaatatctttgaaattaatttattatggttttacataagctatttctgttttctgagactgagcacctaaagaggtacctatcggtgctttaccgatatttgctgatataatcttaatatatttattatttattgattatgattttacctaataattttactatccatgactgcgcacctaacgaggcgtctgccgccgccctgccgatgtttgctaaaaacattttatttttactaattaattatatttagtaacaattttggttatacacctataattattaaatattatttatgtaattaaacatctaatataaacaaattaataattataaaaataataataaagtttttttagcaaacatcggcagggcggcgacagacgcctcgttaggtgcgcagtcatggatagtaaaattataaggtaaaattataaacgataagaaaaaatatataagagtgatttctagcgaacattagcagctctgttttaaatgaatagtaataaaaaaaataatataattaaaaaggaaaactataaaaaataagataattttcagcaaacatcggcagggcggcagcagacgcctcgttaggtgcgcagtcatggataacagaattattaggtaaaatcataaacgataagaaaaaatatataagagtgatttcgatttctagcgaaaattatcagctccgttttaaatggatagtagtaaaaaaaaaacgcacgcttgcgtgcacaacccaaaaacaaatttataaaacataaaaactcaaataaaaaataaaaatcaatgaacaacggtaggtgagcgaagcgaacgcgtgaggtgaatccacatcgcacgcttgcgtgcacaacccaaaaacaaatttataaaacataaaaactcaaataaaaaataaaaatcaatgaacaacggacataattttgattatgttgtatctatttaaataattgaataactatgtgactaatttcaatattattataacataattgtttatttgattacaagttaataatataaaattttacatattttttaaaatagacaacataaataagcagaatgaatatatatttttattccgcttgtttgttatgcaaaaatttattaaattgtatctaaattattatttataaaaaataataataatttttgttataaaaaataatactttatggcaagttattacaacataatcaaaattatgttgtatgtgatattatggtgatataactataacacaatttatgagttttccgtattctttttttctatttgtaacacatctattgtaatcctacaatttaaacaatatttttataaaaaaactattgacaataaacagctggttatgctattataatatagctgtttacgtggtccggtagttcagttggttagaatgccagcctgtcacgctggaggtcgtgggttcgaaccccatccggatcgccaatgctgccttagctcagttggcagagcacttccttggtaaggaagaggtcggcggttcgactccgctaggtagctccagactaaaagcctatagaaacattagtttcagggcttttttattttataataaatataaaacttgatattttattataatttatattttattaaaatatcactttgtaaatatgtttttaatctgtgaatatagcatgtattttataaagatttagccaatttaaatttttaaatatatgacgctattatattgaatattttttatataaaaacaattattatgtaatattatcctgagctttttaatttattaattaaaatttcttaaatcaaattactgtctgttggttaaatcattttttcaatcactgacatacttttaaataaaacctacactattaatcaatatatattttatttaaaattacagcatacaacctgtacgaaactatttacacgactgcataataaaatattcgtcaactaatcctattttttgacgaatataatatatcaatttatctataaatgagaaaataaaaacgccggaaaatttcggcgttttcacgtctttaatttaatatgccttttatctcaatagtttttttcgaagcgttcccccatctatccataagtaaaatgttatatttgccatttttcgaaaaaagaatataatcattttttatctgtttttcacggacaaccgtatctatattgtcaaaaatgcttgccgcctcatattctatttcgggaaaatatccttttattggctcctcctcagtgtatggttctatatatctatacgcagatacacaggaatcattaatgacatacttaactgaggcaaacggatttaaaactgactcaatattaactctacacgtatttctgaattcaggtatttcataatcgccatcacaatactctgtataataagactcaatctttggcctggctatacattcaacctttaccatctgaaaaatatccgtaccattctcggttattgcgtgaaatacatatttaccgttctgatatatactgaaaacacattgttcctgagcgtcaacaattttagcattgaacatattaatattatcattatataattctgagacctctttgtcaggattaaagtaatttaatttcacataatccatgacttttacacctacattaggttttagagaaagcattgccggataaaaatctaaatcatatttttcatctatattcttagatatacgttctggtttgtccagtttataatttatacttccattaaaattatatcttaaatcatattcgtatgtttcataaacaggttccatagaattcaaattattccatgtaaatacctttattaaattacctccatttctttcaagagaaatttgtctattcccaagttcaatattgcataaactacaatcttttccatcgtcaaaatatatcgccgctatgatttcacattgttcacctaaatccgtaagataatcaatataataagtgtctccgtcatttctaatgtcaatcttaggaattgtatctgttggaacgaatggaattgtatattttcgtgcatacagttctacacatgaaccttttataccatacagaatttttccatatatccaattataattcgaatatgtatctatagtaatagcatcatcttcaataacatcgactgtatcaggaaagacaatttcaataagtctatttccacagaatgcatttttacaaacagaaatcgttccgctgggaatttcatagcgacccatacggccggaaggatacgaaatcaatttagtttgtgaactatcataaagtaccccgtttacatccttataaatttcgttgccttcagctatttcataatcaacaaaattttcacccttaatcctaattccctgattatcatccttgatggactttggaacatatagtttagttatctgcctgcagaatgatagagcgtcttgactaatactgctggttccctccgctattcgcacttcacctcttttggcttgcggacacaaaatcaattcgcttttttctcctttagtatataacaaaccatcatcagagtaaaatacaggattatccgcatttacaattactttttcaagttctgaagttaagcatccgggaaatatttcaatcaaactgccgggaagctccagactctttaaaacatcacattgaccaaatgcatttaaagataacccctttaacccttccgaaaatataattgatctaagattacagcaatatccaaaagaattttccggcaaaaattccatactcttaggaatagttaccccctcaagactgcaaacattaaacgcattttccctgaaaccggttactccttcaggaattatgacctccccgatcttgttttcgggacaaataattagttcgtttaaatccttgttatacaaaattccatcaacagacctgaaattattattattctcattgacttttatttcagtcagatacggactcattgaatacattccaatcatttcgacactgcccggaatatcaatactgctaatattagattttaaaaatgctgaatccacaatttcagtaacgccttcaggtatagaataatgttcaagtgtcaatccgcagaaaattaatttcgacttattcgccgaaaacaaaattccatcctgactaatatattccacattgccttcagaaacatttactttttcaagaagttgaaaatcatgaaatacctcaggatttatatatgtaacggtatcgggtatattaatctcgactgtgctcggaattgaccccggcgcaactaaaccttctatacctgtgactgcataaccgcccaattgttccgggatatttaatattttatcatcggtataaggttcccaattatacaagagaataacagcgccaaaatctctcacttcatattcatagtttttatcacttagctgctcttcataaccaattgaaaataccggaacactcattgtcaaaacagatatcacaagcaatatcaataaacacttcttcatatataatcacctcaaattatttaccaggtatagtaattatactccgccttcatattattatcaaacaaacttaatttattacctgcagtagatctaactttatctgtaacaatcaatttataataattattaggataaaaaccttctatcccatttgtagatattggttttacactcactgctttctgagtcggcttatcatatatttgtaactggtcagctcttttaccattttgctctacgtacaaattatctatatttactgtagtctcatcaaccttattattaaattccaatcttaatgcatttacgttttttgaatcaattagattgcactctatacctaatgttgcagatttttgttgattatacaaaatgtcagcattgacaatttgccctgtgcactcctcaacttgaaaactattgaaatctgtttttcctctatttgaagtaaccttcagatctaaagttacttcttttttatcattttttagatatgacctgcatttttgaattaaaggcgttaaatcaaacgccacctgtgccgaggatgttgattttgtattgccgttaaaatcaaccgccggaagctgacctccatattcttgagttaaagaacttgatctagcattataaaatgcacacttgtttgtgctgacatattcattataatttaatggactggttacccctctcttcactgtgattgcaagtctgtcatttgtttcaagctcggctattccaatggccaacggcttataatatgcagtaggaatcacagtacaataaccttcaattggtttatagcttatcgtgtatttaacattattttgtattattgtttttgtagtcccgttcaataatttgtatggaagccatataaatccctcatctccccaaaaatctccccacgaatttacaactctaaacgctcctgtccctaatggagtatttatgttatcatcaaaaccaacaattgtcattgcatgcctgtcgttaatataccactttcgttctgaattatttatatatatctccggagacatattgatccaaaaacacccattattatttgttttcatattattgtcatatattgaatatgaaaaaaatgaaacgcagtaaccatttataagagtctgttttatttttgttatatcatagtttttattataagctactttacatttattactcatagcatcaatatatgtatctttttccgttggccaaatattaaagtcactttctattctgccaaatatttcgtatttatcgctttcatcatacaaattatcactaatcaatctatcgccggataaagaagcgcagccaagtgaatttaaagtatctctaacctcttcaaaatatgagcccatgtctattccaccatttgtcatactatataaccatctcggagacataacattatcaattattatattcccgttagtgtcctgagcacttgtatttcttacattattaaaattattggtcaattgataatacgcaaccgcccatgataaacatgaacctaacgaagcttggtcacctacaggaggaaaataggggtttggcgttgtcgtaccatcaattttagaattatccaccttttttaccgaagcaagtatcgattgccaattgctactttcagattctaacgacacctccgagttatatgtttcttctgggtcgtttttacttattataaactcttctcccattctgcaaggcacaattgtttccgctaaatttacgtcaccttcactttttatggctgctaaatacctatttaccgctcttgaatttggctctatcttatctatagatggagttgtattgaccacctcgttccattcttcatctgatggcatcaataaaccggttgaataaacagtttgctgaagttcttctgtatcttccgctgcaaaactcactaaattataactgtttattattataaataaaaataataatatacttaatattttgtataaataatttttcattttttatcctccctagtcaatcatagttggcgtaaccgatactattttaaacgggttttcaatatataatgtataattgcctacatccgcctttgtttttggtacaacggcgatataatatttgctaccaccaataaaatcctcggatattttaaaactaacatcatctctactacaatcagaatacaataaatgtttatttgcatcaaaaactaaacctttaacatttttaactgacttagcggtgaccacgtaagttccggttagttttggctcaaaactgactatgtcaacatcatctgcctgatttattatagcctccatagaaaaaggcatagtaaaactttggttaactgaatcaattgtacttgcgtaatcatctttgaaagtagtaattgaaaattcacctgtgtccccgtttgaattataaatttttaaataatattcttgacctgcgtaaaaataattatcaaatataaaaccatactgatgattaccataaatatcataccaaccattggtttttctcaataataactcctttgttccagaatatagttctgcattttcagctataattgatttacttattatattataaattccagattgtgtaggtgttagtttaaaccacattacctgtcccgcatattccatattgacatttattgtaccattttcaggtattgatataatatcgtttgctttattaatacttatgccatattcacctgtatcattttccccagataattttaaatagtaagtttggcccctaatcagctccttttcaattataaaatttatattttgtgagttgatatcatagctttcttctataagtatattattattatataatgctccctttatatttgtattaccatatgactgtataacataataaccagtttcattaggtacaaattttatacaatctatatcatttaaaaagttaatatcaccaactatttgccttccaatgccaacatttgtcgctttatcattgtcatttccgaaaaaatcctgtttatcatttgagagaataatgacaggtatagcaggctgcatatctatacctccgcccatacctaatattgaaattttggaattgtattggcttaaatcaaattgactcagtgcacaggtatttgaaaactctcttgtctctcccggttctatagttaattcacaactatcataaaacgtcaacaaagatggaacttttttaagaacataaaaaaagtaatttaacggtatactcgacgatctattattagttatactgacatcaacttttacatcactgccttgttttaatacattttcacaataaactccattacatgataatgttacatcaacatcgatatcatcaattgtcgaaattgatgataactctgcctcagtctcagataaaaatctagttgtatctaaaacctccatgttttctgttaactctattgagggaagcttggattcctgtagttcactgtcagataccaacggttgcatattatttttaatcgtctttgaaagactaagtggcatcatactgccatatcttatatcatttccttcacaaacaaatatcttaactttataatcatttacatttgcaggcacatataattgtggtaatagactccctatttcccctgaagcaatttccaaatgcacactagaatagtcaacaagtttatcattaccgtcatataatgcagttaataccattacattctgagttttctcctctgaatcattttgaattgtagcttttacaccatatgacgaatcaccttttagtatacttggcgcttgaacggaaagcaatgtaggtaccgcaatattattcggcggttctggacaaattggggtaatgtcagactcatgacctatattaaaaaacgaactttgtatttcaggctccccctcaatagtagcaaatacttgatatgtcccattcatatttccctttaaaggtatagataatgaataatatccaaccttattacttgtcacttgctctaaaacttctattccattactaggatttagaacccttataaagacttgtttaccaccctgtccggttgtatatccatttatagataaagtattctctttaatcgaagtattaatatcattattcatattagttatactcatatttacaggaacttcgcttataattccaagctgaccaaaatcatttttgccaaacgaccataattgaccatctttatcaagtacaattgaaaatgccccaccacctgtagcttgtataacattattaaattctccgaccttaaccggtgttttactggttccattattaccatttccaagttgtccgtccctgccttccccccacgcatacactgtcccattattaagtactgccatgctgtgggcatatgcggtaccgaccgattctacgttgtttatactttgtatggcggtaggaatatttctgttatttttatcaccaagtcctagttgaccaatagaattctttccccacgagtacactttattatcaacccctaaggctaaaatatgttctgaatctgttgatatctgtttaaaatcgcccgccaccaaatgcggttccgaagctctaatatcagcatcatttcccagttgcccatagtcgtttgctccccacgagactacactaccattagatatcaccgccataaatttatcaccacacgacaccttttctacagcatcaattaccattacttcagctggtgttccaggtaaatattctcctcgctcgccaagctttccgtcagttgaatttccccatgtccatattttagacgaaccatcatattctcttattgctgcactgaatccagttccggctgatatatcggtaatatgatctattcttgaaatcttagttggtatatataccttacctttaagatcatttccaagttcaccacttgaattattgccccaaccccaaacatatccattttcgtcaagtgccagtgtatgatttttgccttttgctacttttactattttaggtaacccttcaactttttgaggaaagtttatatttttattttcctgaccatgacctaaatcataatatgaaccgtctccccatgtgtatacgtttccgttttcatctaaagctaccacactatttctttttgcatcaacttggacaaatttacttccaaatggtattttaagtggattgtaactctgttgatttacatacttatcaggatttccgtttggcatatatccccacttatatatataacctaattcatcgctaatccatgtggatagttctcctgcggcaatgctattaaaatcagtgttaattgtttgtggtatatatgaatatatgttttcagtttcatatcctaattgtttataagtattatcaccccatgaatatgtattaccatccttatctattgcaaatgtagaattatatttagtaattattttttcaactccagttataggaactttatgaacataaggagtatcctctgaaatacctaattgcccatatgaattgtctccccatgaataaacatttccctttatgtccaacataaccgtatggttttcaccaacagatatgtctaatatatccttgtcgcgaacttcttcaatttcaccaaatcctacaatatcaaacccataatcaaatccagcttgatatttatcattttttccgcaaccatataaagttccgtttccttttaaatagaaactattgtcccctcctgcgaatgctttaataatatcaattcctgtttctttcggaacatttataaattctccatttataccaatttgactgtattcatttgacccccacatcatcaatgtattattattagttacagctaaagcatgatttttcccagctgatatactaacaatatcagataaaatttgatgaggaatattactgttttgatttgttccgtctcctaattgtcccttattatttaacccccatgtccatacggttccatctgctcttagtgcaacactaaaataatctcccgctgcaacctctactatatcttcaagtaactgaacacagctaaaatcagaatctagatttgttccgtttccgagctgaccatattcattagagccagatacatataattccccaccagagctaacatataaacaatgatttttccctgcagacattctggttcttgcattgcttaaattattccaatacccaacaattaaagtaggataaaaagtaccattacaagtaccattaccaaattgaccatatgaattgtctccccacatccacacattcccataactatcaatggcagctgcatgactatatgacaagataacttttgttatattagacaatgtactaatttgttctggtgacgttttgtttatcctatttcctatacctaattgtccatagtaattatatccaaatgaccacgctgtcccatcatttttaataataattgtataatctccatcagcacctatatcaattacatccgtgaaaacagttagtactgcattgctgtcctcggttatttccggcattcctaattgacctctactattcgttccccaaacatatacctctccttgattagttaaagccacagcatgatttgtaccacacgatacttttataatattagatacattcataactttaacaggtaatgtctgtgtcttttccgagccatcgccaagaatcttatgtacatttgaaccacaagcccatacagttccatcattttttaaaaaaatagtcgatttaggagtacccacaacttgctttacgtttgtaatactgagttgctcaggagaatatactatttccttgtttccgttacctaaactaccataggcattatccccccaggcaaacacactaccgtctgttttaatggcatacttattatagtaactcgcacttacagagtcaataccatataattcatttattctttttactatattttgattttcaccccaataccatacgtatccacaatcacataccgcaatacaaaaaccatttcctgctgaaatttgctttacatcaaataaaccataaacctgtacgggtatattactttctgtaaaagtcaagttaccaagctgaccataactattattgcctgcagcccagacagaaccattgcttttcaagaaatatgtattttcgccctcaacaacaacttgtttattttccagactgctaaacaactcccagctttccgtagatgttttctgatagtcattaatctcaaaatcatcatccggaattatattgacctcttcttttattgccggaactcctgtaaccgcaccgtaaagactgagcttgtttccatcaatcacactatcctttaaacacgtaagtttatcagatgtattctttagagtctcctttaaagtatcaactccaatactctgagccaatgctgcagcccccgttacaagtgcagccgacatactggttccatccattgtaccatattcgccatttggcaaacaactatatacgtcactaccaacagctgatatatcaacactgttaacaccatagtttgaaaaatatgacattcccaatccttgattcaacgacgctacactaattgtatttggtaagttaaaagctgccgggtatatcggcgtctcatctatatttattttattgtttccagaagcgcatacaaagaataatcctgattgctcaatagattcttttaatgccttattatcatccgtacttccaaaactacagtttactatagttaccccattctcttttgcatattttattgcttttattatatcgctagtgcgtgctttaccattttcaaatacttttaatggaactatctttgcattaggaacaatctttgcaattattccggctatatgtgttccatgcgattgttctaatcccaaatctacattatatacttcattgacatcattaacaaaatcccatccctctgttatatgttcggataaatatgggtgatttacatcaattcctgtatctatgactgctactgtcacattatcaccacggcttatttccaaagccatatttaaatctttatctatattatatagtctatcgtactcatttgattctggctcaagtgtttcatctgttatagaagtctctgtaatatttaatgaattataatcgtcactaatactagtatcttcaattatattatctgcagttactgtttgactatcagattcagttattaattctgtgtttgtttttccaaacatatccatcacataatcaggttgtaaatattcaaccacatctcctagttcatttataatattatctataaatgtatcagaatttacactttcatttaactctataacttcgaattcttctgtattgtccgtaagtttgctaacagtaacattttcattagattcagtttttattctgttctctttcattttaagtcttacaagcttctctttatcaatatttttaaaccttcttaaccgttcagactcctccttttctcttttttccattcctttttgatatgcagtttcacttacatttttaagttttgatatatcttttttattagcgtctttatatttaattatatatctatccttattttgcttttctgaatataaaatctcttgttcaacctgcataagttctttttcatcacttggtatattattatctacatcctcggccgtattaaattcattatcaaatgataaggcatcgtattttatcatttgattatttaatgatacactaaaaacatttgcgtttactggcaaaactgcttgaataaataatactacaacaaccaataaaagcactaaaaactttttcacacgcattagtaaacccctcctaaaaaatatataatataactctatattactagattaatttttccacctcaattctaaataaaatattatatttctataatcactgcaatttatatatagtataaaagctgtattttgtaaaatatttttcaaaaaactctttacacattatatcattgttacacaattagcacaagccaaacacaaattttcatcaatatccacaactaattgacacaataaacacattgcagcctgaaattatgtatatattcactaaacttgttttatcacaacttattttgttggaaaaataatattgaaaacatttattaaatttataatagaatatattcaatatgctgatagtataattatttataaattgatgtcgaacagtttatcatcttgaaatcttaataaattacatgaatgtagtattagaactaaaaataaataattaaagtcaaatataaaataaacattagtattgatttcttatagccgaagcttattattaaacataaaaatgttttctttaagatttttcaaaacttaaaaaattcacgaaggggattattgcattttattttgtaagttacttttaatgaatttcatagctgcatatgtttgaacatatcatttatactaaatagtttattactacttctccacatatcctgcaaatattattggattaacttatataaaacatatgaaaacaaaaataatataaaacatatatctaatacatactatttcatctcagactatagcttataataaaaaggaagaggtcggcggttcgactccgctaggtagctccaagagactatacagatgtatagtcttttttttatttattttccactctttaatatacagaatctaaccgaaacttttatttaaatttttttatcataataagatataaataagacaatccatgttttaaattctaaaaacattgcttaaaaatttatattcttagtttttatagagttctccggtcatataaaatttattgcttttttcgacccaatatgttataatatataaattaaatcttgtaaagtttatgtgatagatttacattttttataaaaattttaaagataaaaatgtaaaatataaataattatttgagaatcgtcttgaagggaagagtcgaatgttgcaaaaaaatataattcacgaaaatttaaacaatttttgcgttacttggtttaaaaatcgtgatgcgaaaagcgcggcagaatatttatctgatgacatcacctttgtcggcacgggacaaagtgaatatgaaaatggaaaaaccgacatgctaaattatattgagcgtgatatcgaggaaatatctgaaccttttgattatgaacttgtctttatccatgatcaaaagatttctgatgacgtatataaatcgtcagccgaaatgatactaaaaaactctctatacgaatggcatctcagagccttttttttggtagttaaggaaaacggccgctggctgattaacaatcttcatttcgccgagccaagcagcagccaacgagagcaagagcattatcctcaaacgctggttatgaaaaatacagcccaaattaggaataaacttttgaacgactctctggcaggcggtatgatgggcggatatttagaagaagggctgcccttttattttgtaaaccgtcaaatgctggactatttgggatatgataatgaaggagattttatagcagatataaacggattgataacaaactgcatgcatcctgacgacaggaaatctataaaaagagagattgataaacagcttaaagaaaataatgaatatgaagttgaatatcgcatgaagaaaaaagacggctcatatatatgggttcacgatttaagccgcactattattaccgagagcggaaagcccggcataatatcagtatgtatagacataactgctcaaaagaaaacacaagatgaaattctgcacatatataacaatattccgggcgccgtcttccgctgccggtttgactcaaaactctccattatagatgcaaatgacggattatatgactttttaggatataccagggaagaatttttagaaatgggcaattgtatggcttcaattctgcaccctgacgacatgaaaaaaattattgacgaactcagtatacaacttagaaacgggaacaccatagacaaagaaaaccgagttatatgtaagggcggaacagtaaaatggatatctgttaaggctcaattatttaaagaagaaaatgaagatagttgtttctattgcgtttttgtagatataaccgaaaagaaacgtcttcaggagcgggttaaggaattatatgagaacgagttaaaacactttgcggaacaatctccctctgaccgtataattcaagggcgtttgaatgttacccaaaatatcttggaaagctatacatcaacactcaacttagttcatgccaaagtcggagatacctacgataaaattatagagaatttgtcaaagtccgctgttgactccgagtacggagaaaaaattcttacttcgttaaacagagaaactgttcttcaaaatttcgcgttaggtaaaagcaactatcattttgactttctcagtcaaggaaatgataactcagttttttggtcaactacaagcttccgcttctgcgttaatcccgaaaatgataatataattgcatttttttatactttggacgttactgagcaaaagcttcaggaacaactgctcaggatgatagcagaaatagattatgatattataacagaaatagacataaataaaaaccaatacaaactcctttcattcaataaagaagatggaaacactttgcctcccagcggtaagtttcaagaggaaatcagaaatatagcagataaatttatggatgagaaatctacgaatgaataccttacaaaacttgatttcgattatataaaagaacaacttaaaacaaataaaacatattcatttataatagaaatgaaaaacatttatggcaagctccaaaccaaaaggctggaagtgttttatatcaataaggaacttggccgggtttgtatggcgcgcaccgatgtaacagatattgtggagaaagaaaaacatcaaaaggaggaactcgcctcagctctggttgctgcagaacaggcgaacgccgccaaaactgattttctatccaggatgagtcatgaaatccgtacacccatgaatgcaataataggtatgagcactattgcggcacaggctatcggaaacgatgaacaggtggcagactgtatttctaaaattggtatctcgtcacgttttctgctctcgcttataaacgatattcttgacatgagcagaatcgaaagcggtaaaatgcttttaaaatctgagaagatacctatagaagaattcttaaacggcatcaattcgatatgctactctcaagcagcggccaaaaatgttgaatacgagtgtatagttgatccaatactcgacgactattacatcggcgacgctatgaaacttcaacaggtattaataaatattctcagcaacgctataaagtttacaagcgagaacggtaaggtttctttttctgcttcagttcacagaaaattaaaaaacgacgcagttctgagatttattgtaaatgacaccggtataggaatgagcgataagtttattcctcatatattcgaaccgttttcacaggaatataccggaaccacctcactttacggcggaaccggtttgggattggcaatttctaaaaatattgttgatatgatggacggaaacataaccgtccgctctataaaagatataggaacagaatttacaattgacgtaaagcttggtatcagcgatgaggaattgcttcatcataaacataagaaaataacatataacttttcgcatctaaagacgctggttgtagatgatgatgtgacggtgtgtgaaagcgctgtcgttaccctcaaagaaatgggagttaaagccgaatgggtggacagcggcataaaggctattgaacgagtgaaagagctttacaataacaaaaaatatttcgacatgatactgatagattggaaaatgccggaattgaacggtatcgaaactgcacggcagataagagaaattgtcggccctgacgttacaattattattatgaccgcctatgactgggcttcaatagagcatgaagcaaagttagccggagtaaatatgcttatgagcaagcctatgtttaagtcgtctcttatttctgctttttctaaagcgatgggtgaaaaggaagagaaatcacagcaggcgaaaaccttggaatacgatttttcaggaaaacatattttactggttgaagataatatgataaacactgaagttgccgttatgctgcttaaatccaaaggattttctgtcgataccgccgaaaacggtctgcgcgctatagaaatatttaataaatctcaaaacggatattatgacgtaatcttaatggatatacgcatgccaataatggacggtctcaccgccgccagcaatatacgccacttaagcaacggcgacgccaaaactattccgataatagccatgaccgccaatgcttttgacgatgatatcgaaaaaagcaaggctgccggtatgaatgcacatttagcgaaaccaattgaacccgacaaattatatcaaacgctttatgattttatttttgaacaggataaataatatcaacgtactataaactggatctgtaataattttaaaatatgaaatataaaactgttttacaatttttacgacattaaatataaggaggtgaatattgtgtccgataaaaattctccggctatagaacaaataattacaatacttaataactctccgacagcaatatatgtgtcggccattgataattatgaactgctgtacataaacgaaaaggccagagacattctcgcgagcaactcaaccggtcaggaacgaacctgctatgaggctgccggtttcactcagccctgcccattctgtcagacgtccaaaatgagccgggataaatttatggttcgtgaattccaactacctattgattcgagcatatatcagcttagcggtaaaattattgattgggacggcagagaagcccatatcgaatacataacagatattactgagagaaaaaaggaagagaacaaatctaaggctgtcaaagaagaactacagactactttcagctgtattccatgcggattatgcgtatataaatttgaaaacggcaaaatatcgccgttgtttcataatcccgctttctatggaatcatgggttactcggaggaacatataaaagaaattgagaatgataccagctttctcggcgttcaccccgacgaccttcctgtattacaatctaaaattcaagatgctattttaaagggcggactcgtacaatatatataccgcgtctggaatgataataaaaatgaatatcgctggatacgtcttgatgggtcagttgaaacacaagccgacaatactaaatttttgtacggcgtttattctgatgttaataaacgggtactccttgaacaagaattgactgcagccaacgataaaatgcaggatattattaatgcaatccccggtggagtggcaatttataaagtatccgatatttttgaaactatctatttctcagacggcgtaccggaactttcaggatacacagtcgaagaataccacgaactcatcaaagaagacgctgccaaaatgacttattatgaagacaccgaaatggtggtatcaaatatacaggaagctataaaaaatcacaccgttaccgaattcgactttcgaaaacagcaccgtgacggacatatagtttgggtacatgttcaggcgaaacaaattggcgaagaggacggctgtccgctgatacactgcgtatttcataatatatcaaatctgaaagaaacgcagcttgagctagaccatctcgttaactctatccccggcggaattgccagttaccgtattgaagacggaaaatttattccaatatttttttctgacggcatagtggctttatccgggcatacccgtaaagaactagaagaaataactaaaaacaacgcattagaagtaatatatgaagccgataaaaaacgtgtttcggatgaagctgtatcagcgttaaaaagcggaagggttttagatatatcgtatagggtacaccacaaagacggttccctggtatggattcacctaaacgggcgccgtatgggaccgctttccgactcttcaagattttatgcggttattaccggcatgtcttctgaaaccagactgttccaaagtattgcaaatgaaaccgccgacggtatatatgttatcagcaaagatacctatgaattattttacacaaatgaatcgaaaaatcttttcctcaaagataatattactataggggaaaaatgttataaggcgcttttcggcaaaagcgccccatgtgaattttgcactctgaaaagtcacaaacctgacaactcggaacatgatatgttagttgacggaacagacaagttttacagcactcggtttcatgaaaccgactggaacggtatatccgcatatgtaaaatatgtgcgtgacgttacggaagaaactaaaatcaaatttgaaaaagaacggctgtctatgtattttcaaagcgttgtagaaaatctgccgggcggaataaccgtaatacggtatgaatctgacaacagcttaatccctgaatatatatccgaaggatttgcctccatgtgtcatatgacagtcgaggaagtggagaacatatataaaaacgatatatttgcaagctttcatcccgatgattcagacaatataaaaaataaagttctggattcaataaacagcggaaacagtcactgtgaactgacaggccggctaaaactaaaagacggcggttatatttgggtaaagagcaccatttcattaatacattcttcggatggagtcaaaagattatatacggttcatactgatataagcaaatccgtggaagaaaaggaacagctcagacagcagtacgaaaatatactgctgcagcactatcaggcacccgggcctgacaccctgattttgggacactgcaacataacgaaaaataaaatacttgaaattattgattatacggattcagatctcttaaagactttcggctatgtacgcaatgaattcttttccggcatagccggtttggtaacagatgaaaacgaacatcagcagtttcttgatacttatttaaacaaaccgtctttagaggcttatttaaaccatgatactgagaagatattaaaatgctttgttaagctgccgaaagaagaaaaaggacgttacgtacaatttaaagtaaatatgattgaggcgccggacagcggagatattaccggaatactgacagtgactgacattactgaacagacaatatccgaccgcattcttcatcagctttcaatcaccagctatgactatgtcattgatttaaatctttcaaacgattctttcactgtcctttcatgcaataagaacgcccattgtgcgccgccaaagtatggccgtcattcacaaagggttcttgatatggtcagcacagctatagtacccaaagacaaagctcagtattcaaaattacttgaaccggatgagatacgccgaagattaaaaaaagaaggttcatatacatttgcctatgctatttcagacgaaaaaggagacgtccggagtaaaaacatgactgtttcagctatagatttaaggcttgaccgtgtcagcctggtgtgttcagatattactgactctgtcagggaacagcaaggccttctcaatatgatagcatatacctttgacctggcgtgtctttttaacattgatgattcacgcttaacgctgtatacacgtcaaatcgtgcttgaaaatctgactccgtacattatagatgattacgataaaaaattaaatatttttgcaaaccaacaggatactgaaaaagaaaaagccgaattaaaaacgcggtttactatctcatcgatgattaaaaatctttcaaaaaaaccgtccggttatgactttgtgtatccgcagaagacagaagacggtctcagatacaaacaaatcaacgtgctttggggcgatgaaaaccaccgaacaatctgtatggtaagggcggatgtgacagatatgctcgccgccgaaaggcacactaaagaaaccttagaaagagctctcgagcttgctgaagaagcaaataaagcaaaaagtgactttctatccacaatgagccatgatatacgcacccctatgaatgcaattatcggaatgaccactttagctgaagttcatctcgacaaccgtgaaaaagtattagactgtcttaaaaaaatatctgtttcctcaaaacatctattaagtttggtaaatgatatcttagatatgagtaaaattgaacgttcaaagatagccatgaacatagttccggtatatcttcctgatttaataaaccaaatagccgtaattatcgaacctcaggcgaaggaagccgggcttaaatttaattacaagctaaaagaaatcaaacataattatttttggggcgattctctgcgtattaaccaaatacttattaacattttaaacaacgccgtaaagttcaacccgttcggaggaaaaattgattttacagttgaagaaatcccggcattaaagacaaataatgttcgtttttgttttacggtctctgataccggcgtcggaatgtctgaagagtttttaaagcatatttttgatccgtttgcgcgtgacagttcagctgccaagattgaaggcaccggtctcggtcttagtattactaaagggcttgttgaactaatgaacggaaaaatctccgttgacagcaaacctgatatcggcagcaccttcaaagttgaactcgaatataaaataaacaataacatagaaaaaacaatctccaaaaacaatactgaagattcgataccaaaagacaaaaacctatttttaggacggcgtttcttaatcgccgaagataatgacataaacgcagaaatactctgcggcctgctagatttatacggcgctgaatataccgttgaagagaacggagaaaaggcggtttctgcattttcctccgcggctcccggaacttatgacgccataataatggatatccagatgccaaaaatgaatggatatgaggcaacccgcgccataaggaacatcggaagcccagagtctaaaactataccgattatcgcaatgaccgcaaacgcctttgctgaggacatacagtctgcattagactccggaatgaacgcccatatatctaaacctgttgacgtaagcatactgctgaacactttaaatagattattaaaaaacaacaaggacggctaaaaaaataattggaggatattctatatgtttagaaaaatagtgttttttcagctcattataattttgacatctatttttcttctctcaggatgcacagaaaaaagtaaggttgtgagttatccaaataatcccgatacaacaacaataacttttttcggcaataaatacgagacagagaatgttagagttatagaagaaataatatcaaactttatgaaagaaaatcctgaaatcagagtttcttatgaaagtcttaaaggaaacgaatactatgaagcattggaaaagcgtattaaaacaggaaaagctgacgatgtttttatggtgaatcatgacattcttcttgagcttaaatcccggggcaaagtggctgacttatccggtctcagcacaatcccaaactatactgacagtatgctcagtcagatgaacgacaacggcagtatatactgggttcctactactgtttctgtttttggattatattgcaacaccgacttgctgaaaaaacataaacaaaaagtccccgaaaatttaggagaatggagaacagtatgcgattactttttagagcagggaacaacgccgataatagccaacaatgatatttcattaaagaccctagctataggaaaagggttctactcagcttatcaaaacaaaaaccagcaagaaatctttgagagtttaagttccggtgataaagttctaagtgattacttaggatccgggttctctcttgtcaatgaattcattgacaagggctatattgacgccgctaaaacccttaacactaaaaaaacttcagatgatttgacggaatttgtaaaaggaaacacgccgtttatgctgacaggagcttgggcagcaggacgcgttgctgaaatgtctcccgactttgagtttcaggttgttccctatcccgcattggacgatggctccttagaagtcattaatgctgatactaggcttagtataaactcagaaacggcaaatcttgacgaggcaataaaatttgttgaatattttacacgagatgagaacatacaaaaattcgctgaccagcaatcatcgttcagtccgcttaaaaacggttctccctctgctgttaaagaaattcagccgcttgtttcttgttatcaatcatcaagaacagtaataggaacagactctatgcttgatttgccgatttgggatttaacagccgacgcaactaaaaaattgctttcaggcgagtcttttgaatccacaatgcaatggatagacgaacaagccggttcggaaaggggtgctcctaatgaaacgtaacatttcaggcaatattaaaaagaaaattgctttcgccgcaattcttataggtattgttttagttacccttacacttctttttatacggggagttcaaaatcaattatgggaagaatctattacagctattatggaaaacactcagcaaggctgcaacactcttcggatccagctcaaaaacgattatgagtcaatgagtgtactctctaaagatataaaaaaatattccctaagccaaacaaatgaaatagaaacaattattaataactacggccatgtagaagaaaatataagtatgtataccgaagacggcagttatttcccaaaaggaaaccaaattgacaaaacagtgcaggagacggttttgaactctgatattacaaatggaattattgacccgcacatcagcagcataaccggggtaaacgtttttaatatatttataagaaccactatgaatgatggaacaaaagcctatttggtcaaagaatatgagatagaaaatatagttgaaagttttagtctctctttttataacgacgccggcttttcttatgtcatcaacaccaaaggagacgttttaatccgtcctccgcatccaaacagcaacaaaacagttaaaaatctttttgacatgcttcctaccggcaaaaatgacgcaaacaatattaaacagtttgcacagtcattagaaaacaacgacaccggctgggctatatttacataccaaaatgaaaaaactgtattctgtttcacaccgttacggctggagtctgactggtttttaatttcgataatacctaaaaatgttgtggacgctcaaacaaatgatatattaattcgttccatgcttcttataggctgtatacttttaggaataattctcttggcattattttatttccatcatgctaataagacaaataaaaaaataaccaaccaaacaaattatattggtcacctgtataacgccctcccggaaggggttgcactcataactgtaaaccagccgtttaagctgatacagctcaatcaagagggacttcggcttctgcattatcccgatggttcgctgaatgatgcgccaaaggggaaagagttaaaagatttcatttatcatgaagacgctgacagaattatcaaagattttacaaatgtatctctaaacagtcagagaaacacttttgaacacagaattgtcagaactgacggaagctttttctgggcctcagttattgtcgagaagacaatcagtgaaaatggagaaccggtgttaatcgccgcgtttcacgatataacaaaagaaaaattagccgaggaagccgcagagagggaaaaactccaggaaagaatcactcttgttaaagcgatctccaacgcctaccctgttattatcagtataaacctttccaaagacacactcaatttcatttatatgaaagagggactcatgattgggctcggaaagcaaaagacatataccgaactatataatcaaattgtttcaaccattcacactgacagtattgaagaatttaaagaaagatttgcacccgaaacgctgacagccgctttagggaaagaaaaaaatgaaatatttatcgaatgcaaacaaatcctttcggacaaaaaataccattggatttctacacaaataatatatgtagacaatccatattccaaagataaactagctatacttatttcacggcgtatagatgaacagcggtatgaagaagaacagagacggcaagcgcttcaaagcgcgctagacagcgctaaatcagcaagcgaggcaaaaagccagttcctatcaaatatgagccatgatataaggacgcctatgaacgctattttaggaatgaccgccattgccaccacgcatatagacgaccgggaacgcgtattagactgtctgaaaaaaattgggctttccagcaaccacttgctcagtcttattaacgatgtgcttgatatgtctaaaattgaaagcggcaaactttctcttagaaacgagccttttaactttgctgaacttgttgccgattctattgaattggtacgttcacaagccattgctaatcaactcaaactcaatgtgcgttttgatgtaatgaaaaacgaaaacgttatcggcgatcctctaagaatacgccaagtatatattaatattttaagcaacgcggttaagtataccaaacccggaggcacagtaagtattgaagtaaaacaaaggaagagtatacataaaggatatcagaactatatatttgtttgctctgatacaggaataggaatgagtcctgattttattgaaaaactatttcagccatttgaaaggtcaaacgattcatctgctgacaaaataaacggaaccggccttggtatggcaataactaaaaatataattgatttgatgaacggagatattcaggttgaaagcactctcggaaaaggttccgtcttcacagttacatttccgctgcagcttcaagacgccccaaaagatgaaattcctcatgaatggaagggaatacgctgtttgataattgacgatgatatacagtcatgcaaagacgcggcggaacttttagaggaaatagggttgagagcagaatatacaacagagggaaagactgcggtggaaaccgtaatccgcgaaaaggatacatcagacccattccgacttgtaatcgttgactggaaaatgcctgatatggacggtattgaaaccaccaggcagttaagacagaaaataggttctgaaattcctgtaatcattctcaccgcatatgactggtcggaaatagaacatgaggcgaaaaagtcaggcgtaacgtctttcatctccaaaccgttctatcgctcaaagttatgttacttgttgaatgagctaagcggagataacacttcagaagagtcaaataacatattagacattacaaatttgtccgacaaacatgtgctgctggttgaggataatgaaatcaaccgcgagattgcacgcacaataattaatgaaatgggtatacaaacagatgaggcaaaagacggagaagaagctgttaaaatagtatctgaatcagaaattggatactatgatttaattttaatggatatacaaatgccaaagatggatggttacagcgcaacaaaagctatccgactgctagacagggctgacgcttctgggattcccataatcgccatgacggcaaatgcctttgaagaggatatatgggcggcgcggagagcaggcatgaacgggcacctttctaaaccagtaaatatagaaaaattaaagtccactctgataaatgtattaaacggtaacagcgcggattaaaattctcttgttttagttttatcggcttgtaactgattttgacagaaccggtgaagatgtattttatttgcattacagtcatatcatacagaaagcaccaaaaaaattatatcaaactatttataaaataagtatttggtatatagtgacttttagatagaatgtgcagataagataaaagtaatactattgcggcagcagtatatgaatgtatatactcatacgctttactcaatttgtattatttaaattgagtaaattcacttattggaaaactcaaccccaaagcccccggcgggtatagttggaattttagaaaaccttattccatgcgggtttacagagttacgccgcaaatgatataacttgcatagcatattttattaatttataaacaaaaatgacgctgtttcatatatgtatacagcgtcatttttgttatacaattttggatttaattccatttcatttgactttattacaactctgtttaatattatccgtttgcgctctcaagtttaaaaaacacttttttagaatatagagatattcctatcgatacaacagccgctcccagcataatcgcccacggaaccatagaacatacgtcaaataataatccatacatcgcctgacctgcaggagcagcgcaattagcaaccgccataataagcgccattatttttccaatcaaatgggacggcgtctgctgctgaaccatagagcacatttgaatagtaaacattgtcgacagcgccattgccgcaaaactcataccggtgataagccagtatccaaccaatggcggaacaaatgaaaacagtccgattcccataacaagagccgaaacagaacacccggcaagcaacagataaccatttttaagttttagtcttcctccgataattcctccgagcagccctcctgccaaacctccaagaccaagcgccccctgagttatacccaaacttatatcgctcatttgaagtatatttacaaccataataggtattcctacaatcataacggaagagaaaattaaattaaaaagcgccagaataacaataaccggtacaaactcaggtttttcatttttgatatatctgccgctttcttttaagtcatccaaaactattgacgccatacttttttctgactttctctttttaaacggaatatgtataaaaatctccattactgccgaactaaggaaacacgctgtacttaccagcaatattggaacaagcccccaggcgccgaacaagatacctccgattataggacccaaaagacttgccagagtatttaccatgtttataacagcatttcccctcataatctgctcattttcaagcagtgccggaatacttgcctgaacggcaggctgatatgcgccggatatactgtagagcagcataaggcatacaatcataataggcacaatcggcagtataccgtgtatcaaatagaatactgcaatgatagccgccgttccaaagtctagaatcaccattatatttctcttgttgacccgatccgccagcactcctccaaacaatgagaaaattatcattggtataaatgaacacgccgtgaccgcgccaaacaaagacggcgatccggtttctctcagcaaatacagcggcagcgcaaaacgcagtatagcgttcccaaacagtgatataatttgccctataaccaccaatgtaaaatccttttgaaacaaaatctgttttttcatatttctctccttttacaaacagaccaacagtctgtataaattttatataaaactgctctatattgggcagcttattttattctttttcttttttatttattgatttactatattcaactaaagtgtcaattaactcttcatcaagaatctcaaaaccatatcctgacgttatttcattgtatacagcgcatcttgccttaacctcctcaggagttgtgggctttataagaggatgaagccaaacgtttgccaatattaaaagagcctctgcgagttcgtttggatgctctgtcttaattgaaccgtcttttattccctgctctaagattggttttatatataatggagcaacctcgttaaacacactttgtatttcaattgataaaaatttgggattatcaagcaagtatggcacaatatccattatccgcttctgacttggacaaagcaaagagactctaaaaatctccttaagcttttcgacccctgaaaggtcttctctggagactattttcctcagcactctctcactttcctgaccgactctgtcacacactctcaaaaatatttcttcttttgaggaaaaatgatggtatatagcgcccttggacagatttgttctatctattatatcctgaagcgatgtttcatcatatcccttttcagcaaaaagctttgccgctgtatctaatattaattttacggtctcctccggatatttatttcttgacattttttcaccccacttacagactaacggtctgtatattatatcagagagaaaattatttgtcaatataaatttattttaaaaactttatttgaaactgccgctaaagcggcagtttccaaacacttacatattaacggactttttccttcctgcagcagcacttgcagcaacagcagcctgatgatgaattcggctgccaaattgcatatagaaccacatccattgtcaaaggacctaaatactgtccgggctggtacataacgccgctgccgtcagcataaatattccagccgacgaaggtatatcctgttcgaacaggcatatcatcaggaatccaaacctcactggcgtcaggaatctgtatcggtgacggtatattttctgcaggcggaccactcgcgtcgtttggttcgaatattaacacacgccaaggaataataattgcccaatgagcatacagcgttatatcctcagaagttcctgacggtattacggttacctgagttccgcccaactcctcagtaaaccatccgacaaattggtatcccggaggcccgtcaagcggctgcaaaattatatcaggagaagtccccgtaaaggttgcaggatttgggttatatgcacccaaagtgtttaaataggttatcgtgtgaacagcctgatcaagaattatttgagttttatcactgctcagccgaactttccagtcatcgaaactatcaggcggctttataaacgcgtcagcgtcttgctgtgacaaaaccgggtatgaatcttctgacgccaccgccgccgctatagaattcccctcatcgtttggcgtaagataaggcgagttgtttaactgtatcttggagtcgggcagaatcctgctgttcaaaattggtactgatgaaacatcagatccaatatacactccgttttcaatatttcttgttcccataatgttgagttctgcggaattgtaaatacccggagctgttgcggcagaatttggattttcatcacctaaagagacactctcgcttaaatatacaacagaattgctttcgttgtatatacctcctcctgcatttgccttatttccatttatactgccgtttttgaaattaaataccgaagagttttttaaatatactccccctccgaattgacccgaaacattaccgtctatggttccttcctgcatatttataacggcgccgtccctagcatttattcctccgccgtttctgcgggctttattatctctgacctcaacagagtctgatagattcattgtaccatatgcgagatacacaccaccgccaccgttatttattaatccatttccgccaacagcagaattccgattcacttttgcactctcacacaaatttatcgttcctgccggaatattaaagtatattcctcctccattgccattgattgtctcgttgccatatatgcttgttgttccattgaccgtcaaactgctgttggttcctgcagcccaaacgccgcccccgacattatcagcaatattgccagatatatccgcgtcctgaataacagcgtttagctctcctgaaccaccggataaacgcagtcctccgccttcattgcctgatttattatcaatcaccgtatcttcaataaagtttagaaccatgggcgttgtgccgctattagtgcagattgctccgcctccgctgcctgccgcactgttattgctgatagtattattgtcaaagcttattttcccgccgtctccggcaatgcttattcctccgcctgcggaacctgctgtattctcatttattgtattttcactgaaagttaaatccgactttgctttgtcattaatatatatagctccgccctgataagaggaggaattattttcaaaattcacattgtttattgtttcagtcagaattttgtcggtactgttatttataatataaactcctccgccgtgtccgtttgacatattggtggaagtattaaaatcaatttgcgtccctgttaaatttatatttcctccgttctgagtctgtaaataaagaccgccgccgcttccggcactgttgtcctttagcgtaatatctaaaatctccgcatcagccgagctttcgtcctggaatatcatatatactcctcccccggccttaacagccgaattttgcgtgaattttgctccgcctgacaaactgaccgagtcgccattaaaggtgcccatataataaagtccgccgccatatccgccggccgtattattagtgaatttcacctcgttatttattgtcagagttaatggcactgtatttccatttataaaattagaacagtaaacccctccgccatctccttccgcttgatttccggtgaactgaacgttatcacccaaagtaaggtttccatttaccccctccaaatatgagcggaaatataaacctgcccctgaagaagctccgttattgcttatgaccgaccgtcctgtaataaaaacgctgtcgctgttatttctcagcgccgccataattccgccgccagtggttttggaataacatccggtcaccttggcattatcccgcatcaccaaagcgttggcgtagtttgcgtttcctgacatatatacagctccgccctcagtataagcgttattattttgaataaccgcgcctgtctccagggtcagtgttccgccggctaataatacggcagacctgtttgtgctgttatcgtttggatgtttccctgcatttccatcaagtataatatttcggagagttaaagcaccgcagtttgtaatactgaacatatttccaaagaaagattcacccttgaaaatagtacgaacattggctgaatcaatactgcttataacaacagcatatctgattaccagccgtgctgttagagttatatcagtatccacttgtatgaaactgtcatgtgcagctattgcagcctgcagttcactctgattattaacaattgccaatataatcacctactttttaaattatcgggcgcatttaataatatgctgtaaaactttgtaaagtgcagaaattatgacaaattacgcaaacccacatataatattttttacagcaaaattttcgctattgaataaaacatgcggctgtgttaaaatactgtttaatatcatcagctttggaggtgaaaatcatgcactttgttaaagctaaatccattctgtcttccaaaaacgggattaatatctataggggctgcagccacggctgtatatactgcgattcccgcagtacatgctataacatgagccacagttttgaagatattgaagttaaggaaaacgcccctgagcttttaagaaacgctctaataaaaaagcggcaaaaatgtatgattggaaccgggtctatgacagacccatatattcctatagagaaagagctgcgctataccagaaagtgtattgaaattatagatgaaatgaatttcggactcacaatacttacaaaatcttctttaattttaagagatttagatattttgaagaatataaataaaaactctaaatgcgtcgttcaaatgaccctgacaacctttgatgagaaactgtgtaaaatactcgaaccaaatacatcatcaacatatgagaggtttaagacactagaagcaatgcacgacgcaaatatacccgccattgtgtggctttgccctattcttccatatataaacgacagtgaagaaaatctgatcggcattttgaattactgtgtacgagccggggtaaaaggtataatctgctacggttttggtatgaccctgcgtgacggcagcagagaatatttttatcagaaattggacaaacattttccgggattaaaagagcgatatataagagactttggtgactcgtacatagtcactagccccaacaaccaaaaacttaccgacatatttttaaatgtttgccgtaaacatgatataatgaccgatgtaaaaagcatttttaaatatttgagcgcctacgaagataagaattttgaacagctgggattttaaatatctagctgaacggagtgttgactatgcagtttaaagacaaaaatattgaacaaataaaaattaccgtcttggttgaagacactaaaaacgaaaaccttccttcagcccatggattgagtttatatattgagacgcctgaaaataaaattctgtttgatatgggaccgaatgaactattttgggaaaatgctgaattccttggaataggtttaaatactgtggacactgctgttatatcccacgggcactatgaccacggcggagggctttcaacatttttagacaagaacaaaaatggaaaagtatatattagggaaaacgctttcggagattattattctacctcacaggggaaagcgcgatatatagggcttgacaaaaaactaaaaacaaatgacagacttatattaacagcaccgggaataacccaaatcagcagcaatctaactttattttcaagcgtggaaagtaaagaactatgccctaattcaaacaatgtactttggaaaatgacagaacacgggcttgtcaacgacaactttgagcacgaacagaatctgataataaaatcaggcaataggtatatacttgtcggaggctgcgcacataacggaataattaatattgaaaaaaaagcacaggaaatcatgggtaccgctccggatttcactatatcaggctttcatatgtccataccgggaagcggtcagagcgagccgcccgactttgtacaaaaagcggctaaccgtctcagagaaagcgaaactatacgttatacatgtcattgcacgggaagcgcttcatatgaactactaaaacaaaccctcggagaaaacttaaggcgtttgacgccgggctgtcagattatactttaacttttttatatcgtattataattcaatatattatttttaagattctatagaattctataaaattcatagtatctatttgccgccgactttctctctcagcggcatataaattactaagaaattttatattgataggccacaataaattgaacggaaatgttaaggttatatatcgtaaaaaaaatattaaaatataataaaaaatgtggttagcaagcttcggcagggccgtaaacacactttttttagtgtgtaataaaaatcactttgtatcgccaccaccctacaggtgtgatgatacctatcaatgttcactaaaagacactgtattgtgaatattaatctaaaaataatataaagatatggttttgcaagcatcggagggcaaacgcagtttgccgcgtaaggcgcgcagttgcggaaaatttattattaaaaatgattattacaaaattttttagtatgttcacactttgcgtgatttgacaactcacctaacgagacacgcaagcgcgcaatatatcacaactaaggtaattgttgacatctatagtttatataatatacacttttatttaaaagtatagccacaattgacattataggttaatcaaaacaaggcactttgtatcgccccaccctacaggtatgatgatacctaccgatgttcactaaaagacactgtattgtgaacattaatctaaaatattataaagatatggctttgcaagcatcggagggcaaacgcagtttgccgcgtaaggcgcgcagttgtggaaaatttattattaaaaatgattattacaaaaattttttagtatgttcacactttgcgtgatttgacaattcacctaacgagacacgcaaacgcgcgatacatcacaactgagtaatttattatatgacaactaagttaattattggcatctatagtttatatcacattatttagtttatataatatacacttttatttaaaagtgtagccacaattgaccttgcaggttaatcaaaacaagttattttgtatcacacccaccagaggtgggggcacaccactaaagaacactgtattgatgatattaatctaaaatattataaaataatatgattctgcaaacttcggaaggtgtgccccaccttccggcggcacaatagacatccttaattttttgttcagtctattgtatcctatcttctatgtgcaaggaagctatattgaaaaactattagcaatttataaaaataatatttataatttattattatctctgacttactataagaatattgtaacttacactgatatattttacactgacataatcagctcgttaaacaaaaaactaaataaaacaaaccccataaaaacatatgttttatggggtttatactatatatgttccaaatgttttatattatactatcttaaccgcatacaaatccggcagccatgttgatagatttgtaaatgttaatgtaccgtttgtcaggtcctgcggcagcgtaaatgttatcttgctcagctgcaactccttctctgctcctgccggagtcaatgttacagggctttctgttctctctgctgttgccaccactcccgaaccgtctgacaggctcattgttattcctctgttatacgctccgataaagtataccgtatgggttccggctgacaggtttattccgttcacatatgggtctcccaaagtatttgaagcatttgggtttcctataaaattcttatatccttttacatattcattatcaattgtcgtaccatttgagcagaacatatactgaacctctgttccgataaaatcatcacttattgcaaacgttcccgcctgctcattctgtctgcctttcgaaaatttaaaataaataaatataatggaatagatgtattaaaaagaaatataactaccgaaaacacacacataaacacttaatagtattttataactatcgagtgggaatgatatcacactcgcctgaaagccagtaaccgtgcgggttacaccgttctggatatatcttgtggcaacgttttggcaacacctgcaacataaattgtattgttccataaatatagagctaactgaatgggacgttcacaaggatatataaatcatataacatcaggaaaagcaatgccatccatgagcgaattttttgaaatatgtagatatttgggaataacgccatacgaattttttaatgaaaatataaggtaccctgaaaaaatacataaaataatagaaggaataaataaacttaatgaaaaggatacagaactgataattaatcttatagaaagttataaagataataataaaagatattaacaaatccgcgactgcgcacctaacgaggcgcataaatgcgccctattcccaaatatctacatatttcaaaaaattcgctcatggatggcattgcttttcctgatgttatatgatttatatatccttgtgaacgtcccatgtctaaactcatacatctttctgatacattttttctcattctcaattctgttattctttctcttataaaatcttcaaacatttatatcctctcctttttctatttttgttttataaaaattataataacatgaattggtcataaagtgtttttctgagtatttataagtactacaaataatttctaggaggaaatatgagggaacttgatacatttggaagaattttaatacctaaagaaataagaaaggaattaaatataaatgaaggagataaacttcatataagttgtatagataacactgtaatattgaagaaagttgataaaaatatttgtgataaatgcggagagaaatcatatacaaagcagttaaatttgtgtcaggaatgtatggaaaaattattaatataagtttgttatatattgaacactgcgtgttcagatgatagctcacctaacgcgcttgctatcgcaagcctaccgaagttcactgacccccaatttttttgtgttaaattaaattgaaaaatcaacttttttagtgagttaaataaataagaattcggaatatctattttcacggtagttcacaaagtcaacgggaaagtaacagggctttttcttttgtgcgtggagcacaaaagaaattagcgggggcgagcgccccttggagccgtaggcgacctaagcgagcaagcactttttctttggtgaagcgtttctttttcgtgccggaaaaagaaatggttcaaacaccctattatgtaataataaaatttttatatggggtcatatacaaagtatataaacagttttttagttaagtaaattaataaaaatttatatggtgtcatatgtaagaaacctttatatttgaataatacaattatatattgaacactatgtgttcagatgatagctcacctaacgcggcggccgatgccgccctaccgatgttcgctgaaccccaacttttttggtgaattaaattaatgggaactcggaacagctttttagtgaatcaaaataatcaaataaaatttgtattgtaatttataatataattctcgtattttcaagataagtgtgttacaattaacctatctacataaagtgggtgttaacacaacatataaataaaatatgagaacggagaaagagcatatgatgcgtgacgcagaaaaaactataggtaaccttattgataagcagggagtttcatatattgcgtctatttcagaagacggttttccaaatataaaggcaatgctgccgccccgcaagcggagaggtatcaaggaattttattttactacgaatacttcttctatgagagcagcacaatatagaaaaaatccaaacgccagcatttatttttgtgataagcgctttttcagaggggttatgcttgtcggcagtatggaagttttagaagattctgagaataaagaaatgatttggagagaaggcgacactatgtattatcctttgggagtaactgacccggattattgcgtgcttaaatttgtggcaaccggcggacgttattattccaactttaaatcggaaacgtttgaaattaattgatttgtatatttaaaatctaaccggcgaaaattatagctgaaggaagctttgtgtttgtttaaacctatcggagaaatatttaaattataaacgaaaacagctgactgacaaaaagagttttatatattaaattcatatttaaggagtaaaataatggttaaggttagaaatgaaacagaaaaagattataaaatagtagaagaaatcaccagaaaggctttttataatttatatgttccgggctgtgctgaacattacctggttcatattatgcgcccgcacaaagattttctgcctgagctggactttgttattgaacttgacggacaggttatcggaaatattatgtatacaaaagccgaactagttgacgaaaatggagaaaaaaaggaaattctgactttcggcccggttagtatattgcctgaataccaaagaatgggatatggaaaaatactaatggaacattcgtttgaaagagcgtccgagcttggatacgatgttattgtaatattcggaaatccgggcaattatgtagcccgtggatttaaaagctgtaaaaaatataacgtctgccttgaagacgggacatttccatcagcaatgctggtgaaagaattgaagcccggcgctttggacggaagaaaatgggtttatcatgacagcgaggttatgcagcttgatgagaaggaagctcagctctttgacgacggactggaaaaaatggagaagaagtatcagccaagccaggaagaattttatattcacagccgttcttttataaagtagccttttatagaagttaagaaaagtaataatctaactaaatttattttattaaaaaataggtcactttatattttagaattaaattagtaatgcttttaatatttactttttatataaacctatgattatctattaaaactttacacgttttgctatataactgatttaatagtaataattatagtcagcaataatttttttctgtgtgaattggtttgtaacttattcagttattataggatgtgtttcatatttaaagaatacaatataaacaattcagctcaaagagacagaatatattgttcatataagcatgagcaatgacatgaaatatctgtttaatatatctccataaagatatgtaaaatgttgatagtgttgtgcatttgacataaaaagcatgattaaaatatgatgtcggtttattatatagataatatcaggttataaaaaataaggatgtatagctgcaagggaaatatattgtacaattgggagaataaatcatatgccggaattaataaaagataagtattataattacaattcgttaagcgaattagcttttcgtttaaaagacgtatatccctcgtttcaggctgataaatttgtcagcgatgtcatggacgacgattgggacgcgttagagcttaaggcccgtgtgcgccggatttctatcaatttgggggtatatctgccgtcggaatatgaacaagcaatcggcgttattgataatgttgttgcaagttatcctgacgggtataacgactattctttagtatatttccctgacttcgttgaagtctatgggcaggatgagcgccattgggatttgtcaatatctgcattagagaggtataccatatgctcaacttccgaattcgcagttaggccgtttattataaataacgaagaacgtatgatgcggcaaatggctctttgggcaaaacatgacaatgagcacgtacgaaggcttgccagcgaagggtgccggcctcagcttccatggggacaagcgctgaccagttttaaaaatgacccgtctccggttattggtattttggaacagctgaaagccgacccgtcgctgtacgtccgcaaaagtgtggccaacaacctgaatgatatatccaaaacacatcctgatttggttgtaaaaatcgcacgggattggtatggcaagaatgaatatactgattggattgttaagcatggttgcagaactctgcttaaaaaggggaacaaggatgtgctgagcgttttcgggtttgcggataccgattgtataattgtcgacggttttgaactgggtgctcaatctgtttcgattggggaaaatatgaccttttattttagaatcaaagcgaaaagcgcggttagggtgaggctggagtattgtattcactatataaaggcaaacggcaggagaaaccgcaagatattccaaatatccgagacgtcattagaggagaatcaagaaaagaaatataaaaagacccattcatttgcagatttaagcacaagaagacataatccgggaattcattcaattacgcttattgttaatggcgctgaagccggaacactggattttgacctgttgcctgctaaataactgacgtctttggagctggtgcggcggcttaaaattaaattttaaatgtttattttagatgattttataaataaaaaatagaagcggcatatcacttgaatggtatacctcttctattttttgttattgattaaattccccagctcataatccatagcgctatattaaagaagataataacggagcatgtgtctacaattgtggtaataagaggcgatgccataagagcagggtcaagcttgcacagcttggcgagtatggggagcactcctccaagcatcttagctattactactgttgctatcagacttaatcctgtgactgccgaaaggaacagcgggtcctgaccgctgtacataatataaattctcagagtgttgactgctgcaagaataagtccgacaactactgctattcttatttctttaaacattattttcataatatcttttggggttatttcgtcaagcgccaaaccgcgtattatcattgtggagctttgcgctccgcagtttcctccggtgtccataagcattggtatgaatgcgacaagtatcggaagcgctgtaaaagccgcctcataattttcaattatgcttccggttattgtggccgagagcattaggagaagcagccaaactattctgtttttggcgtgtctccaaacaggcgtcttaagatatgtttcctcaatcggctgcaaggcacccatcttttgaatatcctcagtgttctcttcctggataacgtcgatagcgtcatcgaatgttacaataccaaccagccggttttctttatcaacaaccggcagagacataaaatcgtacttgtcgaacatgttggcaacttcttctttatcgtcaagggtttcaacactgattatatttttctccatgatagtgttgataaccgtattatacggtgacagcaaaagctctttaaccgtgaccaaaccaataagtttgcggtcggtgtcagtaacgtagcatgtgtaaatcgtctctttgtctactcctgtgcggcgtattctgtcaaatgcttcagaaacagtcatgtcttttttcaggctgacatattctgtggtcattatactgccggcgctgtcttttggataccggagtatctcattaatgctgttacgcatttcagagtccgtatgtctgagtatacgctttaccacgtttgccggcatttcttcaatgatgtcaacagcgtcgtcgacaaaaagttcttcaacgacgtcgtgaagttcccgctcactgaatgcgtttatcagaagctcctgctcgtcgctgtccatttcaacaaaggtttcagccgccagctcttttgggagtattctaaataatatagggaggcgctgttcatcaatctcgccgagcagttcggcaatatcggcaggctccatagcagtaaacaagactcgtattcgtccaaattccctgctgtctaaaagctcgttcacattgtttctcatttcgtccaaattaatctgttctgccatatgaagcacctctctttccgggtctcaaaatctatcattccgtgcaggcaaagctgtctgtcattttgcaaaaaacaattataacataactcgccggtcagttcaaggtaaaatcaaccaaagatttacgcagaaatatgacttattattaatctgagtctttttttaaattattatacagttttgtgataacagaggcgtatagccgtttaaaaaagccattgtgactgtcctgcgctgagttatacggctgaagagatacaatgctctgccgattaattttttcagagatagcttcccggagtaaaacctcctgacagttaattttgctctgaacattaggtttcatatcataagtcccgtcgctttgcagaacacgggctttgaccgtgtcgctgagacatatgcggatatagtggtttattgcgtcttttatatcttgtgaatatatggggcagccaacctcaactcggttatccatatttcttgtcattatatccgctgacgcaataaacaatttttgttcctcaccttttccaaagctgtatatgcgtgagtgttcaaggaatctcccgacaatactataaactttaatgttttcggtaagccccggaatcccaggcagtatacagcagattccgcgcaccagcatagtgatatctaccccggccttactcgcctcctgaagtttgcagattatttccttatctgtcacagagttgacctttataaatatctgaccgtcttttccctttttcatctcattgtctatatagctaattatacggtctttcattgcgttgggagcaacccacaaatgcttatattcgccgtcaagattagagatggatatattattaaaaaagtttactgcgtcttcgccgatttcatggttttcggttataaatgaaaaatcggtatacagtttggctgttttttcgttgtagtttccggttcctatctgtgtgatatatttcatttctccgtttacatttttggttataagacaaacttttgaatgaattttatagtcgtctaatccatagatgatattacaaccggcctgttccagccgttctgaccaatcaatattgttttgctcgtcaaatctggcgcgaagctcaataatgactaagacttctttgccgttttccgcggcggtacataaatgttctataagtttggcgtttttagccaaacggtatatggttatttttatagacacaacctgagggtcagccgccgaccttttaatcaaatcaacaaacgggtccatgctctcgtatgggtatgacagaataatgtcgtcgttgcgttttccgctcataatattcgtatgggttatctgcggttcaaaatcaggatagcataagctgtcgttctgatcctgattaaatttgctctgaagcccaaaaacatagccgagagacaacggggattttgtggcgaatatttggttgtcagtaacgctgagttttgtacacagaagattttttgtgtattcatcaaactcattcagcgattccagccgaactactgccagacgttttctttttttcagaagctttttcatcttgcttctaaaatcctcatttatttcataagcctcatcgtttggatttatatccgcgtttctggtggcgcagaatatatttttatcactcacggtataccgctcaaaaatattttcaaagtacataaatataatgtcttctatatgtatgtacctgatttttttgcccggcatatagagtatgggcggaagcgcaggcggaattgtcacaattcccagcgaaactgatttttttctctgaacttttccgactacgcatatttgttttgaggcaataaaaggaaacgggtggtgttcatcaaccaactggggggaaagtattggctgaacataatttgtaaagtattcttttacaaatttcagttcgtcagccgtcagcgcttcaggggtgagatgaacaataccatagtttttaagattttgagaaacagaggaataaatagcgtccttttctaaatataacggccgaacggcggagtatatttttgtcagctgttcagtcggcgtcataccggttttgttgtcggttgcctttttgtcggcaatagaaaggtcgaacagacttcccacccttaccataaaaaactcgtcgagattactgacaaagatagaaacaaattttaacttctcatacagcgggacctcatcgctgacagcttcatgcaggactcgctcattaaacctaagccaagatatttctcggttttgcataaatttatattccggtttagcagagttttgactcataaattatcaccccagcctattaaaaatagtttgtcgtttaaacggattattatgtatatattatacagcgaaaaaggccagattgtaaagtaaaatgtatgtaaaatattactaaaaaagtactgattaaaaaataaaggctccggcgaaaaaccgccggaaccgcaaggcatgtatttgcttaattagcagccgcatccacagccgttgtcgcagccgcagccgctgttgtcattgccgcagcagcagcaaattaagataataagaataattatccaaagacatccgccgcctccgccaaatccgttaccgaagcatcccatctgtgtgcacctccttctgtcctcgctgtcagtgggtggtgtgcaatatgctttccgccgtgaaataaaagcatactgcacaccgccccacatgacagtcaaaattaaaatcagttatataagtacattaatgttctgtggtaagaaacaaagccgggaatttattagcagcatccgcagccattgttgtcgtttccgcagcagcagcaaattatgattatcaatatgataatccaaagacatccgccgtttcctccaaagcatccattcatttaataagcacctcctaaagtgttttcactgtatactatgacaaaattaagaattggtgaaaagtttttaaaaaagatttacataatttcaatattatgatattatttcatgtagtgaaaaggatttttgcatatatgctcttacagagccgaacattatgcgatggcgtaaaatatgaaagcggagggatcagttaatgaaaaccgatattgaaatcgctcaggagtctgttatgcagcctattgctgagattgctgaaaaacttggcatgtctgcagatgatattgagctttatggaaagtataaagcgaaactcagcgaggattatattgaaagtttagaggacaagcctgaaggaaaacttgttttggtgacagctataaaccctacgccggctggcgaaggtaaaacgactgttacggtggggctgggagaagcaatgcccaagattggtgaaaacgctgtcattgctctccgtgagccgtcaatgggtccggttatggggattaagggcggcgcagccgggggcggctatgcccaggttgttcctatggaagatataaacctgcattttaccggggatatgcatgcaataacagccgcaaataatttgctgtcggccgcaatagataatcatatccaccagggaaataagctgatgatagacctgagacagataacctggaaacgctgtcttgatatgaatgacagggctttgagggaagttattatagggcttggcggaaaaattaacggatttccgcgtcaggatggttttaatattactgttgcaagtgaaataatggcgatattatgccttgctaaaaatattgatgatttaagagaaagaattggaagaattgttataggctataatttgtcaggcgagccggtaactgcaaaacaattggaggtagaaggcgcaatgactcttctgctccatgacgctataaagccgaacctggtgcaaacccttgaaaataccccatgtctaatgcatggaggtccgtttgccaatatagcgcacggatgcaattctatcagagcaaccagagcgggacttaaactggcggattactgtataactgaagccggattcggaagcgatttgggcgctgagaagttttttgacattaaatgtcgttttgccggattgaatcctgactgtgtggtgcttgtagctactgttaaggcgcttaaatacaacagcggtcagataaagggagaagcgctgaagtatgagaatctggaagccttgagcttaggtataaacaaccttggtaagcacatagaaaatatgcgtaagtatggggttcctgtagtggttgctattaacagatttgatactgatactgacgcggagcttgattttatagaaaattactgcgctgagaaaaatgtgaaatgttcaatgtgtgaagtgtttgcaaaaggcggagacggaggagtggatctcgcaaagaaagtcgttgagactataaagtctgagccttctgagtttaagccgatttataacgttaatctgcctataaaggaaaagattgagacaatagcacgggagatatacggagcggatggagtaacttataccgccaccgctaacaggcagatattgaatctgacaaatttggggtttgataaaatgccggtgtgtatggcgaagactcagtattcgctgtctgatgacccgtcacttttggggcgtccttccgggtttgatataacaatcagagaagtaaacgtatcgagcggagccggatttatagttgcgctgaccggagcggtaatgaccatgccggggctgccgaaagttccggctgcaaataatatggatattgacagaaacggaacaattgtaggattgttttaagcaataatatataggagttgaaatcagttgtttacatcaaaggatatatatgacgttatcgttgtgggcggaggccacgctgggattgaggccgggtttgcctcggcgcgtctcggaatgaaaacatgtattttctccataagtctagacgctgttgcgaatctgccgtgtaacccaagtattggggggacggcaaaggggcaccttgtcagggagatagacgccctgggcggtgagatggggaaagtcgctgacaaaacctttatacagtccagaatgctgaataagggtaaaggtcctgcggtgcattctctgagggctcaggtggacagacggaattatcagatggagatgaagcaccgcattgagcttgagccaaatctagatttgagacaaggcgaaatagttgaggtaaagacagacgataataataacgtgaaatctgttgtcacaagaaccggcgcagagtttttgtgcaaggccgcgattgtatcaaccggaacctatttaaaatcaagaatagtaataggcgagttttctcaggagagcggaccggatggagtgtttccggcaaccgagctttcaaaaaatctgcagaatatcggagttgagctaagacgttttaagaccggtacgccgcctagaataaataggcggagcatagattttgatgagcttgaagaacagattggcgatgatgtgataattcccttttcatttgagacgaatggagagggattggtcaataaagtttcttgttatattacctataccaataaagagacgcacaggataataaatgataatcttcacagatcaccgttatacggtggcggtggaatcgttggaataggaccgaggtactgcccgtcgattgaggataaggtggtgaggttcagtgacaaaaacagacaccaattatttgttgagcctatggggctggatacagaggaaatgtatttgcagggattttccagcagtatgccggaggatgtgcagatagatatgcttcattccctgccgggctttcataacgctcaggtcatgagaaacgcatatgctatagagtatgattgtgccgacccgcttcagctttacccaacgctggagtttaaaaaaataggcgggctttatggcgcaggacagtttaacggcacatcagggtatgaggaagctgccgcccagggcttgattgcaggaataaatgcggctctaaaaattaagggaaaggagccttttgttctggaccgctcagaggcttatattggaacgctcattgacgatttggttacaaagggaaccaacgagccgtatagaatgatgacctcaaggagcgaataccgtctgcttctaagacaggataatgctgatttgcgtttaaccccttacggttatgagctgggcttgatttcatcggagagatactcaaagtttttgaccaaaaggcgtatgatagaagaggagacggcaaggcttcaaaatttgatattcccgccgtcaaaagaggtcttaaattatttggaatctgtcggaagcactccgatttcaacaggggctcgtgcggcggaactgcttaaacgtcctaatataacgtatgagggtatgaaggagatagacaggggcagacctgatataccggacgacgttgccgaacaggttgaaataagtataaaatatgagggatatataaacaggcagattaaacaggcagaacagtttagaaaacttgagtctaaaaagctgccggaggatattgattacagcaaaatagacggtctgagaatagaagccagacaaaagctcgagaagataaaaccgtcatccttaggacaggcttccagaatatcgggagtaaatccggcagatattgccgttttaatggtttatttgaaaaaatagtaaaattgaaatagaaaaataatataaaatttataaaatgtttaaaatgcggacatagtataaaaatatttttgttttataatgtgtaaagtaatttgttttaaaatatagaataaaaggagaattgttatgaagaagatattatgtgcagctgtcgctgcagttttagcagtcggagcattaactgcctgcggaaataagccgagcgagccgtcgggtgctgacgccggtaaaaattcacagcagaatgtgactactgcagaaccggcttcgtcaccgtttgtgccggaggaggttccaagccagtttaaggcgaacggcagtaatattaccgaaaaggaaggcggaggcgtttctgtgtctgttgctccgagagaaggagacgagagatataagtttgaaaatgacgatttaggatttgttgacactgagagcggagctttgctgaaaatcggcatgtcatccgaggatgtggaaaaactcataggcgctccaagaacagttgaccgtgacggttttagaaaatacagcggaatcgttataaaatatgatgataacggaaacgcttcacaaatgattgttgcagccggcaatatggaaggcgatgataatccaaatagatttgtttcaccaagaggggttaagctttcaacaacacttgatgagtttaaatcagtatatggtgatgagtacaacgaaccaagccaagcagcggaaggcgatgaatctataaaatcgtctgctatgatggctgttagatattatgcaaagaacggtgatacttttaactatttgggcggaaactatactaaagaaaataagcctgaaaatgacgctgacttgataatgcagactttcttattctcaactgagacaaaaacagtcagcgttatgtcggtaggaaacggaacagcaaactaaaaaacagccggcttgttatttgtttcaagccggcctgttttttggccgaattttttgataagaagtttttttcgtatagtgtgcgacgtatttcgacaaaataatcgaaattattcacaaatagttaattttttctttacagattattcacttaccaatgcaaaaaggtggtataatatgtattgtaacaagaaattgttacagagttaaaacataactccctcccttttaatttgtaagaccgttcccccaaacggtcttatttttttgtttataattaaaaatatgatgcaaagtttagatattattaacggaaagaaagcgattcactgcaagagagtgattcacattctttaaagacgttatttttttgagtgctgcactcttgcaaaaacaatggttggcgacataatactttctgaattcataaaaatcacctcgtataattgcagtgtcattttgctcttgaataagagctgaattacttagactttgcggattggtttaaatttcctctccgcgatatggttttattggagagcctttttgcgtttttatacgggaaactatagttttcagaaaataatttgttccgcaaagagggcggcaaaattattgagaaatatcagacattctttttttgcataaaaagtttaattccttaatgttgattttatgatgtttaccaacccttttataataaaatatttgctgtaagtttcttttattattgacgtccatatatagtatcttatttaaatacactaatttaataattaatacaaggcttgaatttttcatgtttttgtggtaaggtaatgacataaaatgatataaatttttaaatattttacataaagctgtaaagcagaaaatgtatttgatttgaatatacgtattaatgatgtattgatttctccatatggtatagttcggttaatatatttcttctgaagttcactaaaaaaacactgtatatagaaaataactataaaaaaataaattataaaagatgtggttttgcaagcatcggagggcagatgaaatctgccacgtaaggcgcgcagtcacggaaaaatttaataattatattacaatgaactattctaagtatgttcacgctacgcgtgagatggcagctcacctaacgaggtgtgcataagcacacaatacatcacaactacgtaatttattgacattgaaggctataataaaacaaattactttgtatcacacccaccatactggtggggtcacacctaccgaagttcactaaaaaacaccgtgtatagaaaaataactataagataatagattataaaaaagattggtttagcaagcatcggagggcagatgaaatctgccacgtaaggcgcgcagccgcgggaaaatttaataatattattacaatgaactattctaagtatgttcacgctacgcgtaagaaggcagctcacctaacgaggtgtgcctacgcacacccttccgaagttcactaaaaacactgtgtatagaaaaataactataaaataataaaatataaaaacgagtggtatagcaagcatcggcaggtgtgattgtgaccacacctgccgatgttcactaacaaacatccttaatttttctgtatagctttctgtagaccttccggttatactaaaataagtaattaaatatcacccactttacaggtggggtcacaatttgagtgttcaaaactgatacatataactaaatcatattttatctgttttgagatatagtccgtaccggtaaaatttaagtttcatatattatgttgatttaagaaaggatgaaataaaatggctgataaaaagattaaaggcgtactttttgatatggacggcactatgtttgacacagaaacaatgtcaatttatatttgggcggcaactgctagatattacaatataaatatttccagagagtttatgatggaatgtatgggtctcagcacgaaggctataggagaaaaatttgataaggcgttcggagatgttctgaattatgagacatttcgcagcgctaaaaataaagttatggaagagattgtggaagaggacggagtgccacacaaaaagggtctgacggaaatccttgattatattaaggaaaacgggattaaagccgctattgctacttctacatctaacgagagagccgtgtataatcttgaggagggaaaagttatacagtattttgacgaagtcataagcggagatatggtggacaagagcaaaccggaacccgatatttatttgcttgccgccaagaaactcggtctaagacctgaggagtgtatggttttagaggattcaaaaaacggcataatctctgccaggagagcaaattgtttggcggtgcttgttccggatataataccggtcgatgatgaaatgattgaagccgccgattatgtctgcgaggatctattagaagttattgatttgattaagagaataaataaataataaataccagggcttaaaaaatatagttcaattgttatgtagaatgaaaatatttaaaaaccattgtaaaaggcttgttctgacgtgaacctaaaaatcggacttttttgggtttgttcattatagtcaaaacacaatggttttttgcttatttttaataataactcttttataacacattttatctaaaaaaataagaccgtttgggggaacggtcttacaaattaaaagggagggagttatgttttaactctgtaacaattccttgttacaatacatattataccaccttttcttgtttatgggtgaataatctgtaaaaatcaaattaacagtttgtgaacataaaaaaggcgttatttaacatattatagtaattttatattcattattaaacgtttgaaacgtgacgataataatagtttaattttgatgaaatttattaaaaaaataattggttgatttatgtaatgtattaagtcatataactttcttccgaaataataagttgttatgtaatataagtgtaaagtcgacagaaaactatacagaaaaattaaggatgttttttagtgaacatcggcagggtgtgaccccaccttcaggtggggtcacagacattgtaggtttatcaatacaaagtaatttgtattacacacacttttaaaaaaagtgtggtcacagccctgccgatgcttgctaaaccacagttttatataatttatttgttatagaattattttttatacttgaaccttaacatttgtggccgcttgattgtaaactttttatatttttgaaaaatatataacaagttatcggaaatatatttattctaaaaaaattttggaaatacttcaggaataaaattttaaaaactagaagtcagacggaaataaaatatcttttaaacaagtcgtacttaaatgcgtttgccggaaaaacaaaaagtccttagtttaagcgttagcttaattctaagaactttttttatttatattatttaaagttgtttgctgttaaacaatatagaagattatgataaaactgcgccggtgcttccggaacttacgagttttgaatatcttgcaagataaccggttttaatattcggctcttttggtttccagtttttgcgtctttcctcgagttcttcatcagaaacttcaagcttaatcttatagttcggaatgtcaatggttataatatcgccttcctcaaccaacgcaattgtgcctccatcggcagcttccggagaaacatgcccaatagctgcgcctctggttgcgccggagaatcttccgtctgttataagagccacgctgttgccgagaccgcttccaacaattgcagcagtggggtagagcatttctctcattccgggtccgcccttaggaccttcgtatctgataacgattacgtcaccgggatttattttgttatcataaatagcgtttactgcgtcttcctcacagtcaaagactcttgcttttcctgaatgtttcatcatctcatcacatacagccgagcgttttactacgcatccgtcctcggctatattgcctttgagaaccgccagtccgcctgttttgctgtatggattatcttttgagcgtattacttcgttgtctgtgatttcacatccgcttatgttttcaccgacagttttgccggttaccgtaatgggagatttatcaataagacccattttgtcaagttcattcataaccgcatatacgccgccggccttgttaaggtcgagcataaaatggtttcctgccggagccaaatggcaaaggttaggagtcttttctgaaacaacgtttatggtgtcaaacggcaggtctattccgcattcgtgagcaatggccgggagatgcaaggcgctgttggtgctgcatcccaaagccatatcgacggtaagcgcgttaataaacgcttcctttgtcatgatatctcttggttttatatcatctttaacgagttccatgatttgcataccgactttttttgcgaggcggagacgctcagaaaataccgccggtatagaaccgtttcctttaagacccattccaagcacctctgtcagacagttcatactgtttgcagtgaacattcctgaacatgaaccgcaggtaggacagcagttttcctcacagactttaagttcgttttcatttatttcgcctactttaaaacggcttatagcttcaatcatggtcgaatagcttgcagactcgccgttccagtctgaacctgaaagcataggtccgccgctgacaaaaattgaaggaacattaagtctggctgcagccatcaataatccgggcacgttcttgtcacagttgggaaccataaccaggccgtcaaaaggatgagctgttgccatggcttctgtagaatcggcaattaattcacgtgttacaagtgagtatttcattccctcatggcccattgctatgccgtcgcatactgcaatagccgggaatactataggaactccgcctgctaaagcaacgccctgcttcactgcgtcaacaaccttatctatattcgtgtgtcccggaactatatcgttcttcgagcttactatgccgataagcggcttgtttatctcttcctcggtcagtcccagtgcatagagcagagaacgctgaggcgctgcgttaacgcctttttttatcctgtcacttctcattttatttcaccctcctgtatgtatttgtatattaatcttctgaccttaaattatatcttagattaaagtttatgtcaacctgaaaatatcacaaaccgacctttttattgtaggattacaatagatgtgttacaaagagaaaaaaagaatacggaaaactcataaattgtgttatagttatatcaccataatatcacataattagcttcaccgacaatgcaagcttcaggaacaaacttaacgtctatctgtactctctgaccgggatagagcatttgctcgtaaggctttggtacgtatttgggattgggtggtttaacaggcatttgtccctgtttgcggagtatgcggtaaagacctgtaatagaacgagtatagcctctttgacgaaaaaggttcattggcagcgaagtatctttaggactgctgtcaaccattatttcaaaagtatcatccatatctaacgcatataaaccaatagattttaaaggttctgctttgcaaaatcatcaaacgagtagaatttatgtgttgcataaaaatactcgttatccttacggtgtgaacgctctaccttgccgttatgtctaggtgtgtacggtcttatgagcttatgttgtattccaagttctttaagtcgcttttcaaacatagttagggtcggcttttgggagctgccaagcctcttggtaaactcttgtccgttatcggtctgaacgcactcaatagggaatttaaaggcttttacaaggtgttcgaggaataccgcagaagaatagctgctgtgctcctcaaaagcttctaaagtctgtccaatatgtcatatgtatatgaccctgtcagtattgtatttgttcctgctttttgtgtataatttttcctgtttccgtttacgtcataactatattccgcaaacagggacaaatgcctgttaaaccacccaatcccaaatacataccaaagccttacgagcaaatgctctatcccggtcagagagtacagatagacgttaagtttgttcctgaagcttgcattgtcggtagtaacggaagttagccaagaaatcctaaggtcgatgattgaggaaactcaatttcaaaagactttttcactatttgtttttcaaccatctgagaggataggttgagataagaaacttctaatctaagctgaggttttcaataagaaaataaagcaagtacggatggtttcaatgcgggctgatagctcagcaggttagagcacacgcctgataagcgtgaggtcggtggttcgagtccacttcagcccaccacttttattgctacaaagtggttttaaatttaatatcccatgggggtgtagctcagctgggagagcacctgccttgcaagcagggggtcaggagttcgattctcctcatctccaccaggaacttatagttccaaatttcaaccatctgagaggataggttgagaagatgtttgaaaattgaataaagagaagagtaaggagtaatgattagaaataattatgaaagatactttgacgtagtatatgacatccctttcggaatgttgtccccctcctaaaggcaggttactcacgcgttactcacccgtccgccgctttccatccttatcttctccccgaaggaatccgttaaaaatttctcgctcgacttgcatgtgttaggcacgccgccagcgttcgtcctgagccaggatcaaactctcgattaatattgttatatatccagactctcgtctgccaatatactcgattgtttgttagctcttatcgaatactaacgtttgcagatctctctgcttgtaaagttcgctaaaactttttttggaattgacaaagtctccactcttgcgagtttcttaccttgtgcaattgtcgtaataagtacatctaaatgtatctttattaccgctttttccttttttactctcacagtattctatctttcagcttttcttgcctcagccgaaagctttattatcttatcatattcttacccttcttgtcaatatattttttcactttacttttcacaaattctttacccattatttacttctgctttggttattttgtttgtatatagttttctatttataatgtcccgctaatattactttaaaaaataggatatgcaattttggttgcatatcctattttgtttgcttaaaaacttaaactatcttttatcacatcatcgtagttctccgaataaccaattctccaaccgctgtcgctgaggtctctgagaaactccagtcatcaatgtatcaaatccaatttatgtaacgctaataatttagacaattaatattcaagtcatttaatatgcccggcttaaatacttttttatggtcaatgttatttattgttataacatccgactgacaaatacttagcactattacttaaatatgcagttataactcttaaactattaatttattattttaatcctctaaacccgattcagcattctcagcgctttcttcattgccggtgtcactttttgcgtcgtcgcctgttttggcatcgtcaatgttatcttctacaggctcctccgcctttttcgtgtcttcttctctgctgtctgcaggttgagttttcttctcttccccgctatcagtctttttttcggtgtcagttctttgagtagatttttcctgagtagtatctttcggttttgagtctgaaccggattgtgtgtttttatcggtgttttccttgtcatttccggccgatgacttatcaccgctcgattttgtatctgaggcagctccattactgcttttcggttttacagttgcagcgggtgccgacgctggaatatcagccgaattactccttgttttaaaccaatttgaagcgtttgctgaaactatgtatatcaataaccctataataaaccctattattgcaagaccggcaacttttattataaactttcccggatgtctttttgcagaaggcttcttaactcttttaccttcataattattatcagcataaaactgctgatcctgtctgcgcgtattctttttcgttttctgatccgggttatatctataatattgctttttgacaggctgagaatgtctcctgtttcggtccccttgatattcattgccggaaattcctgtctcctctgccgcccggctgttttcaaagccgctccccctgccgtcaattttgggaatggctacagtcatatcagcattattctctaaatttgtattgacaggtcttctgtttgttctacctgcactttgtaccggtttatatgtctcagtttcagacgtttcaatatttttaacgttattatcatgcttcacatcataattattgtttaccgccggcctcaccaaagagctgccgcaatacttgcatatcttatcattgtcgcctacttgctttccgcaaaattgacaaatcatataaatacctctttctttttatgtttattaaattataacacaatattcgacctagtcaatacatgctttacataagatagcataataaaacacaaatattttgatatattttattgttctgcaatcacttatatgttataatttaaagaaaaaaatgactggagagatacttatggcacacaaaaattttaaagattttaaagaggcggtaactgaacattataataatatagaatttcctgccggggctattggagaattgtctgaaacaattgtaaatatgtcagccaaaatcactctggaagttctgcagcaatatcataaagaatttatagaaaaaagtaattaatttagaacaaaaaagtcagtccggtataaaacgggctgactttttataatttattatcttatgtctttcatatcaacatcatccatatcatcgaaggtttgattttctcctaccataccccaaatgaacgtataatttttggttccaacgcctgaatgtattgaccagcttggtgaaataacagcttcctcatttctcataacgagatgtcttgtttcctgaggttcgcccatcatatggaatacaacatcatcttctcccaattcaaaatacagatacacttccattcttctctcatgagtatggcacggcatagtattccagttgctccctacctcaagcgaggtcattcccattaccagctggcagctctgacaaacttcaggatgaatatattggtttataactctcttattacatccttcaacgcttcccaagggacgtttatttgccatttccattgtaatcttcaatgttgggtatgtatggtgagccggagccgagttcaaataaaactttgccggattcgcagggtcgtcactcttaaatgatacttctttaattcccattcctgcatataaaccatccttataggacaaatcatattcttcgccgtctagaataactgttcccgggcctccgatgttgataactccaagctctcttctctcaagaaagtaatccacgcccagctcgtgtcctgcttccaaagtcagaaccttttctgacggacatactccgccgacaattattctgtcaacatggctgtaaaccagcttcactttatcaggaataaacaagtcctgaatcaaaaaatcatttctcattctgtcagtagtgtaatgttttgcatcatcaggatgccacgggtttctaatttcaatatccatttctattcctccatttataaaaatacgccgctttctcagcgtctctttagtttcattccaattttatcatagtttcatttgatatgcaaggaataaaatgaatattttacgacagttaacattctatattatttgggaattttaatggtatattctatatattcctcactctcacgccgcttggttaccgcgtttacaccgctctgtttcataagatcaacagcttttcttatagtgttagaaaaaattcttatatctctgaaagtttgaggaaggtgccccggctttttctcttcttcattattattttcctgagacttttttagtattttttctactaaagcttctgtttttgccacattaagaccttttttagttatttcattcaaagccgacatctgctgctcctcattctcaagctttaacagcgcgcgggcatgacgttcagttaatccatattcacacaatacggctctgacttttatcggcagttttaaaatacggattttgtttgccactgtcgactgattcttcccgagcttagaggcgagctcgtcctgggtcattccatgctctgaaatcagagttaaatatgcttccgcctcctcaatataatttaggttctcacgctgtatattctcaaccagtgccaaaattgcgctgtcagtctcatcaaccctcataactattgcctgtatgtaatccattcccaaaagcttgcacgcttcaagcctgcgctgccccgcaaccagttcatactcaaacggtataacctgtcttacagttatcggctgcattaaaccataattttctattgacgcggccagctcgtttaatgagttttcatcaatttccaaccgcggctgattggggtttggttttatgctgtttattggtatggattgcgagtttccatgtgtccttatcctcttattctgagttacgtccgtcaaattaatctccatatttactctatcaatttcatgcacttcgttttcctgagaggcttctgtttcgacgcctcgttttaaatagtctaataacatttttgtcatcctttcttttgtaacatttgctatattcggctataaaaattatatcgtaatatataccttaatgcaaaaagtttaatgacaaaaatttcgacatttaattcattcttcagtctctctcaattataattaagtcgtcgccaatttttgttatcttatcccatggaatagtaacgtcgtcttctctgcccaaaacacccagaaacctgtatgagcccggaaccagaagagactttatctgaccgctgttttcatcaaattccatatcagacacaaaacccagtctttcaccatccattgcacaaattacttctttagaacgcatatcgctgaatttcattccatcaccgcctataataaaaaatcactccataatatatatgaagtgatttcaaattctatgtgataaaattattctgaatcttcttttgtctcttctgcctcttgttcaggctcagtctgatgctcaaaaccaaaaagcttttttaagcggttcatagcttcaactgtattatctttatccccaaacgctgtcaaacggaaatacccctctccattttctccaaaacctgcgccgggagttcccacaacgtttatattctccagcagataatcaaagaattcccatgacttcattccgttaggacacttcagccaaatatacggagaattcacaccgccaaaatactttatacctatctcatccatagtatcagctataacttttgcgttcgcacggtaataatttatattttccattatctgcttctgaccttcttcagtgaaaacggcctccgcacctctttgaacaatgtatggaacgccgttgaacttagtggtctgacgtcttacccacagcttgttaatctcaacaacatcactgtcaatctttaagagcttcagcttatttaccttaacctttaaatccttcggaactatagtatatccgcacctggttccggtaaatccggctgtctttgaaagtgaacagaactctattgcacatctttttgctccgtcaatttcatatatgcttcttggcagattttcatcctgaacaaaaatctcatacgcagcgtcatataaaataaccgcgtcgttttcaagagcatagtccacccacgttttaagctgctctttggtataacaagcccctgtaggattattgggcgagcacaaataaataatatccgcctttgtatttccctccggcagaggacaaaaaccattgtctgcattagcgtttaaaaattcaatttttctgccattcataatgttggtatcaacatatacgggatagaccggatcaggaatcaaaacaacattatccttatcaaataaatcagttatattaccgacatcacttttagcgccgtcgcttacaaagacctcatcaagttcaaggcgaattgtatttttcttataatagtccacaatcttttctctcagaaagtcatatccctgttccggtccgtatcctctgaatgtttcctgtgcgcccatctcatccacagctttatgaagcgcctcgataactgcaggaaccaaaggtaaggtaacgtcacctataccaagccttattatttttttatccgggttttgggctgaataatcattaacctttttagctatctctgaaaatagataactttctttaacgtttaaaaaattctcatttaatctcaatttcaacactcctttattattaattaatttctatctggctattggcggaacctcaacttctccttcacagataaatgtagccggtcccttttttattaccgtgccgtcctgcaaataagttatttttaaatttccgcctctaagcttaaccgttatttctctgtcgtgcttacagtatccgtttaaaacagctgccacaacagcagcacaagcacctgttccgcaagcccatgtttctccgcttccgcgttcccaaactctcatttgcaaagtatcctcgtcaataacctttataaattcggtattgatacgctccggaaacaattcatgattttcaaatagtggaccgactttttcaagttccaaactatcaatatcatccataaatattacagcatgggggtttcccatagacaccgccgtaatctcatattctttatccataacgctaatcggataacctataactctatcgccgtctatactgacagggatcttttgaggttcaagttccgccttgcccataccaactgtaacagataccacttcgccatctattacatcaagctctaaatctttaattcctgaattagtttcaagcgttatatcagtttttttggttaaaccattatcgtatacgtattttcctacgcatcttgtagcgtttccgcacatttcagcttccgacccgtcagcgttaaaaatacgcattttaaaatcagcggtttccgacggcataatcaatactaggccgtcgcttccgattccaaagtgcggatccgaaacaaactcagacatttttgacggattaaaaacttcctcttcaaagcagttgatgtaaatataactattacctatgccatgcatttttgtaaatttgatcattaatatccctccatataaactgcttacacatggtatattctaccacaaaacgctaataattacaagcaatagtaaaaataattttaaaaatataaaaattgtttacacaaagttcattgaatttcgtcttttattatgttagagtaaaactgtaataattttacgaggtgaagaatatggaaagttttcgaaactttatgcaggaaagatacggatttgacaaactagggctgtttattataattgcgtccattgtattatctatgttatcaaggctgttttggcttcccctcttgaattggatggctataattcttgatatagtatttatatacagatttttatctaaaaaggaatttgccagacagcgtgaaaacagaatatttcttgaaaagtttgaacaagccaaagaatttattcatagagacagaaagaactataattactacaggtgccccgtatgcaaaacaaaatttgtaactcccaaaaaccaaacctttggttacacttcaaaggttatttgcccaaaatgcaaaaatgaattttagcgcttgtaataaataaaaatagttttcataaatatagttacgtaactctttgattaatctatcccgctctttttcattttatacccctaaaaaacgccggcactcatatgtgccggcgctttcttattaattaacagcttcttttaaagctcttgctaactgggcaggacatgatgtacctctgccattgcagtcgatatcctttaaaatttcaataacctttgacgcttccattccttcaaccagcagtgatatgccctgcaaattaccattgcatccgccgacaaatgatacattactaactttaccatctactaaatcaaactttatttgacgtgaacacgtccctctggttttatatgtatactccatataatcacctccaaatatgcaattaacgaacactctgccttgaggccttgctggttccggcgtacttgccgcatttatctccccatacagccaaaacttcattgtctgatgagattacccttatgacctcacacatattagagcagccgttacactcaaaactcgttggtttaaactcaagttccagctgttcaaatccacggaacataggtgtggttatattattttcttcaatatattcttttgcaagaatagcacagcctatggctcccataacatcataatattttggtattataaccttttcgcctacctcgtcctcaaatgcctttctgattccaacattagcagcgacgccgccctggaaaataaacggtggctttaatgtctttgcgcggcccaaattgttaatataatttctcacaagcgctgtacataagccttttattatctcagcctttgagaatccatattgctgtttcgctatcatatcagactcggcaaacactgtacaccggcctgctattcttacatccttttcagcggttaatgcaagctcgccaaattgttcaataggaactccaagtctttccgcctgatgatccaaaaacgaacccgtaccggcagcgcacactgtattcatagcaaaatcagtaaccataccgtcttggaggattattatttttgagtcctgtcctccaatctcaaaaatggtttgagcgtccgggtgaaaatggagggttgccgtagcatgcgctgttatctcattttttataacatcggctccgacgagaacacctgcaagttctcttccgctgcccgtggttcctatacctagtatatcgtcatcctgacagcctatagcctctttcagttttgtcatgccttttttgacgctctccagcggctgaccgtttgccctaatatattggttaaaacaaacattataattattatccatagcgataacgtttgtactaaccgacccaatatcaatacccaaataatatttcatatataactcctataattattttgtttgatactcaggcgaagtcggtgaagtctttaaattgtccttaacctctcctacctttgtacctactcttcttgccgctgattgtgcagcgttctcaagagagtcagccacattattcaatgtgtttttctgttttgcgaaatgtttatttcttattaaatcagtaaacgcttccagtcttgtctttacatgagcctctcccatctgctcatccaaagataatgacataataggaatattaagctcctctgatacagcaggaaatttacctaagtttacaagttccggcagacatgcaaaaggcataagatgtaccacaccgtcaaaaccgcgttttgcaaaatccattacccaacccatattttctttatcatggccgccgcagtttataggcgccagcttatctgatgatttaaatattcgatgtgatttaggaaacggcagccacttcggaatcaaattatgttctacccaatcagatatgtactgaacgttttcaacttcaacgcccatagagtttaaaatttcctcaacgttcttattcacagtgggttccataataacatatatctctcccactatgccaactctaatccgtttgctttcctcaacctgacgcatcggtatgctgtcaaacattctgagcgcttttttatacgtcttattaatttcagaatatgtatcgcatttatcaaacatgttttttatttttttccatgttcttgaaaaatcgccttgattaatctcataagctctcattattttcattttcttttcaagcttatccattttcttaatgagattgtaacaaaatcttgctatacccaaaagtttgaagttgctggttccatttttgaccagcatagcgatttcataaaatgccttaaaatcattaaacatattatcaaaaacaattacttttgtatcaaatcccagctcctgcaaaactttctgatgaacatccgggtacatcccggcacggcacggaccgttgccgcctgatgaaactatcaattcggcgcccctttcagcgcactctatatatgttcccatcattaccttaaaaggaaaacagataaactcaggactatacttaacgccgagttccattgtcttttgagatggaggatcaggcattacaacttcatgacccagcttttccatcagctttttatatcctgttacacaacccatatgcggaaaagatactttcatttaatcacctcattaaccttccgaattttcctcttaatcatatctgtgaacgcttctatacgcgtctgcagatgactttcgcctgtatgttcatcaattctcagagtcataaacggaactccggaatctgcaaaatcatgctctatttcttttcccaccactgagtcaggaccacagccaaacgctgttatatgtattattccttgaacgtctaaatcctttatcataacgcttgccgcctgatataacttatccggaaatgtccaaaatataggtctggtgcactcgtctctatatttgtgaaggtctcttaaatccagcatatcaaaagttataacattaactttaagctcacgcagtttctgaattatattcatgcttatgaatggatcatatacattataaacatatccgagcaatcctatcgtagtatcaaactcaggcaatgcgaaatcagaaattttggcgccctcaaacattacctcggcggcttcatcgagcgttaaacccatattgcagtattctctgaaccgcttaaaatcctctgctgcgccctccaaagcgattcgcattttgtgagccgaaacgccaagctttttagccaccggaagatagcacttcaaagccgccgtatcctcacggtcacaatcaatttcagcaataagaagctttgcctcgggaacagtcttttcaaccaactcaggcagcccaatatacttaggacaaaaccaataattcttctctatatgcacaaatctcggacaaaatatgtagtcaacgcctttttctatcaagttaataacatgaccattatatatttttataggaaaacaaatttcagggactgtcaccgctatgcctttttgaaccagcggctttgttgaagtatcagaaataacaacctcgcatccaagcctctcaaataatgaccgccaaaacgggtaatagtactgatataataaggctcttgtaataccgattttcatataacttcctccaaattctaaaacaaaatattcagcacgtttacctccacggcctcataattataaccctaattacagccattttactccttttttcgggctttgtcaatagctttcagtctaatagattgccgaaataatcacataaaaataacatcttttttatacattttatgccggttttattttgcacattcagagtttgcatcatcaattattgtaaatactgcacttatgaaacacatttagttttttgtatatatatttataattatataaattttttattttcatatgtctatataatttatttgataagtttataaaaggcggcgggctttaagccctgccgcctttttatgagacactctatattactgaataaccagcatgtcaatcgcttggtcaatatatttagttctgataaatacctgattgcccggctcaatatcaaatggttcacctatagtaatctcatctttacttgtatcatagatataaagattcacatctgttgtaggatatgctctatagaatctgccatctgcaacattagcactttcaaccataaagtaatcaaatacttttcttacttcaccaaatacagtcataagtttgtcgttcgttatcttgtaattattgacaccaagtctgtcacgctgcgaagtacttgattcaaagtaaccgccgccgcttgttctgtaagtgtagttaaacaatactctgtatgtgtacaaatatccatttgaacccaaattgtactggataacatcacctctaactaaatccttgatatcttttttgtcgtttgccatagtccctgttggtgtaataggatcaacctgacttacatcatcatcaacctttaatgaaatatactcgccttttgaccagccgtttacttcaagaactttctcctgcttttcctcatcccaagctgttgcgaacttgtcaacaaccaatgtatcagcagtttggtctaaggttgtaggctctttatcctgaataaccattacattggctactcccctgttcaggtcatatatatctgccgtataagaaccatctgctagatcctgctttgttaatacagtataatcttcatcacggtcacgatctacaaaaggaacatcaaatatgattgtagaatcttctattgcacagttaccgataagacttctggaatatcttccttcaccgctgaaatatttaccaaagcctaaatcatcatctgcatcataattttctgtgaaatctacagccttgtataatgtcttcaacttgccttcagagttaatttcataaacaactaactgagcgtcagcaaatgctccggaattaataataaaggaagcagatctctgctgagcttcatctgttctgcctgagttatcatccttttccatcacattggtattaacctttgatgcagatacatactcatttatttttcctgtcttatcaagaatcttaaccctaaaattactttcaaaaacatcatcgccggcagcaaacttaattaaataaccgtagttaccattgtttgatgttgaagtattagtacctaagagtctgccatcataagtgatttggaaatcacttgtaaagcctgatgttatatcctttacacaataagcggatactatatactcattacctgcaagtgtaacaaccttatactctccggctgtatactgctcagttcttgttgtactgattgttccggaaacaacatttcttgatacataacctctaatatactgtccatctttacttacgcaataagttatagcatcatttttcaataattcttcaggtgtgattgttttgccatcaagagttagtcttgtatgataagaagtatcaaattttaactcaggaagtgtaactgtcatactgttttggaatataacctgatatgttgacttattatatctgtcaaacaatccgtcaaattgttcctgaatcattacagcgctggctttcgtactgctttcatgagtaacaacctttacatgaccctcttttattactgttgatacatcgctaagctcataataaggcttgccattataagaaatcagtgttgaaccatcaaacgtaagagtcttttctttatcatttgaatcagtgtaaacaatcttatcagctgttaaagaaacgatatcttttgccattatatcatattctttattcttatcttttcttggctcgcagtaagcaatataatctcttctataacctgaaacatcttccatgtaataataatttacttcatatccaagaagagattccatgtcataattatctgagaactgatagcaagtgccatcaattattacttcattttccaggtcaacttcactgcctgtcaaatatgagaagtaagttccttcaacataacctgtttcatttttaatcttatatgtttcagtaagcaaagtttttgaatcgcttactctaacatctgctgtaccgtctgctctgtaaactacagtttccatcaaatatgcttccatagcgtttctaaccatctttgccatctgcatagctgtcattgaatcagtatagctcaagctcagaccattataaatgccctgtctcaaagcaaacgttgtgtaaccgttaggaaatccgccgtttgtaatttcacaagcgtcctgatagccaagtgcacacataatcatctttgaagcttcgtttacaagaatagggtcgtttggtctaaactcagaatttccgtcaccgctcaggataccgatttctgtcaaatagcatactgatgagtatgcaaagtttgacgcgtcaatatcaacatatggtgagctgccgtatctcggatatccggctgtgtttgccttaagcatttttgcaacaattgttgcaaattccgctctagtaaccttttcgttctgccaataaccatcctccagcatttcaaaaaggcccatagaatagtcaaacttataagcgtcagcatactgaacgtcgtcattaggcattgacgcaagttctgttcctgctgccgagcttaaaacagcgtcggcagcttcttcatttgtggttgaatcttcggcaaaagctacgaaagtagacatacttaaaatcatagcagctgccagtaacattgaaattactcttttgatattactcattaacagttccctccatcttcaataatccatatatgattttagcggattgagcacggtctgcagctcccttaggatcaagcatattgtctccaacgccattaattatatctgcgcagtacattctttctattgcctcaaccgcatagtcacttatgctgctttggtctgagaaacttgcgtaaggcttattggcaggaatactaatacccaaagcattcaatgttctataagccataaccatcatatcttcacgagaaatattttcatttattccgaaagttccatcctcgtatccatttgcaactccaagatttaaagctttagctataggctcataataccattcaccctgaacaacatcactaaatggaacttcttcagccggtgatacactttcacccaaagcgcgcattaacatagaaacatattctgccctggtaacattagaagaaggtgaaaatactctgtctgccgtaccgttaacaatgtttttctcagctaaagtattgattgcgtcaacagcccactcgtaatcatttaaatcattaaaatacttgttagtattaggattctgagttactgctggagtagctgttggtgcctctgtaacactcggatcttctgttggagcaggtgtagctgtagcataattgcctccgccaccgccgccgccaggattaacgggttttacgtctatatttccggaatctgttccatcaccgttatacgctttaatacttgcaatattaacccatgaatatccatcgttacgagacttaatctgaattttaccaacattataatcatctatatcttcatcagtaaactcaccatatccatgaactagctttccatcagcatacaacttaatgttcttctgagcaaagtctacaaccactttataagttacatagtcagccgagcctttctcataataccataagccgtgaagagtctttccggtttgtgcaatatcagagtaaactgcgtctccggctattgtatcaaattgataatatttagatgaatatccggtattagaaggcagcactctatttttcttttcacttgccataggagtttttcctatactataagaaccgacttcgtctgagttaaactttaatatcggattctcaaccgttccgtcaaatctccagcttccttcgtccggcggattagtctgccacttattaactacaaactctctcgaaacaggacttgattcgctatcgaagaaaatagaaaatgctgattcccacaatgcagaatttgtagaatccttatcctcgtttacaagagaatccttatagaagttcagctgaacagtgttatgctcatcagacgcatcacttgttatctgtgatttatcacccttcttactaaaatcaccctgtctgttaagagcgtcagtttgcttctgatataaaattttcatcttaatttcataagtaaacttatcatcttgcgttacattcagcttattatctgcatttacaccatgtgagtttgtctcatccaataactgcagacaatactctccggtatccgggtcgttagccattgttacgcttccgccaagagtatacatatactcatttttcataaatgcgtcgcgttcttccttagacatcttagtaaagtcataatttaacaactgactgctcggtgtgtctgaaacaacatcagatgctgtcttaccgttgtcattaactgcaactactataaagtaatatgtctttccattttcaagatgcccaacaacttgtttgttggttctggcgtctatacctgtaagtttatgagcatatgctgtatagtcgctgccgtggtttgaggtatcgtaataaatctcataactttcatcagtagcaacgtttcctgtccaattcaatctaacttgcttcaaatatggaaccttatttgtaataacaggcttatccggaagcaaatctcctgctccctcaggcgccaccgtcgtacggaaggtcatatttttttcattagcatcgtttggatcatactctgcgacagtcacgttactattttcatctgtagcagttaccttataataatattgagtatcaggctgcaaatcaatcaatgttttagcatgataggtatgataataatctgttctttcatcataagtcaatacttcactctttgtataaacacctggctcagtaccatactcaactacacatgttgttctgtaatttgtattccagaaaatctgagcagtagaataaccaagcttatttaccttaaagttttcaattgacgccggtgtattatcagcttctaaaggttgatcgtcagccataaatgacatgtattcttcaagatatgtgtatccggattcaggattaatctctgttgccaaatacttagaagtgctccagcctctgtactctttataccagttaggaataccatctcccatgccatcccaagcgattttataagagtcaggtcttcctgcataattcttctctctataagaatccataaaatcagcgatttcagggaaatcattctttacccaatcagccgggtataaatcagcaactgttctctttacctctaaatactctttagattctcccataagagaatagcgtgtctgatcataattcgcatcagttgttgttacataacgatcccacttattgtcataaagtgtataaaccgtttgctgtcccggtgaaccacagaactcaccccaccagtcgcctatttcaaagtttgttgtatattgatatgtgctggaagcattaggatttgtattcttatttacatcagtgaaatcatcccaatgtacaggtttagtttggccagctccggctgaagcgcctttaagaacaggtccttcaccttcttttgtgttccagtcacgctgagttttatattctgaataatcattcccggttcttctttccagttcttcaaagaacggagatacttcctcagctgtaagcttattactttttgatgttccattctgcatttcaaccattgccattgtatcatacagatcccttgccggtcttgttgcacccattccattatcactttgagcatatgttgtaagcttattagatgctaaaacatttcctctaggtgcagggaaaggatagttcatatatgtcaatgttgccgcaatggcaatttttccttcattatcatatgaagcaggattgttattccattcttcataggtaacattactcaagtcataatttgttcccggcttaccattctctgaaccaaagtctaatacataatggaatgaaccggaagcgtttgttgctctttcctgtaaagtcgttttatccttaactccatagttttctttaaagtaaaccattgcgccgcctgaataaacacggccgcggccggctctgtatggagtagcatttgacatactaggaccttttcttgcccagttattataaacattcatcttggcattcttatcctgccactcataattgtaaatatcaaaaccattaccgcagttaaacagcaagttattatatgcgtctatccaatccgcatcagttatacgcggtgtacgctgagtactatctcccaagtaatttttaataaaggatgtttttgtagcaccctcattaatcataccaacataggagtgtccgcctttttcatgaggcgaattctcctttagagatttagccattattgtatttgagattgtaacatgttcgccggttacacggaaatccatatcaatcgcccattgcagagaacaatggtcaataataacttgttttgatgaaccgatactaagcgggtcagactggttaacttcgccagttttaaatacatcaccaattctaatcttcaggtttcttattataacatcatgggcacttcctacagttataccataaccttttaatgttattccaggataaggagctgtctggccagctactgtaacgttagaaagtttctcacctttgattgaaataggtcttcccaaagtagtaagatcaattactccgcctacgtcaaaaactattgttcttgcaccgctaatctgttccagtccatatgttaaagaaccttcgccatcggcatccaggttagtaacatgataaacctgacctccgcggccgcctttcgaatatgctccgtaaccttcaactccgggatatgctttaatagcgtcatcaggagtaatacttaaagtaaagtcttttgtagccgtttgtccgtttaaggttgctgtaacagttaatgttactattgccggagaagcgtttctgtcaggtcttgttacgactgctttataaccgccaagatccacaacttcattatcctcgttaacttccttattcttttctatcttaatatagttctcatcacttgaagaccagctcaatgcagaataagtacccttatcaccaagataaaagctttcttgtcttacatcgtttatatcaattccgccgattagagcgttttcagcatcatacttcgccttttcgagatcacttgtcggatcaagctcttttacagaaattgaaaagttctttgtctcagaagctgcaccaaatgtcaatgtagccgttataattacttcctgaacatcagaaccagtaaatgctggtctgttaatagtaacatgtccggttgcattatctacacttacaatactatcattggaggttgtataaacaatctttgaaccgtaatcaccttcaacaggcatattaaaatcattttctactgctgtctgcttcaaatcagacggcaataccaagttattagtatcgcctgcaactttttcctgatcagtagcaggggcattttctaaaacttttaagttaaattcacgtgttgactttgctgaacccttttcaaggttagctgtcaaaattactgccatgcttcctgcaccggtgaaatcaggacgtgtaattgaaacatatccggttgcattatcaattgtagcaatcttggtatcagatgaagtccattttatttccgagccattagctcctgatattggaacataaaaaccttctgttactttatttgcatccaaatctacaggaagacttaaagctgttttgtcggcagctacgtcttctgcgtcctgcttagcgttattgttatcaatgagtttaacattcttaacaagacaatcgccaagagacttaggatcgttcataattgtaaaaccaacaccttgcacaagtccttctgaagctgcaagattctctttgtttatactaagcttatccttagtagttataacttcaccgttttcatctttaaccgaataagtatatgtaccattttcggtatcaatgtcacatctcatagtataccatttaccggtagagtatgaaacaccggtatcaggtgttctggtattatcactccaggttgaaataccgtatggtgtgtttttgctgggatcctgatcagattttcctgaatcccaaaaataaccgcgtcctaaatacggaaaatcatctccacttactgctgtttcaacgtcgtctgtctttccatagaaaaatagaccaagtcttcccggtgtttctacataaacatcagctgacaccgcaataactccctgtgccggagtgtcaaaattgtgaattgcaaaaacgccctcatcaccggatgcggcacttccatttgaagcgccgtttttattcttctgcagtctgagagcattgccggcgctggaattatctacttttactaaagattttttctcacttccgctctttgatactgacgtaagaacccatccggggatactagtatcaccaacgttgtatccgtcaaatgtttcactgtaaattacattttcagcctcaagagtaacatcttcctcatcatactgaaaaaaaccatcagcgtcagctttgtacaaactgtcactttcaggtgccgaagtcgcagcaatatcctcgtctgctccagtatctgcatcttctgttagttctaccttattgccattttcatcaatggcataattaagaagaacctcattttcatcgttagcagtttcctgcgcctgctcagactgctgctccgcagtcacagttccggcatctttagctgattcttcagcaaaagaatacatcggagccgcctgaagcacaaacatcactgctacaagcaacgcaagaatagccttaagcttctttcttaccattttaattccccctaaaaatatataatgatttaatatttatctaattcataactgtatcaaaaaatatagatacagccaggtactatacattatatagccttttgttccaaaagtcaatgaaaagaacaattaaacacaaatttatcagaaaacttacagttattttgcttgaaagaattgtatttttgaccgtttttttcatttttgacagttatataaagctcctgttatcaaaaatcaaatactttcactcatattcgaacataataaaataataatttactaaaaatttcaaaagactgctatatattgacaaccccaagtatctgcaatatattgcttagcactataacgcctaaaaatacaggagccaaatactttacaacaattataaatactcgttttcttttaaattttgatgtcagctctatctcatcagagatagaaccaagaccaacaaaccatccaaatacgacgcacgttgcaaggcctgcaagcggaagcagcagagagtttgctatgaaatccataaagtccaaaatagaaaaacctaatattttaacaaaatccaatgcgccatatcccagcgaagccggtatacctaaaatacaggccgacgccaccacaatcaaaaccgcagggattctcttaaccttacatatatcacacagggttgatattaacacttctgctatagaaataaacgatgttaacgccgcaaaagcaactagaataaaaaaggcccctccaataacttgtccaaacggcatcttaagaaatactttaggcaaagttataaacatcaaaccggcgccttgatctaattggggtgtatcgccggccggaaatgcaaaaactgcaggtattatcatgaaggccgctaaaatcgcaattgctgtatcaaaaatttcaacattttttacacttctctcaatatccgtgtccttactcagatacgagccaaatgttatcattattcccattgcaagcgacattgaataaaacatttgccccaatgctccaactacggtttcaaatccaaaatgagaaaaatccggaattaagatatacttgacgccctcaatagctccaggtaaagtaactgaatatacagcgataactattgatattataatcaaaatcggcatcaaaacttttccggccttctctattcctcctctgactccgccgagcagaactccaagaccggccagtgaaaatattacgccatataatatcggttgatacggctgtgaaatgaaattgttaaaatacccgtctgcagccgcaaaaggaccgctgttagttatgaatgtaaccagatattttatgacccagccgcctattattgaataatatcctaatataatagtacttattataacagtcagccaacctacccatgtatatttttgactaaattttctaaatgctcccaccgggctcaagccggtttttctcccaattgcaatttccaatgtcattattgaatatccgaaggttagaactaaaatcaaatatataagcaaaaatataccgccgccatatttagcgactaagtaaggaaacctccaaaggtttcccaacccaaccgcacttcccgcggcagctaacacaaatccgattctccccgaaaaactatctctctttttcaaaacaataaccaccctttatttttataattgtattttaacacatcttaatttaaatatcaatattttaatttgatattgtaacttggtaaattttctgttatatttataataattactatttataatcgggaggaagaaatgagtaaaagagaagaagcaatgaaactgtttaaagctggatacaactgctgtcaggcagtggtaggagcgttttctgatgatatagaaatagactttaaaactgccatgctaatctcctcgtcctttggcggtggaatggggaggatgcgggaagtttgcggcactgtctcaggcatgcttatggttttagggctaaggtttggatattctaatccaaaagcatttgcggagaaaactgaacactataaacgcgtccaggaatgcgccggaaagtttaaagaaaaaaatggttctattatatgcagagaattattaggattggatctaaagagaggtgaggctgacagccatattccgtcagagcgctcaaaagaatattataaaaaacgcccatgcgttgacttagtaggagatgcggcagaaatactcgaaaaattttacattaaataaataaaaacacctggcagcaaataatgatatcaaatcatatttactgcacaggtgttttatttctatgctattatatgcttattctatttttcaatctctactttataacttttaacatagaatgatgaatcggctgaagtttgagtacctgacaggaaacctacatttgtaagcaatccattaaactctccgtcttcagaagttattgttctgcttgtgagctccttaaaatcttttgtatcaataccttggcttatataatcagttactttataactgttattttcaagaggctcaataacaactttcattgtaagccattcgtcataagcccatgtaccgctgtatgaagttggttcttcaaacgccgtatattttaaaactgtaccctttccgccaatacgtgctataactgtcgttgtttttgaaacgccatttttgtcagtatagtttactgatgaaccggctgaatttgcatacagcccccacatatctgtaccaacgtttgctcctgcatttttaacaacagctgtcataataacaggttttgttatttcaacaccattttcaggtgtccagaataactttatctgatctgtctttgcaggcgtggatttctttaatattttagctacatttacatctgtgcctgcttcctcgccgttaacaatctcaattgtactgccttcagccatagtgtctaatgccattccgccaagactatcgcctgaagcatcaattactgtcccaactgtttcgttagcaaatgtgctttcaaataaaacctctgtctccgctgccggtccttctgttggtttttcgcttggcacagcagtaggctccgcagttggaacaaccggatctgcagatggctccggagcggttgtcggtttttcaatcggcacatttgtcggttcaggttcattggtaggcgctgaggttggtaccggcggcattgtcggcgggttttccattgtagattttgtatacttaaccgcatatatgttcaatgcgccttctccgtaaatatataccggagctcccggataaacgctgaccgtaaatatcgacatagtattggcgtctacgctctttctagtctttattccgttctgctcaacaaccattacgcgcggagcgccctgactggacgcatgggcaaagtatatacttactgttccaaacttatccggagtaaaacttatggccctgcttgaattttctccatcaattgttccggctccgccgagttttaatcttcctgaatatttttcgccgtcgtcaaaagtcttattgctgacatcaatctcaatagctttgcttggactagcgtaaatagtcataccattataatttgaattacttgttatctttaattttccattggcgtcaacttcgcccaaagaactgcaattctcaactgtatattcccaggcactagtttccccggcaggatctacagttggctcaggtccattagttggtcccggtatactggttggcaaaggtgaaggtgttgctgttgccggcgcacccttaccaaatgtaacgtttacggtaacgtcactggccggcattacaaatgcgctatttttaacatcaacatttgaaccagctgaatcgacaacttccatactttgtacatcataaccactgtcaggaatcgcttcaatattaacagtttctccgttatatgctttcagagtaaatccatcggtttcagcttttccattatccgctgtaagtttaatattatcatagtaaaggtttccgcttgctgtcctcataaacttaatttgtgcaagctgaggagctctgccgtcagtaaccggtgcttctgacgtcgtcagaacaggtgttgccgaaatattgtcaggattatatgttccgtctgttccatgcagataatatgaaacagtaaatggatctgttgctccaagttctccctttatcacaactctataccactttgaagcttctaaagcggcagaaccaacctgaattcctgcctcagcctttccggctacatcatccaccgattttgttacaaagacctttgaaccaacatccatcatatggaagaatgctgagtcactgttaaactctgtagcctgacctgttgtttcatcatacggatgagctgtgttatcaagataagttctgaaagaacgacctgctgcattcgtattgtcatcataaaaatcatatgagagctcaaattctccggtcttaatgctgtccgccaatacatattgtaccgctttatccattaacttcatctttgaagaagcatttcctccaatatcagagttatcgtcaacaaccttttctgcatcaccgtcagcagagataacccacttaccgccgtttccgtcagacatcaggaaattatcggttgaattaataactgtgactttttctgctgcaagttctgcagcacccttagataattttaccgttccattttcaggctttggagcagtggcagtatattctttagcagtgctgtcaacaaacgatgctccaacagtaacatcggatgcaggcatagagaaagtgaaagtattatctgacacttttgttactttaacatcaggatcggtagtaacatcagatgctttgaacccactgttcggtttagttgtaaccgtaatttttgttcctgccttcgcagacagaataccattggaatatgttacgctctttataccaatctttgatccgtttgcccaagcatagtagcttaagttaggctctacaggtataacataagtattaatctcagctttagaaggagagtagtccttttcgaaataacttccttctgtgtcatcatataaattgaaaggtttattaggattcaagaataattctaaggataaatatcctgcctctttaggtgtgaaactaaatacgtttccgcccggatcatgctccgagaacggaaaggcaattgatggattatccaaacctttaattactttagtttgaactccgtcaacatcgacatagtaccactgtaccgcatcccaaaacgtaattgtaccgttactgtcgtccttgccatttatatttaatacagcttttccattaccaaaaatatttgtatcttctgcaactgcatctgcaggtatattgtcatctgcaagccattttaccgacttaatttcatcacttgaaatagttccattatttacaactatacttccattttcaatcgcgcttgaaatattaatattgtattgtatattgggatcaagtgtcggttcaggtgttggctttggtgtagcagttccagccggaggaggtgtgggaacatcgccataaacaacgaaaattccatagaagtttatacctgcgtcaggtttaatcgttattgtatcagcaccgccggcatgattaacttcaagcgtcggtgtagctcctccttcacaggttattgaacctattacgccagatgaatcaagtacagaatacgatctgctttctgagccgctggcagacacagcatccagtaatatcttacaagaccctgtaaccttaaatgataaagtagctgttccactcttcaaagtcttagtataagcatatccgcttccggcgaacttcttattactgtccgcaattgtagaatctttcgatactgtcaatccacctgtctcaacattagctttcataactgatccatctaaatcactaaacggcgaaaccgagaaataatatgtaggatcacccaaaggctgctcagtaggagctggggtcggctttgacggatccaatgtcggttcaggtgttgaagttggtgccggcgtagctaaaatctgctcgaaatgtgcagcaacctcaatagaacccttttgcacgtcttccggaaatacaaatgtatatgagctgtctccgttatcagttatattttttgcatctattgtcacatttttgcctgatacacttgacacataagtaatcacaggaattctgtcaacagaaaaaccatccggaggaataatatttattgtttctttttcaccgggtaaaactgttgggggaacaggcaaaattgtgccgttctgatactgacctacggtttttgtcggcatagtaatctctgaagccgcatactcagcattaacctgccatcttgcatatatacgggtatttccggttataactgtgtttttaaaatcaaatggagttttagaagtattgtcggcataccatccaacaaacgtataatgttcacgcgttacaacatcagtaggctcagccgcataacccccggtctcaacctcctgactgcttactgaaggagttcctccgtttacttcaaaagaaactatggattttccttctgcataccaccctgcatagagaaccatatttctagttacggcgtctgaatctacatcccatttcttagacgctatcaaagaatccgctgcgtcttttgatgtataccagccgtcaaaaatatatccttcacgagaaggcataactgcttttgaacctagaacactgtttttggcaacagtaactgtttttgtgcctgagccattagaaaacttaccgccgttggcgttgagcgttacatttgatgaattgctgttctgattattattgctgccgcctccgcctgaagaaccgcctccgcctaagttgccaattccgccggttgttcctgtaccgccgccgggattagatgtctgtgaaggactctcagcagctgcagttattccgtctaatatctttacaacttctgcacgcgtaataggagcggaaggcataaacgttccgtcttcatatccgtttattacacctgctccaaccaatgcggttactgaggtctttgcccattctgaaattgaatcgttatcagagaagtttaacaatcctatagaatttattttataagcacgctggaacattgtagcagcttcctcacgcgttacagcgtcatcaggtctgaacgttccgtcttcatatccaccgataattccctgagcaacgcattttctcaaatctgatacaaaccattcatcacctgaaacatcgctgaaattaatatcagcaagtgatgtgaactgttttgctgcagatataacttttgccagttccgctcttgaaatgttagcgtcaggcaggaaagttccatcctcataaccattaattacattcgcattactccacttgtcaatcactgactctgcccaatgaccgcttgtatcagaaaaagctgccgctgaaacgacagtaattccgaaagtagcaagcaccatagccatagctagaagtaatgccattgactttctcaactttttcattccaattccccctaaaatatattaaaataaacttttactatattattttaatgagcaattatgtatcattaacaaatgcaaacctgcatttgtagataaaattctcattatagacaaagtcaattatacattaatttttaatattagtcaatcaaaccaaaacaatgaggcaattattcattagtttttaataattttgtgctattagttccctaatatattacaaataatatactaaataagtcgaaatcttacataatacaaaaaatcaggacacggtttaatgcgtcctgataaatactttcactattggcttagcgccgcgtataatcttagttattattatccattatttttatgtattcatcaaagaattgttttttatacctgttaacataaacttcgtctaccataatattcacatcaggcacactgttttcttccttttgctgtataaactgcaaaaactttgggccaagaagactattagtaaaaaagtattcctttgtcttttggttgcagactataacaaacataattgatgttaattgagaccaggtcataacaaagtgtttattttctatcacagacatcctgggtgttgaaataccgcatctttcgccgaatgctttttgtgacagcttcagcaattctctgattttaggcaaatgatccgcaagctcaatacacatttcttgtttttcttcttcagttaaaataaccataaccaaacagtcctcctaaatattaggtccattactcacgcatataaaataaatttttaaatctaactgccataaatattaacgagtataattttaacacacaaaatacataatgtcaatattttataataatacgtaaatattctactattatatacaaaaagtgattctataaataaaacaaaaccgcggatattaaatacccgcggtcaaatgttttagttacttctatattaatatccttctgttacagctaaaagtttaactcttccttcagacatataaatcaatactttagccgggttaagaccttcattatactcagctataccatccataattgcttctttatcagaagttgcgtcaactatttccgtctttccgccattctcggaatatttaagaattttagctcctgagaagcttgaagcagaaatagtatactggtcttcgccgcttacatcatcattctggtctatatacttaggaatgataaccataccttcgctggaatctgaagcatatacgcttccgtaaataacacagaaatcagcgctgctccaatttgaaactctgccgcttcctacttcgatataaccttcgtcagcaggatacagacgatattcatccttaaatgtcttgaagccgtcactgtcctcgcccactctgtagatatcaccaatctgtgcattcttaactacactattagatgagagcgaagcccaatcgtcaaaagttccgttagttgaagttttagaaatcttaaagcctgaaactttatacattgtatcagatgtgtttgcatttatctgctggctcggcttatcattaaatacatatatcggcgagctgtcgtcaacttccgtagcggcgcttccgccgtatacaacaactaccttagcggaatttgtgtttgaaacatcaaatgcctcaacgctgtcataagtcttatttgtgctgaaatagctgtttgttgctttcctaaacctatccgtatcatttctttgatcctgcggcggaactacaaaaactatagagcttccgactgaaagctgaatatttccgctgctaagtttactgttagcatattttaatgaaacttctcctcgctcaagattagcaaaattataaagcttatctgactcaacagtttgtccgtcttttacatccgtgtcaggggttacagtataaagagtatctatacactggtttcctttataagtagtataagtatatttaactacctgctgcacgtctgtatgaccaacttctccggtcttctgataagacgcgccttctctcaaagcgtccaaaaagtcatatgctgtagaacagcttacaccgttaacagtggttccctttctgatatgaaaatctgttttggaattattttgagttagtattctaacctgaaaatcatctattgatgagaaagtagcttctccctcgtcataagccaaaacatatccataatattggttaactacctcattgctcttgctatacgcaaacacattacctaaaatatccagggcatatgttccattgtcaccagtctttggttcctcaagtgaaccgtcatttccattctccatccaaggagccgcgtctgagaacttatatgaattgctgccaatagacatttcatccccggaaattgttgaagatacgtttccggtagccttgtcagttaccacaacagctcttgaatactgttcgccgccattctcagcatagttgctcactgcatagcagattacattaccttcagaaatagagctgaacgaaacctttgttccatttttatctactatttcaagattagtgtctttatcaacatccaaagtcaaagttttatcagtcgctcttgatgcattatcaactatcgaagaatcacttgtagatttctttgatacataatatacctgatagtcccaaatagtaacaacgtcatacttgccgtccttatcagaatccagtactgttattgtacctacgttagggaacatatctgtagagaatctgcttgcgtccgcattggaaccataaagctttccattatatataacaatgttgtcagatgccaaattagcgtttgtaagcgatgatgtctcagttggataatacttaattgttgtattattagactcgtctttttcaatcattgaagaattgagttcaagagttgcattttcttttatctcataactgaacagcgtacggattgtatcattagctgatgttttaggatagaagaaatcaatttgatatccgagcttatttgtaaattcagctgcgttatctacagcgtatgtatgaacttcataaactgtagagttcggctcttttgcacgaatctgtatctgattctcgcggaggttaacatccgggtcgtcaagacttgtcaaatcgtttgctgaaatataccctgtatttttaatgtatcctagataatcagcgaggaatgtctttgttgttactacgccgttttcaacaagagatacctcaagtgaatcatagagcatctgcgctatacaagcacgtgaagccggcttctcagcagaacctaagttctgagcgccttttaagatacccaaagaccttgcctgagccatgaagtttgaataccacggagttgcgtcaacagaaatattttctccgtatccaagcgcgcaaacaaccatctttactgcttcttcataagcaaccttgtcattaggtctgaaagttccgtcctcataaccgttaacgataccatttttataagcggtattgatgttcgggatagaccatgaaatatcagaattctggtcagaaacatcggaaaacggtaaatctgcagatgaggacgaacctatagaaccggctcccatagttctcatcagcatagcagtaaattctgcacgggttacatcattatcaggcttaaatgttccatcatcataacctttgataatgcccaattggttaagtgctgaaacggctttttcatatgacactgttgtcggaacatcactgaaagctgcaaaaacagatacagtggacgcaaccatcaaaagcgtcaaaaccaagcacaaaactcttttaatgtttttcattttttacccctccaaataaaaatatttatttattttataaatatataaattttcataattatgcttgtccattaaattccaaacagactcgcgcacaaatatgacgcataaatgcgaagtttattttatcatgtttatcgaaaaaagtcaatagataaacaacttataaccactgaatatttatcctattattcggctaatttaagcatagcagctgaaaataatccaatataaccctcagcagtatttagtttctattttctttccattcttataaaagtatcgggctccagttcaatctcgcttttaatatatacaacgctctgaggatgattggcaacctctatctcattgccctccccgtcggtcatatactcaatcacctgagcgtgaaaatcaccgaaaggccttaaaaattctactgtattccccttaaagaatctattcttttgaataacctcagccatttttgtctctttgtcatatccggttactattcctaccatatcatagttgcgtatataagagctgctctcatagtgctgttcgctgccgccgggctttccaaaatagaagcctgttgtataatcacgatgactgacttttttcacttcatctaatagcttagtgtcaaacacataattttcatccgaattaaaataatcgtcaatagactttctatacgcttttacaattgtggcaacataaaattcagatttcaccctgccctctatcttaaaactgctcaaacctgattctatcagcttatccacatactggagcatacaaaggtctttagaattatatataaacgtacctctttcattttcatacaccggcatatattcgccaggtctctgctcttccattagaaaatacttccacctgcaaggatgcgcgcattcaccgcggttgctgtctctgccggccatatagttgctcagcaagcacctgccggaatatgatatacacatagccccatgcacgaaagcttccagttctaactcttttggtgtacgctcccgaatttcccttatctcgtccaaagacatctcccgggccaaaataacccgctttgcgcccatgttataccatgtttcagcacttttccaatttacattattcgcctgagtgctcacatgtatatccaagtccggggcaatttctttagttaacgcaaacattcctaaatcggataaaataaccgcgtcaataccgctgtctttaacacttcctaaaaactctgaatattcatttatatcagaattatgcggtatcacattagcggtcaaatatacttttttacctctttcatgagcaaatttcacaccctcaagaatatcatctgcgctgaaattatccgcggcaactctcagcgaaaattcttctcctccgatataaacagcgtcggcaccataagttaatgctattttcagcttatccaagttccctgccggcgccaacagttccggttttttaattgttttatctctattcatctaattaaccccctatctttccctagacacgcataaaggcacataatatatgtgcccgacaccctaatattaatttgtaaaccattttaaataactataatattgagcaggctgtgcgctgcctactcaatattattaataaacatcaactaatacgctacaccaaagtaatcacaaataccgtgcgctatactttcagcatagctccactgacagccatcatcggccagtttagctgcgtcggcggcagtatcaataaatgcagtttcaagaagtatcgccgtcatgctggtatttttaataactgcaaaccctgcctctttaacacctctgttagaggtaccaagagaacttgtcacatagttctgaatatatgtagctaaccttttgccatcagcattgccgtaataataatatgtttcggttcctgttccgcctcctgcattacaatggattgatacaaacaaatccgcaccaatactgttagctaaatttgacctgtaagcaaggctggctgacgtagattctgtagaacagttatcataaacagaattacgcgtcattacaacattaaaccctctctcttcaagcagaggcttaaccttttcagcgatataataggttatatcctgctctctcaaaccgtttccggtagcgcctgtatcaacgccgctgtaattgtgaccggggtctattacaacagtaagaccattattagacggaattgaaggtttatataccggttcattaataaccggttctcttgttggagccaatgtcggcataggcgtaggagccaatgccggtttggctgtcggatccggagttggaaacgctgttgggtccggtgtaggcgctaatgtaggagccggggtagcatcaaatatatcttcaccggaaatatctgtgttttccggttcttccggttccgctgtaggatatgctgaattatttgacaaatcggaagcgtcacccgacgactgatttgaatcgtccaaatcaccgccgttaataaaactcaaagagttatacaccatttgtgccacaaacgctctgttagcgtccttacccacagtcttcttcgtgttctgaagcaaaccatacttttctgccacagccacataacccgaataccaataagggccaacgcttcttaggctttcatcgccggcaccggatgaacatacgaccattttaaccacctgttcatatgtaaccggatcagccggagcgaaagaaccgtcaagcataccgtttatatatcccttttcataacaataagatatgtagttatttgcccaatacccgtcaggaacgtcagagaacggtatgtctcccgctgtgtaataagtttcattatagcctgtagcccttgacataaacgcacagaattcggcacgcgtagtctgagcctcaggagcaaagtttccatcttctctaccttgaataacacccatattgctcaacttatccaccgccgtataatatgaagcggtaataggtacgtcagagaattctctggctgatgccgttataaccggcagagcaaatattaacatcgacagtattagtactgttcctgctaatagtttgtgttttcgcataaaataatcacctcaaaaattttgccgctgaaaactcctgatactggtgcgccaatatacaaaatatttcagcaagcattccaatttcaaaaccgaaactgtgcacacagtataccacggcaggctcggaaaatcaagtaaaatcccgattttttcacaatttgttaatttgcaattcacaaaatggccaaaatatttcccacaaaattttccgtatttttatataattttatttttaaaaatcaatatattgtgttacaaaatttttgatgccaatatcttgcggtcattttttgtaacataagataaatatttctgtaacatttctgtaatatttgatttttttcaacattgccgcttttgtataaattgcacaataaaattataacaattttgagtatataaagattattttaaaggcgagccaaaaaaacttttactgcgcttataataacaagatgaatcaaatcagctgcttattatacaagcggcctaattttaaacctattatattatagtctaaatacatctgaaaccgcatgtccgggaacaaacattgcaacatgcaggatataaacaataattttagttagatactactataatgtacttaaaataaattttacagacggcaattgactttattattaataatttttattaactgcataatacttaagatataaaaatattattttttatattatctttaaaactttagtccagaatgttattttattctatataataaaagtatcaagcataaagcggctgcccagtttccatccttcaataaaatattccaataattccagacttgaaacttcttcatgtgcggctaataactgttcaaaaagatatttttcctcattcttcagtgttatgcttagtttttcttcattttctaatataacttttacatgtttttcaaattctaaattgctgacaacacgtttttcatgaggatttatatttccgtaatacaattctttcagtacactcaaacgtttcccctccaacttatgtattttaaaatttcttcacgcttgaaacttccttttattcttttttaaatttatgacttgattttgtcttttttaatggtattattttgtttagaattgagaagttatcatccggtcataataaaggattttaaagaaataggtaaataataaaatgtatctaactgtataacctctatacttgcatacagttttatcatatttttaaatcacctgctttattattttaatgtgtcaatagattatctagttgggcgtaccgataatcctaaaataaacaaatgattgcttcagcacattataatttgttaatcttctatattatattctgtaataaaaatcttaatattatatcactcttgttcttatattctgatgcttgtttatatatttaaaggatttgtgtatactaataagcaaagattgaaaacatttgcattgtttaaatgactaattcattttctttatggtgtcaacatatagttaaattgtcctatttttttaatcgttaaaaaaatatcgaaaaaatacttgaatattttatccgtttgaggtaaaataatactgctgtcggctaagaggcgtatttttattcttacttacaggcttcgctgttccgatagcagataaatctgcaaaatataaaacaatatatatctttttaggaggtactttactatgtcagtaaaagttgctattaatggttttggacgtatcggccgtctggctttcagacagatgttcggcgcggagggttatgaagttgttgctataaacgacttaacaagccctactatgctcgctcaccttttgaagtatgattcagctcagggcagatacgctctcggcgacaaggttacagccggcgagtcttctatcacagttgacggaaaagaaattgaaatttataaggaagcagacgctaacaaccttccttggggagagcttgatgtagacgttgttttggaatgcacaggcttctatacatcaaaggataaggcacaggctcatatcaatgccggcgctaagaaggtagttatttcagctcctgcaggaaatgaccttccaaccgttgtttttggtgttaacgaaggaattttgacacctgaagacaagattatttctgctgcttcatgtacaacaaactgcttggctcctatggctaaggctcttaacgactacgctcctatccaatcaggaatcatgtctacaatccacgcttacacaggcgaccaaatgattcttgacggacctcagagaaaaggcgatttaagacgtgcacgtgccggagctgttaacatagttcctaactcaacaggcgctgctaaagcaattggtcttgttattcctgaacttaacggtaagcttatcggaagcgcacagcgtgtacctgtaccaaccggttctactactatccttgtttcagtagttaagggcaaagatgttactgttgaaggtatcaacgctgcaatgaaagctgctgaatcagcatcattcggatatactgaggaacagcttgtatcttcagatattattggtattactcagggttcattatttgacgcaactcagacaatggttaaccaaatcggcgacgacctctatgaggttcagacagtatcatggtatgacaatgagaactcttacaccagccagatggttagaacaatcaaatatttctctgaacttggctaagatttctatatttattatataatttaataaaaatacgccgcctgaaaacaggcggcgtattttatataaaaacatactttataaaccgaagttatgaaatattaagtttttttattatcatattttacttaaatatattattctgtactctcagactgaaaatttacttgcttttataataaaccacataactttttactataaagaattatttacaatgttctcaattaaaatatagttataactgttcttgacagctcgatttacttttcagtattttatctgaaattcattttagttttttaaatatgggtataacacataaaagcaaacttaaacaaatcgtcaaatttactttgcgttttttccactttgcatgcttcttatatttatattttaatttctaattaaaatataaatcaatttcgtatacgctatttaaccttaaaaatattatacttcttttttctattttatttttgtcagctctatcgattcttttccggtaatataatcaatctgcagctcaagcatacataaattatcccattccttttttatttcggcctctctgtccgtcttatccccggaagaatatttgaccgccagcttttcgattgcacttcttttttctccctcatcatctaaaatccgaatcttcccaaaggcaatgatgctcttataattggtcgtatatttttccggcaccacgtcgtcttgaccgattatgcaaaaagacgctttattatttctttttacagcgtcaattttgtgtccggttttcgccgcatggaagtaaatgcttgaaccgtcatacacatagctgagcggaactgcatacgggtaatcattgtctcccgacagagccaaaacgcccgaggtaccgttatttaatatctccgatatttcttcaccggacaatgactgtttttttctgcgcatctctctaaacatatttcttctcctttatatcagtaactctataataatcttttcttaacacggcaatataacacaatgccgaggatagctacaagcccttctgttatcggcaatgtcagccatacccctataagacttgccaaaaatgacataagtagcgctataggaattataagcacgattccgcggagcaatgagattgcctgcgctggaattgctttttcaaccgctataaaaaacattgaaataactatattaagacccataaacggaaccgccgtaaaataaatttttaatccctgttctgcaatactttgcaaaagaccattattcccgctgttgaatattcctgttatcggtccggcaaatatagaaatacatgtgtaaaccaaaactgaaaccgccagcattgttaccaccgcatactttaaagcaagctttacgctgctgatattacccctgccgtatgcagaactgactatcggctgcattccctgagcgatacccgtataaatagacgcgaccacaaacgaaatatttgcaataaccccatatgccgcaactccaacatttccttgaatagccagtatgattatattaaagacaattattactatgccggaagccagctccgtaatcagagatggaatacccaacgaaaaaatcgtgcctataagctttaaatcaggtctcttaagtttaaagcgaaagcagtttttatttctgaaatgcaccgacagaatcagcatacttattatcggagcaaaaccggttgccaaaaccgcgccgaatatacccataccaaatggatatataaagatatagtcaagtataatattagaaaaacttccggcaagcattgcagacattgacagtttcggattcccgtcattgcgcacaaagcaaatcagcacatcattcattataaacgccggagcaaagtacagcagcacgctcagataagtttttgtcatatcaaacacttcattatcggcgcctaaaaggacagttattttattagaagcaaacactcccagcagcacaaaaatcactgacagaagacctgccgcgtatacagtatttgtaaatactctgtttgaatcttggtatgccttttgacctcttaaaacagaatacttagacgcgccgcctataccaaacattaaaccgcttccgtgaataaaactgtataccggaacggccaaattaagcgccgtcagaccattcgccccaactccgttagaaacgaaaaacgtatccgctaatatataaaatgataagcctatcattccgagaacattaagcgaagtatagcgaataaagtcttttaaacagtttgtctgctccatatatcttgtctccttattcataaaaagcgccagctttctatcttcaaggacttaatgatagaaagtctgacgctccgctgttttacccggcggcaaaacagcgtgattatttaatttaacatttaaccatatctcttatataatgtcaaccccatattgcatatatcttaacctgctgtttttatatataacaatttctatttttgcaatacggttagttaactatatctatatccggttcaagctgccccgttgagtataaatatataacgacagcaataaaaacgattaaagcaatgatagacaatgcgtttagtactattccccaaacgcccatccacttactcgtattccttgcagggttatactgtttcgtccccactatacccagtattaggccaacaatcggacctataaccgtattgcagagtaccaaacttataataccaattataaaactggctatagctgtccctaccggacctttttccttaacactatgaaaatcagaatatgtaccgctttggttctgagaaccctctgtcttttgagtttctccgcatattgggcatacagcggcgttatcgtccatcgcattgccgcatttggtacaatatttcatctaatcgtcactcctttatttgagtaaaccggtaatcaaatccacaaggttaaacttaacaataagcgctgcaaaaacgattgaaaccatagataacagcttaatcaaaatattaacggacggacctgaagtatccttaaacggatctccaactgtgtctccgacaaccgccgccttatgattgtcgctgccttttccgccaaagtttccggcttctatatatttctttgcattatcccaggcgcctcctgaattagccatcatgatagcaatagcaaatcccgaaaccaaagctcctgcgagcataccaacaactccgtttactccgagaaccaaacctacaactataggagcgagtataccgagagccgccggcaaaatcatctctctaagcgatgaacgtgtgcagatatcaacacatgtttcatagtccgcttccgctttgccttccatcaaaccttttatctgcttaaactgtcttcttacctcaacaactattttctgtgccgcacgtcctacagcctgcatagtaaacgcactgaacaggaacggaagcattgctcccacaaacaaaccaatcaaaacaggcggatttgtgagcgacaactgaagctgtcctccaagagcctgaattttatcagtataagaaactatcaaagccaaggctgttaaagctgcgctgccgatagcaaatcccttaccggttgctgcggtagtgttacccaaagaatccaaagcgtctgtacggtttctaacttcctcatcaaggccggccatttctgctataccgccggcattatcggcaacaggaccataagcgtctgtagccaatgttattcccaaagttgcaagcatacctacagcagatattccaacgccataaagacccaatgagaaactgctcaaatctcctgtggcaaggaaaccgccgccgcctgcggcaaagaagctgacaaggattgagatacccactataactactggaattgctgttgaattcatacctagcgctataccgtcgattattatagttgcgcttcccgtctttgatgactcagaaagcttttgggtcggcttatatgaatcagatgtataatactcagtaaagaatcctatcagcacacctgctaccagacctgatataactgcccaaaatacgcctgtattctgcggaagcagtgtaaatatcaaaactgcggctgaaatagctgaaagtatagccgaaacatatgtgcctcgtctcaaagaacccaaaagatttttctgtgtagcgccctcttttgtagaaacaaagaacgtacctataattgaagcgattattcctatagcggcaatcatcattggaacaactatgcccttaaagcccaaacctgccgctgtggcaagcgcgcctgttgatatgattgaaccgacatatgactcataaaggtcagcgcccattcctgcaacgtcgccaacgttatcacctacgttatctgcgataacagcagggttacgagggtcatcctcaggtattccggcctcaacttttccaaccaagtcagcgccgacatctgcagcctttgtaaaaataccgccgccgacacgggcaaacaaagccatagagcttgctcccataccaaacgtcagcatagccgccataatctcgttcggatcactcagaacggcttttaaaattatgaaccaaacgcttatgtccaaaagacccaagccaacaactgtaagacccataaccgtaccgcttgaaaacgctaccttcaggcctttattcaaactattttgggctccgttagcagttcttgagttagcatatgtagcaatcttcattccgataaatcctgaaagtccggagaaaaatccgccggatacaaatgcgaacggaacaaaccatgtgagaagaccaaacgctgccattacgcaaataattatcagcataacgataaagaaaataccaactgtcttgtactgtctctttaaatacgccatagcgccttttctgattttagcagaaatattcgccatttcttttgttccctcaggctgttttttaacccagaaaaatttgtacatcgcaaaagccagaccacatattgaagcggccaaaacaatccacggtgcaatgtctacaatacccattgtaaaacctcccataacaacaaaatatataagtttatttttttacaaatacataaaaaaactgggattttttctaaaatcattaagacgcagaaaaaactgcatggttaaggaaaaaactccataatatgacaaaaatttaacaaaatttcaattatattctatatatgtctataatttctttgtgtttattatacataatgaacatataattcgtcaagttttttttagtcatgtaacataattgtagtatcaaaaactaatattttatattattaccatagtctctactgtttttttgcatttttttgattttccgccgcagattgagatagtaatttataatagataaaccctctcttaaatagttgcttattttggaagccttcggcgtatatgctgaaattttaacaatatttttatatccaataagctcggctatttttttagagcgaaagacatggaaactgttggttacaaatgcagaattgttttctatacttcctccggtctttaatattttttcttttgaaaattcaaagttctcataagtgctgtgtgaatccggttcaaggataattctactttcctctacaccgttactgacaaaaaaatctttcatagcccgggcttcggttgtgtcctcgttatctccctgccctccgctgcagactattataatatcccggtttactttaaccagtttcagcgcggctgagagacgttcatataagcatcggcttggagttacgccaaacaagcggcaccccaaaactatcaaatacttaatattttttatttcttttatttcaagctcagataacttaggcataaacctaccccttaacttatatgatttgtttgttatcttaattcagataatataagtttataaaaaataacctttattattacaaatatataaaaagattgcactgcctaagcggtgcaatcttatataaccaaaatttatatttggattattccccagcggcagctccgcctgctgcagagtttccatctgctgcggagtttccgcctgatgtagaagttccggcgcctgaagcggcgcttgcagcagcctgctcgttttcaagttcctctgttgctgcctgaacatcatccaaaattgccttaactgaaaccttatcaaggttccccttgttttcgcttactttagcctgttcaacccagtaaccctgtatctcatataatccagggattctcatgattacgtggtaaccataattggtcttaaccggttcagaaatctcgttaagcttcaaagcgaatgctgcagtttcaaattcttcaaccatttcgccctttttgaaggtatatccggctgatgtttcgcttgtatcagtattatactgagtcattaactggtcaaagtcgccgcccgatttagcctgctgcgcaacattctgagctgtagctaatcctgtagcgtcgtcaacagctgttgggtcaggtgttgcggccggatctgcagctgcagggtcagttgtctcaatcaaaatgtgtttaacagacgctctgtcatcctgtgtataattctgaaggtcaacgccttccggagtaaactttgaaatatcttcttccattgccgcctgaacattctgcgccttcataacagttgtatacattctagcatattcatttgcagaagatatacccatgcttcttgctctcaggctgaatccgtcctcgccgaactgctgaacatagctgtctactgtagactgaatctgctggtcgttcttctctgtccaagcattatcgtctgtaagcagcttttcgccttgctgtcctgtaaccatatcggcaacagcatttttcattgcattttcttttatagtatcagaaagttttttgccgtcgatttcctgatcccagtcaaaactgctgaggtcgccgtctgcgctttcgccttcaatatcatagtactgagtcatagcttcagcatagatataataacctaaatctttatctgtgattttttcaccgttaaccgttgcaactgtcttgccctcagccttgccatactttggctgtgcggccgtaaagttcataatcagaaatactatcagcgctgcaaccgcaacacatccaactatgattccaaccaaagcgccgacagaaatattgacgccttttttcttttcttctgtaacttctttaatgttatcaacgctttccagcgcgtctgcttttatctctgtaatagagtcttcaagcttatctccggcttctgaaatcacttctccggcgtcattaagtttatcgcctataacttcttttgccttttgatcagcctcagaaatttcttccttgatttcagacgcggcgtcagctattttagagcttacgtcatctttcatcttttgaactttttcatcgttcaaaatgtcctttttgtcattagccatctttttttctccttttatgttatgtttaaataattttaaatctcataaaacccgggacagcccgaatacttacacagtcccaaaatattgacctgcataactacacaatcccaaaatatttttctattatacatcaaagcaagttaattttccactattgttgttaaaacttattcaaatgtttacaatttattcaaatttgccttgctttgttctgataaaaaactcatcatttcttttatctgagccaaatagttcttcccgcctttgtcagaggacagaggaacaagttttattgccaatttaggattattgggcgtcaatatcgatatttttccgggatatttgtctatcagttccaaacacggtttcatatcgggtatattttcagggtcaaattttaccgttatcctctctgagtttcctataacttcggttatattataacttgaagcgtacgccttaatcagggccacctccataaggttttcaacctccggcggaacagttccgtatctgtcttctatttcatcatacgcgtcatacagctcatcctgattttttatcgcggctatccgcttgtatgctgctatcctttgactgtgattctttatatacttatctgaaatatatgctgatacaggtaaatctatctgtgtctcggtctcatttttcgtctctatccccttaatctcagccgtcgcctcttcaagcagcctgcagtacatctcataacccacagcttccatatgcccgtgctgctgggcgcctataagatttccggtgccccttatttccaaatctctcattgctatcttaaaaccgctcccgaactcagtaaactcctttatcgccagcagccgtttttcagcctcgggagttaaactcttattccgcctgtaggtcagatatgcgtatgccagcctgtttgaacgtccgaccctgcccctcagctgatacagctgcgctaagcctaagcggtcagcgttttcaagaattattgtgtttacatttggtatatcaagccctgtttcaattatcgttgtgcagaccaggacgtcaatagttccgtctgacacgtccatcataatttgctccagctcgttctcgtgcattctgccgtgagccacggctattcttgcagacggcaccagctccgctattctgttggcgactttaaatatgccgtctattctattataaagataatacacctgaccgccgcggcccaattccttatttatagcctcccgaattacgtcctcgtcatactcaagaacataagtcgatatcggaaaccgctccgccggaggttcgtttattatgctcatatcccttattccggtcagcgacatatgaagagttctcggtatcggcgttgcggacagcgtcagcacatccacttcttttcttatctcttttattttttccttatgggcaaccccaaagcgctgttcctcgtcaatcaccaaaagtcccagcttattatatttgatatgctttcccagcagtttatgggttcctataacaacgtctatttcacccgttgccaaaccttttacaatacgcttttcttccgccgcggtacaaaaacgagacagcattgcaacgtttatcggataatccttcattctctgcttaaacgtgttaaaatgctgtgtagccaaaattgttgtcggcacgagatacgccacctgataccctgccatgaccgccttaaacgcacctctgagcgcaacctcggtctttccgtatccaacatctccgcacagcagtctgtccataggatacggcttttccatatcctctttcatctcttgtatgcttcggagctggtcgtcagtttcctcaaacgggaacttggcttcaaaatcgctctgccactcatcatccttagggaatgatattcccggagtattcgcacgcttggcgtagaggtctataagttccttagccatatcggcagcggcagcttttaccctctgtttggtacggctccattctccgccgcccagcttgttcatttttattcttgctccgtctttggcgatatgcttgtagaccatatccagctggtctgttggcacatacaaaaagtcgtcgcccttgaatcttattttgagataatcttttctgacgccatcaacattcagctgctcaatgcctatatactgaccgataccataatttcggtgaacaacatagtcacccatattcaggtcggtaaagttgtcaatcttttcgcctttaaccttgccgtagcgctttctttttttcttttcatgcccgaatatctctttatcagaaatcaccactgtctgcgtggaaggaaattcaaatccatgcgagatagaaccgtgagttataactattcctccgggcggaggaagctctgtcaaaacgtctgtgtacgcacagttaaaaccctcgttttccagctggttcagcaggttcttagcccttatctcagaaccgcccagcacaaccgtacggtattggctggatttatagaatctgagggactcatataagaattcaagcctaccctgaaaacctgccaaagacttggagccaacagcataggttctctttgccctatattcagctgaataatttgaaataccgctgaccccaacaaatctatgcgccgtcagccgttttaccgccttcttcagcggcaaaaagtattccgtatccgccttggggattattcccctttcagtcatctcagttatgtcttccgcaaaccttaccgtctcgccttcatacgcctcgcttattctgcggccgtcacaccaaaaaataattgtatcatctgccaaataatccaaaattgtgggcttttcacgatatatatatggaatatacttttctattgaagggaatctaatcccctgcttaagtctttcaatatccctgttcaacaccgaagccgatttttcggatacaggcttctcagtatcgctaagcaagctgttcagcttttttactaatttagcacgttctttatcatccggcaccagctcgcctgccggagttatcctggcctcatcacatctgtcaatcgttctttggctgtccttgtcaaaggttcttatcgagtcaacctctgtgtcaaaaaattcaattctcagcggatactgactgtaatacggaaaataatcaagtattccaccgcggacgctgaactgaccggctccctcaaccaattcctcacgcttatatcctaaactttcaaacttaccgatcagcgtctctaactcaatgtcatccccaacttttaatgttataacgttttcctgatatttcttaaacggtatagtcacactgagcaaagccgaatacgtggtcacaacataggttcgccggcctttgtttctgaacaaatagtcgagcacctcaagtctttgcttctgtatctcatggctctttacatctacatcgtaaaaaagtatatcggagtttccgtaatacagaacctccgcacctgagaaaaatctgaggtcgtcggctatttccatagcggcagcctcgttttcggcaaccaataaaatcggagcctgaaatttttcggacacacaaaaagccaggtgtgccctcacagagtccgacacacccgctacgtttataggcgtaatatttttttgtaaagcccctgccagctcctcaaagtcggcaaggtcttccataacttcataaaaaccgtttgttttcatagccaatcacatacaatccttatccgttatacatttgcatagccgtcctggcatctgtcctgattatctcctcaaccgctttcacagctcttaccgctgtgtcagtcaggatttcagtctccgccttagaaaatcttcctaaaacaaagctgcatatatcctcatgctcatccatatcatttccgcctatccccagttttaccctagggaactggtctgagttaagattgagtataatacttttcagcccattatgccctccggcgctgccgcttggtctcactctcagttttcctaaactcatagttttgtcatctgaaatgacaataatattttcatcaggtatatcataataatcggcaataggcgcaacggcctcgccgctcagattcataaaagttgtaggtttaaccgcaatcaccttttcgccgcatactatacccgttccaacctcagccctaaacttgcttgacttaaactttatattattcttggcacagaacgcgtcaacaacatcaaaaccgatattgtgtctggtattaatatattttctgcccggatttcctaatcccactatcatatacattatatttacctcaagtaaattttattattttttcttgctgtcttttctttttgccgtccactgttccttaacaacctgcttagaacgggctatagccaaagattcaggcggcacctcgtctgttatcgttgaccctgccgcagtgtatgcgccgtgccttactacaacgggagacaccaggttggtgttacagccgataaagcagtcgtcttcaataattgtacggtgcttattcacgccgtcataattcacgacaacggttccgcagccgaagttaaccctcttacccacgtcagcgtcgccaatataagtcagatgagccaccttggttccatcatctattgtagaattcttaacctccacaaagtcgcctatcttaacttcagaaccaactttggttccgggtctcagatatgcaaaaggtccgacatttgtatcagagcctatttcactgtcgatacccacagtctccaatatcttagtattattcccaaccttgcagttattcaaagatgtgttggagccgataacacagttttcaccgattacagtgtctccctcaagaactgttccgggatacaaaacggtatctcttcctaccttaacatttgttgtaacctgaactttgtcagggtcaataattgtaactccggcaagcattaaagcttcaactttgcgtcggttcaaaatctttccgacctgtgacagctggagtttatcgtttactcccatagtctgttcaagatcggtgacatacgctccgaccttttcgccttcgctcagcattatttcaattacgtcggttatatagtattctccctgggaattatcattagtaattttagacaaggattcttttagtttttgaatatcaaagaaatacatacccgagttaacctcagttattttctgctcatcctcagaagcgtctttctgctcaacgattctgacgatttcaccgttttctctgactattcttccatatccatacggctcgtcggctatcgcagtgattactgtagcggctctcatctttttgctgtggtcttcacgcaccctctttaaagtctcagcctctatcagaggcgaatccccatatagaaccataacagtgccgtctacgtcctttatgctttcaataccctgcataacagcgtggcctgttcccagctgttcatactgataggcatacttcgccctgtccccaagatatgctttaacatcttcggccttatgaccgataacgacgatattttcatcgcttccggtttcttccgcagtatccaaaacccattccacaagggcttttcctgccgcctgctgaagaggtttcgcaatatttgatttcattctctttccctcaccggccgcaaggataatgctatataatcccatttctattcctccaaacaaaattttatatcacaatttttgcattatatcataagatagtattattttcaatacctatcacaataattgatatccggtatgcctagcttaataaaatactgcctagagcatatgacagttatattataaactaaaaaaatattgcataattatcatagcagactattttcctatctcagtattcctaaatatggattttactaatctattgtgcagacaatccacgttatattttcgcctgcaatttttaattatatatctatataagcaaggaagacattataaaacgattatgtaaatatgcttttagcaaattacttttttacgtcataacaagtcgcaaaattgtaattttattacttatatacaaatttcaaaaattatgttataataaaattattaattttgcttgactgggaggatttattatgagaaagatatttccgattacagtgttagttattttactgttaatatccgtatctgtaaacgcggaaaatataacaacgataactgatctctatgatttcagcgatgtcggagaaggtaaaatcactgaagatattattctgcctaataatttgtatgttcacgcaagcggcggcagcattaccgtgaatcccagcgtcaaaaagtttgagggcagaacctacgtcaaccgggcggttctaagcccatgtaaaaatgttgaaaatcccgactgcgccgtgagtattatacctgaaaccgacagtatgctgtttgttgatatgtataacgtggcggcggaaggatcaggtctcagaagctttgaggtgaagcaggacggtatagtgttaggctcgttcatccttgacggcaaaacaatgataaccactgagcctatgcaggttaaaaaaggaatccctgtatacatatatgtcaccggaaaatatgggcttatcttttacggcgccgggctaaagtatgatacagtatctcctgacgcggttccgggaattcaaggcggcggaaaaaagaccaccggcgccaggggaaataaaaacataagcgtctatcacgttacaagtcttgcaaacgacggcccgggaacgctgcgtgacgccgtatcgcgtcccggcagaattgtcgtttttgatgtctgcggaacaattaacttgaccgaacgtttgaaaatcggcaactcaaatataacgattctgggacagactgcgccggggcagggaataaccattgccggaaccgacgttctgattgcagcagataacgtcatagtaagatatttgagagttcgccccggagacagtgttgaaggtgaatgggactgtttgggcggcgcgcacataaatgatattgtcttagaccattgcagtgtcagctgggggattgatgaacttatgtccctgtacggcggccttaatccagacggcgctgacaccggtaactatacaatttcaaactgtctcatatcagaaagcctgcgtctgtcaaaccattataaaggcgcacacggttacggagcgatatggggaggaaccaacacaagctactataataatattatagcccatcatgacagcagaaacccaagacttgccagcaatgtaatctatactgagctaaaaaataacgtaatatataattggggcggcaattcaagttacggtggtgaatcgactgctgaaaacttttatacaaaagtcaatatggtgaactcatactacaagtttggaccgagcacaaaggcaaagtataagatatttgacgtctcaggaacaggttcgcactattatataaacggtaactacgtttacggctatgaatcagaaaataacaataacggcctgaatgacaactgggcggacgaggcgctcattcataacatggctaacgcggttagggaaaatgaaccgttcgacatgggagagtataaagtgaatgaagtcagcgccgaggcggcttatgacaaagctgtaaaaagcgccggggcagtcttgccggttcgagacagcatagacgcgcgtgtggttgaggatatgaaaaatcagaccgggcgtttaatcaataaggcatatgaggtcggcggatacgttgatatgtccggcaaaagcagaatatttaaaatttccgagtcttggaaagaagcaaacaacatgggtgacgcggatgaaactgatataatcagcgagggtttatacaaaggatatacctggcttgaagcttatgtgtttgatgagattgaaaaactgtcgtataccgaatccggctggacaaattcaataacgccgaccaatcccaaaataacaatatcaaaagtatcagacggaacgcaaaccgtaaccggatatgcaaatatttatgacaacactccatatatttcaacagacaaaagaagtatagaatacggcgctgtatccgaacctgccgaaggtacaaaaataaccaaaattgaagtttacgacggtgaacaattaattgagatgtcagagggaacagaggcaataaacataacgattaatctatctaccggcactcattatataacaagccgcgcctataacgacaaaggtgaaagcacgtcgtcggacacatcaataatatatatccgcgggctgtcagacggcgagtggctatatgcagatattggcagtgtgccgtataaaggcggatacactcaaaacgaggacgggttcagcattattgcgagcggttcagtcggcggaaacagcgccggcaagatggattcgttcggttttatgtaccgtgagtttacaggggactttgatataatactggaaaccaagaatgtgcctaagtttgaaaacaatgttaagtcgggacttatggtgaggagcagcctggacagcagttctgaaatgtatcttcttgcggacagctggctgaagtatggcgaaaacataagggtttttgaaagacccgtaaaaggaacggcggttacaaactcatatatgtttgacgctgagggcaccccggtagagaatgttgactcaataacatacgatatgccgaaatatctaagaatgacaagaaagggacagcgactaacaatgtccgtctcggaaaacggaactgacttcacagataatataagacagccgtatattattgaagacacaacactgcctgaaatggtttatttgggtgttgctcaggattcatgcagttcatcaaccttgataaagtatgcggcagaattcggatttaacgtgacattatcagaagcggaaaaaaatactcagctaaaaatatatgatgaaaacgggaatgaaataaaaaataattctgttattgaaaatgactctgttttatcaaagatagttattcccgacggcgttgacacaagcaacagcgtaatatacaccgcagtatacagggacgaatgccttacagacatgcagacaggaagcgatgttaaattacctgtaagctccggagatttggtaaaggtctttgtttgggacggcaatatgcaaccgctttatacagaggaataatttattaaaacagttgtttaatttagaataaatcagacgccttgattttgtggaaaactccaaaatacacaaggtgtctgacaaattataaaaaacattttaatgaaaaaacaaaaatgggacaagccccgcaatatcgggggacttgtcccattctcttaaaaatttggtacaccttcggggattcgaaccccggacaccctgattaagagtcaggtgctctagccagctgagctaaaggtgcatatccttcgcttttcagcgaacaacatatgatattatacagcaaaccataaaattttacaatatgtaaattattctaattttatcaaatttatttataaatatttggttaaattatatatgtgtaagtataaaacatggtgttctgatttataaaatatatggggtcatataaaaattttactttataattctataatttataaaacatatataaccccataaaccaaaatgcaaaacaactcaattcacattggcggttggcagattgattgtgacccttgtgaatttgccatactcactctctatgactatagaaccgccgtggctttcaattatttctttagctatggaaagaccaaggcccgtgccgcccttttctcttgttctcgctctgtcaactctgaaaaatctgtcaaacacatgctctaagtccgcttttggtataccgtgaccgttgtcctcaacctttatatatacttcattatacatacttccggcggccacattcacatacccgcccttttcaccgtatttaatagaatttgatactatatttactatagccctctctatctgttccgggtctgcgtacatctgcggcagctcatttgccggcagatatttcagttctatatcctctatctccgcttcaagcgcaaacctgtttactatcccccgcagcatttggtcgattgaaaatacctgttttttcatttcaaatttctgtacgtcaaattttgacaaatccaaaagatttcgaactaaagcagtcattttatccgcttcggtttctattgtggacaaaaatttcttcgccatttttttatcatccatgtagccgttcaaaagtgtttcagtatgggttttaattataaataaaggcgttttcagctcatgagatacctcggcaacaaactccctccgcgcaacttcaaggttgaactgctcagtaaagtcttcaaatacgcaaacgattccggcggtcttgtcgttgtccatcttaaacggaacaaagtatatgcggatgtgtttaccgtcatatgttatatctcttatttcggtagcgtatttatccaaatacataaactccgccatacaaactccggcgttcagtttttcaaaaaacgggtcaaattctgaaactgaatcagaatcaatattaagcatatccgccgcagcaggattgatatgtatgagtttttggtcagtgtcaaacgccattataccgttggtgatatgctccaaaataacgtcgactttatgcttttcagccccaatctggcttattgttctgctcattacactgcccatatggttaaacgccttagaaagcgcacctatttcatcgttgcgccctgtttcggcaggaaggtcatatattcctcttgcaaagctgtcggcgcgcctggaaagcttccgcagaggcacggtcacagaacgggaaacatacacagccgtcaaaactgccaaagctattcctgcaagaagcgtccataacaagacccacagcagttggtttataatatcccgcaatacgtttttattatccctgatatatataatataaccatcggccgtatcagtcaccggcttaatatagtacgcatagtcaagaacatcagaagagaaattactgttgcttccctttgtgtgcttatcaagcgcattggtcaggtttggagttttttgaactttttcctgcataagcgctgacggagcaatcacttctcctccggcgccggatagaatataacatttcctgttttcgtccagctttaaaacagaagagtatgaatccagcagttttttaatctcgtattgctttacaaactctcttttcgacgagttcagaatagtttgaagagaatcaggcagtcctgactgtattgcagagtccgcatgagcaataaaagaattttcataattccgggtaacacaaaaaactgccgcaacgccgaatgcggcaataagcagtataacaacggccataaacaaagcgaccgttctgtatatcaatttgcctttaaacatcactatacctcacaaagtagtctatatattaattatatcattattataaagaccgcacaagtataattttctttgtttgacaaaaattttattattttaaaaaagcattgcaataactttgcatatgctgtataatgtacttactgtaagaggtggattctatgggaaaggctgtcaggataaaaagagtggttttattgtatttagttctgattgttttgggcattgccgccggatatcttttgcttaacggaaagcttggccttcggtgtctgtttcgggatttgaccgggttcaagtgccccggctgcggcaatacaaatggtatgctggcgctgttaaacggagattttcttgcccctgtaaaattcaacttaatgttttatcctgaagtattcactcttttatacatattgatatatctgccttacatatatataacaggaaagaatttttcaaaatacgctgccgccgcgcttgttactttggcggcggtatttataacatggggaataattagaaattttataaacttatagaagggactgtaaaacatgaaaaaatgtaaaaactgcggtcaggaatttgaagacggcgcaaacgtttgcccggtatgcggagctgcagataacggtcagtccgcaaaagtttgtcctaactgcaaaacagaagtaagtgacaattcaaatttttgcaccaactgcggcacgccaataaacggcagtgcacaaagcaataacggggacgctcagaacaacgcaggtcagaataatttcgggggtcagaactatcgccagccgccataccagccgcctatgaactatgttccgaaatcgaggctgttagcgggtcttttgggaatattcctcggcggtatcggagtacacaatttttatttgggatttactacccgtgcggttgtacaaatagtggtaactttgattacctgcggcgtaggaagtatttggggatttattgagggaattttaataatatgccatcagataaatcttgacgcttataacttcccgctcaaggatgactgctaaaaagaattgatactgcttaaggtttatggactgtttgcaattatttgtaacagttaacaaaaatagaaggtcagacaattaatgaccatcgagagaaatattttatagagcatcagactatgatgctctatttttatgcaataaaaagtctgcaaactaaaaaagtattatgtcaagtatatcataaataaattatataaaaaaatggtatttctagtgaacatcggcaggtgtgactgtgaccgcagctgaaaggcgcgtgttatcaaagttacttgttttgctatagcctgcaatgtcattaatatgtatactcaatgcaaacgtagtttgccgcgttaggtgagttatcatctgaacacgtagtgttcattatataactttactttgtatatgaccccatataatatttattattttacttataataggtgtttgaaccatttctttttctggcaagaaaaagaaacgcttcaccaaagaaaaagtgcttgctcgcttaggtcgcctacggctccaaggggcgctcgctccccgctaatttcatcttgaatctgcgcttcaagatgaaaaagccttgttactttcccgttgactttgtatactgccgtgaaaatagatattccgagttcctattttatttaactcatcaaaaaagctggtcttcgacgaacatcggtagggcggcaatgccgccgcgttaggtgagttatcatctgaacacgcagtgttcattatataactttactttgtatatgaccccatataatatgtattattttacttataataaatatttgaaccatttccttttatttaaacattcataataataacattatagttaatggcaataatttaaatactcaatgcagatgaaatctgcgtataagccgcgcagataattgatttttgcgcaaacaaaaatcggagcaagctttgcttgctccgatatggtgccggtgatcggggtcgaaccgatacggtatcactaccacaggattttgagtccagcgcgtctgccaattccaccacaccggcaaatcttaatttgacacgcgtattagtataccataataaaatataaaaatcaagactttttttagaattattttaatttttccggctttttatatctgaaattataagttttatatgcgtaatttgttcctgagtaagtccggaaacgtcaattgtcagcttattatcaaggtctaacaggtaatccgtagagacagagaaatacttggctatctttatcagcatatcgattgacggctgtatgttgtcattttcccaatttgaaacgctttgctttgtaacacagagtacttgagccagctccacctgacttattctgtgtgacttacgcaattctcttattttttcgctcaacataaattcaccgccctgtcaattattataatactataatataattgtcgcttgactaattaaaaatactatggtattgtaatagtggacaaaattaaataaaagttagtttgacaaagccaggtgaaagttatgaagaaatgtattttatgcggaagagaagctgaacagctgacagaaactaaatataatggcaggaatattaagatttgcgatatatgcagattcaattttgagaagctcaatgataaaggaaatataaaagggatatgtgaagctataaattattttaaaaaacttatgtctgaaaatcatgagtagacagacttgatttttcccggtaaacgtatataatataagaatataataatattcttgggagtgctgggttatgaaaatatctacaaagggcagatatgctttgagactaatgatagatttggcgataaacggcgaaaacggactgagttctacaaaagaaatagctgagcgtcaagatatttcacgcaaataccttgagcaaataatgacaattttgaaccgtgccggattcgttaaatctgagcgtgggtcaaacggcggatacagactaacccgccgtccgccggagtatacagtcggggaaatcctgcgtctcaccgagggcagcctggctcctgtgtcctgcttagacggtgatattaatacatgtcagaggcaaagcgcgtgcgcaacccttatggtttggaaaaaacttgatgacgctataaaaagtgttgtcgacaacacaacgcttcaggatttagtcgatgagcaaagactgttagataccagcagctacgtaatataaaaaagtttaaaaaaggtctttacaagttgaaaattttgtgttataatatctgtcgttgctgaaatatgggggtgtagctcagctgggagagcacctgccttgcaagcagggggtcaggagttcgattctcctcatctccaccaatcagcgaaagccggaatattccggctttttttgcgtctaaaattctcagttctcatacggaatcatgacggcacgttatggcacaaatttagttgtataatggctcttaacaaaatgaaaaggagctatacatatgaattatataaccgaaataaaagggtttaatgatttgctgctgagagagcggctttcctcgggacagattgcgctttggtacgctctcatgcatatagacaataaaagcggctggaaaaaatggtttacggttccggttatcactttagagctccacaccgggttgtcaaaatcagggatatacaaaaaccgtgaggttcttaaacaattggggcttatagattttaaggcttttaaagggaaggccgcaagatatacgattaattcattctgcgaagattttaaatcaataagtaataacattgctgaaaagtgtccaagcggtattgcagatagcaggcaagaaagtaatcaaggtagtaatcagaggagtagaccattatataaacaagacaaaacaaaacaagacaaaactattttaaaagaaaataataaaagaaaagataattcagataaaaatgtttatggaaaatacaaaaatgtttttttatctgatgaggaattttcagagcttaaacaattctatccaaacgattggtctgaccgtatagaaactttgtcagagggaattgagcttaagggatacaagtataaaaattatttactggcgataaagaaatgggcggaatacgaggggcagaaagctgacagaggagtagttaaatcgcccggccttaataattacagcgatggcaataagagtgattatgctgagatagagcggatattgatagagagaatgcagaacggatattaattcatgatacggcagtatattgtccagatattgtcataaaagcaatatagccgtcctcgtgcaaaggacgactatattattataatgtcgaattttgtgacaaccgtttaacggttaccttttatctttaatcagcaagcttgcttgcggagctgtctctaagtcagtcgaagagagcctactttaaattatttttataatagtatctttctcttagtttgtcaagatagtttttaaaaaatgtgaatttatgttgtaggattacaatagatgtgttacaaatagaaaaaaagaatacggaaaactcataaattgtgttatagttatatcaccataatatcacatacaagaggttgcattgatgttttcccacaaaacaggggttggtgtcaatgccgtttctgaaatattgaacgcagcatttaaaagaggtatttttgacaggacgctgtatgagaagtacaaaattctaacatcaaaagggatacaggaaagatgtatgaaaatgtgctcaagaaggaagcgttttgaagtcgagaaaaaataccttttaattagtgtacccattagccttgaaaatgtatacataaagggcgaaaatgttgacatttctgaagaaaatgtatacatttttacacaaagtaaagtaaaggaaagaaaagtaaaggaaagtaaagtaaataaaataccggccgtgcctgaagagagcaaaaaacaaaaacacaagtatggaaaatataagaatgtgttattaacagacgaagagattaaacagctgagagaaaaacttcctaatgactgggagaagtggatagagacattttcggaaggcctggagcttaagggatataagtataataatcattatctagccatactccagtgggaggagaggaacaggcggaaagaaaccggaatcagaaaaagcaagtttaataattatattgacactaacaaaactgattatgaaggtttagaaaagaaattacttgataacatgttaggggaacagcgatgataaaattcacgataagcggaaggctgccgagccttaatgattatatcaacgtatgcagacataacaaatataaggcggcggcatttaagaagcggattgatactcagataatttctgagatacggaaacagcggataggcaaagcgaaaacgccggcatacatagaatttttatgggttgagaaagacagaaggagagaccttgacaatatatactcgggtaaaaagtatatattagacgcgctgcagaccgccggagttataccaaacgacagtcagaagtacgttatgggtttggtggatatgattgcttttgacaaagcaaaccccagggtggaggttacgatttgcagtgtggatgtttaactgtatttagagaataaaaaacgcagatatttaatctgcgtcttcgccgccgggaccgtctcggcgttctctgttatcagggtaatggtccatgttagtgctaacccactggttatcggtggcggtcttttctccgttttcagactgatgtgtggggtcgggttttctcttattcatttttatcacctcaaatatagtattgccaatatttgctgaattattacgggatttatgcggaactaaaatataatatataaaaggaagaaacaaaaatgtgtaagttaaagagtgggattattttaaaagataaggtgtttgtgccgtactatgatagacatacaaaaatgttagaagaattaaaaatatccgatacattgaaaatgctaataaattatacgttcgcgcggagcttataacacctaacggagacgtctttagtccgattgatgactgaagtttttatgatgaccaggatattattccgcattagattgtagaaaattatgaaaaaacgtgtgtgattaaagcgattaagatttgggttggagagcacatatatatcaggaaatcaaatttttttgtagacaaagagaattattactttagatcttgtatgggagtgttatacggcaacagcagagttagagcctgcggcgactgtacggtttctataccttaatggtctgccaatagtattgagaatattgtgcttatggaaaagttcacctataaaaataataagacaaaaacaatatactagagtgaaaatcgaaattagtcgctgttgataatgttggagggaaaaggtgaaatctgataacggaaaaccaaaacctacattgtgcccggcaaaaataattactgcggtagccaggataagagagtgtagaataaaaaagtatggagatagtgacagctggaaagatgttgagccgcaaaggcatatggacacggcttccgggcgctttgttgtatacataaaagaccctttgggcgtagatgaagaaagcgggctgccgcacttgtggcatttggtttgcaatactgcgtttttatataaattggaagatagaagcagcaatgatagctgaagatatcaaaaagggaatttatgagaaatagatatgttattatttgtaataattgcgaatatttggatataaccaaagacgtacacaatatgagtaattataaaaaactcatatgtggaagatttacaatactaggttgttacatttaaacgcacatccgattttatatctgtgtggtagttgtaaagatgataattataaagggttcgtattttataaagattaaattcaagtattatgtagtatatcattttttattttctaaaaaatctttttgcactgttattgttgccaatgtgtcgccgagctgtgtaaatattgcggccagcagcggcagttcttcaggctctgctgattgtgaaatgcttgctgcaatcgcggttaccacagcagtaatagcaatggggtccatacaaaaatcctcctaaggtttatattgtatattatgtaattctattttacttgtgaatatgataattttatttgactgggtgctgcaaaacttatgacagacgttgtcaaatacatgcggcctaaacttgagagaaatactgaaaaggtaataactaaaaaataaacgattattttgatgcggtccagcataaaagtgagctccgaaactaaaagtaattataagttttaataaatgagcagattgcctagacgttatcagcccaaaaaatctatataaacttgaacataatttatgtatgcagacatttacttagttaaacgctataaggatttaagacataaaaaacggcgagtctttatatggcagcgctctgcctgccgatggtatgttccgagtaaacaggacaagcgattcaattatgcgtaatgctttacttttaactgaaatatcggtgcaaattgaagcgatagactaaacaatatcctggttattaaatatgacatatgatgaatggatagaaaacctgacagacaaacaaaaagaaatatttgacaaaacacgttgtaatatatagaaccaaatcagctgcaagaaacaatatgcgaggtataccgaggtttgggttaaggagaatgtacctaaaacgtttgacgagttcccaaatataaagtataataaaattagtaaatataaagagttgaagttaatatatgcagacacaggattaaaaaaaatctgtaatacatataatcttaaaatacttgaaggtaaacatggcaaacacgttttgggataatatagaaactgttataagtgatagaacagttggatacagcttaaatgaaattgacggttctgaaaacgaaatgagagctataaaaattcattatttaaaaaaggaacatatatcatgccgagaaaggagtaacagatatggatttatgtaatagattgagagaaattgcagaaaaatatacacttgataagaatttaacccttagagtgatttgtgttgaagttacatattttaccggcacaaaagaacttataggaaaatatgatggctatattcaagcattggataatgaacccgaaatagcacaattagaattgaagatacctcaatatgcaaatggtattgtatctttgttagaaacggaaattaaatcaatagatgtaataaattaagcatctttgcgaatacaaggtgcttttattattcaaaaaacgaggtgataacatgatgtcaaaagacacaacaaattaataagcaattgcaataataaattaatattgagggagccgtagaaggctcttcttttgttacgaaaagaaggcgggattatatgagcggaagttaggggaattaactgtaagatttgcgggtgacgcgtcgtcattaagttctactatatcttaggtgcggccagaattatccggtatgaatgcaatgtcacaaaaaggcgtgaaaatcatcgcagagcagacccggcaaatgggcggatatgataagatagtcgcaaagccggcctaaagtctaaagcaaaagcaaagtatattggctgaaacggaaaaagagtataagaaaaatactaaacagctgaacgaaaatataaaagggctaaacggtcagaaatcagctataggcagtcttatgacttagaaaaatctgagattcaggctttggaatctgccaatgcagggcttgataaaagcagtcaggcgtataaggatggtgtattcgccgttatatctaaatggattattgtcattttcagttttacccatatggtttccgaatgcgtcatatggataactttttagtacggcttccgtttgtagttgatattatcgaaatatgtcggttttctctgtatacataaaaaactgaaacggaactatgtcaattttttatgcgtacacttgtcaaactaatggtttcttggagggcgtaaattatacgccctccaaaacaattttagttatactctttgttatccttagtcccattacagctgacagtaaaatacttattttaatatctgatttccttccgaatttatatagtaattaaattaattttaatccattatatcatgttgttttgttaaataatcttcttctaattttatacgcgtattaattcttctataattataaagctgcgtataatcacccacctgtctcgtatgtatatacaatgcttggtttacaagatataaatattcatatgctgttatattttcttctaattgttccggatatatattcatttcatattcgcttaatgcgtttttacaatttatcattcccgtatctatgcaaaactgatagtatgggttacatacttcctgattattttcataataatactttgctatatataaatctgcgtaaaatcgtgaaccgctggatgttgataacattctgcatattgttacaaatgcttcattatatgtcatattattgtcaaagtttgcatataatttcccgtcttgttcttgtcctgttattaaattataataaaataaacttgcggctaatttatagtcatatgacaatggttctatatcagaaaattcaaattttcgtgcagtcctataatttccataataactattcattccatataaccacgcctctttttcaagttcatcttttatttgctctgctgtataaccgctagttattccaataaagtctctatcatatgtattaaaaacatatgatatttttaatgcatctcggcgagtaattaaagaagtttgattccaacgtgattcagcatttctaactatatccaaactttcaagattttctattgctgttaactcattgcctagtttgaactgctcctctgaacttaactctgagacatgcgtatcttctgcaaaaacaaatacatttgttaatattactattatcaatacataaactatttgtttcatttttttagctccttttatcttaaaataatgtcatactagataaagtgtttatttagtaatgttactcttggcatactgcctaaactttcctcgtttaattctcatgagatcgtataaggcaaatactgtattcatgcaccataattgtttccaatatatgacttatgcataaaaaactaaaacggagctatatgtatttattaaccatttaaaaaggaagtatttgatggattgttattttaaacagttaattaattttatatatttaaaaacctttcggtgttttttattccgttttagttttttatgagtatgcttgtccttttaaatatcatcttgtcaatttgttaaaattaaagtattgctgttttcctcataatctactttatatcctatggctgcacagaattctcttattgacacatatgtatcatcaatattattattaaattttctttcatatctttctattgaattttcttcaattattttcttaaatttctcttcacttaaattatcatatatactattttttattccaagataattaactaatattctatcgttttgaaacaagtatggatatatagaattatcatataaatgtccgtttatatttaaatacagatatctttttctagcctcaaaaccctctctctttaatattatatattctccataagtttttccatcatattttaaatcacatcctgccttttcaggaaacaatttattgtctgcataatgtaaattaatttggcattttaataaatttgaaattatttgtttatatgctgctacatttataggcatatttaacatttcaaattgagtttcagtttcatcaattaatttatatttcaatgcttttttatatacttcttcatctgtaaaaatataatctccgagttcttaaatacattcttctcccgaaggttctaaacatcggatgcaccaagttaaaacttcacatattttagccttatcatatggtctcacttcccagccagcattgtttttcagttctaatttaaccattccaatggaccacgaatataaaacatagtcataactataaaaatcatttttcggattatagtcaataaatggtctgcctaagtacattcctcccatatcaattaaatcttctgtcaaacctataattttcattatgttaacaatacagtcttctcttgtaaaactatcattctcataatttttatacaatatcaattgctctgttagttcatcagtatttatttctgttttgtctaatgcatatgaatttattgagaaactttgaaatatcgcgcatgttattaaaataaagaatattattttacttatattatttttcattttctatccctttcaatcattatcatactgtatttaattcaggttcaactattataaattttttaatttttctatgcaaattatttgaatagaatattactattttcattttataaattcagttaatatttcatcatttttatttccaatttttttaatcaaaacgtttataatacaactattctctttatcaggatacataaatacaggcacaatattttcatgctcatttctatatcccataataaatttatctatatttttatttgatgtaattttatagcttgttttatttatttcctttttttagataagtttttcaaattaacttttatactaaattattatataaatccatatgtttttacatcacttgctaactcttctgatatattataaaattctgcaattctttgtggtgaattattgttcaaaaacagattataaattgattttgtaataatacttgatatttttgttcttatatttaaatgcgattttgtatagttatacataacaaatctatatataaaatttaatacaactatcacaataactatagagactaaaataataaaactttaagttttctcatttacgcatgttcctcactctaacaatataaacatacgtattttatatatcttgtccatataaataataatctgtcaaattagaatttgctttttcatctgtatgctgtgtatagtatatatcgtcattatcagcagaagttattattgaagcatattctatatttccgtcttaataataactataggtaaaacttaacttcacagcttcattatacttccggtttgtaacctttgtcaacaaatataaatgtaatcgactataaatggttgattatgtgaaagttaatgacgagaaatttgtttgcggtgtatatttcgccttctaggctgttttgttgaaatgcttaagtcattttgatatactgtcatcaaagaaaaatgggagataatggtatcaaaaaatcgacaataatatttctgataactgtgtttattttatgtctgagtttatatttgaagacagagctgcctgggtgaccgatattaacggaaacagcagtaagattaataggcggggcgaagttattcttccatttgctgtgcttgcagtttatgattctcacaacatactggttggtaatgaaattaaaactcttgaaagttttgaagacggagaaactcaaacagttgtttttgatttggattccacggatacacagagaatatgtcgtctttttatttgggatagtttgcaaacaatgcgtccggtttctgttcctgtagatatagaacagaatgaataaaaatattgtgtaaaaagaatgactgttaattttattgacttatttaacagttaatatgtttattatactatggggggattaaagcatgaaaaagataattggtttgttattaactttgtcagtatctataggtattttgttatttagcgctgattccgttattgcggcgtcttataacagttctgctgctttaaattacgccgcggctcattggaatgataacgttggtctttgcgccgagtttgtttccaactgtttgagtgcgggaggatgcagtgcatggagcaggagcagcagcgctttaagaaatcagctgataaattccggacttggaaccgagtatgaattaaccttgaattcagataagtcaattacagtgtcgaactattcagggaagttagctgccggagatgttattttttattattgtcccggagcgaaatgtttaacttttatatagaacagatgttaattagacaactgctaatattaaaaagtagttgctattttagagattttaaaatttgaaatgttataaataattagagtgcagtttaacttgatgtaaaggcgaggtatatatttagtaaatttatttttaatttgctgtgtattatcagaacaaagaatttagttttataaaaattaacagaaccttagtgaatactagagttctgtttttttgcatattttatattaattgcgctatatatttgtattggttgcgattgtttttctatagaatataaaaccatctgtttgaataatatttttacaaaatatatataagtaatggttttattatggaattatataaaatgaaaaatagtatacatataaattaaatttattgcgtcacagagcagaaggctattcgccttctgcaacaattttttccaataccgcgataaggtctgacatagtattcagctgtacgtctttttcaagaatagcattctttaatgcgattggtaagctttcaaatttatcgcgtaagtttggagctacatatgacataaaaatcacctctgaagtatatagtatccaaatgtcagataaacatacagtaaataaagttcaaacaatgctttattaaaatgaaaaagctgctttgttattcaaaagagacttattcacgtgttaatatataatataaattagcataaattttagtttcagggcgttttgaatgaggagaataaaaatttttgcaggtggattgtatttttgatgatatgtataatttgctttaaaataaaatattaaaatttaaatagctaattttcagatgtattatttaatcagtcttttatgcttattaatttgacataggttcgtcatttatatcagcgtatttaaactttatggaaaaaccacaaagcattattcacgcagttattagactgcataaatttgcgtctcccaatttatcaaagtcaacatgccaaagccatgatacatcctttctattatttgcaaggccgtttatcgcagagataaaattatttttttataatcatctgcacaattgattggctcgcatagtcggaatttatattacacaaagtattatagcttgtaaaaagtttcattattttaacataaagtctccgcgataaagaatttatgtgcgataagtcacatatctttttgtacgagaaattgataaaatatctttatattttgtcaaaggatgtggagaaatggaaattttaaaattgtactttggaaaaactttatactataaaagactttattttggcataagtcaagaagcaatggctgaaaaatgctgcatatcattaaggcagtatgttgatatagaaaatggaaagagattgccgtcattcaaaagtttaattaatatcataattaaaagcggaatagatttggatgagtttattaaggagattcaagaggagggatatactccggaagattataaaaacgtaaaaaataattgataagtttatatcgttttaatgaattaaaaatatgatataaaaccatatttaaaacaaatagtttccggttttattgtatttgatttgaactataaaatttttgattaagaaactaacgaatttattatttttaaaatggtgtttaaaagtaaatataaatttgaaacagccgactgcattactgcagtcggctgttttattatatcagtagtttgaacacgaaaactgcccggcatatgttataatttatcctttatcttacatttctgttcactttacagcaatttttcattttttactgctgcgtgaaaaaatctgaagccgtataatagactgtaattataaaaatattttatttgaggttaagaaaacgtcagtatatactgaattaaaactcgtatagaattatatatgaattgtcaaaaaacgacttccattgcagtcaatatataagaaatagtgctttacaaaaaattttgtcagtgttaaaatataactatagaatataaaataatgtggtggtacatatgcatgatatatggaatccgtggcatggctgcgttaaatgcagcgagggctgtgataactgctatatgtattttttggacaaggcgcatggaaatgacggttctgagatatataagactaaaaatggctttcgatatcccattcaaaagagcagaggaggtggatataaaataaaaagcggcgagatgatacgggtttgcatgacgtcagactttttcttagaagaagcggatccgtggagagacgaggcgtgggagattattagaagcagaagcgatgttattttttatttgcttaccaaacgcccggaacgtgtggctaagcatttgccgaatgattggggagacggctgggaaaatgtgttttttaatgtaacttgtgaaaaccaaaaaagggctgatgaacgtttgcctatcctgatggagctgccgtttaagcataaaggaattatgtgcgctccgtttattggtccgttaagcattgaaaagtatttaaacggcggacaaattgagcaggttatctgcggaggagagaattacaatggagcgcgtccgtgtgattatgattgggtcaaatctctacaaaacgaatgtaaaaaatatgatgtaacgttttgttttattgagacagggacggtttttataaaggacggtaaaagatataatattcccaataaaagaatacaaagcgagatggcgtataaatcgggaatcagttatagcggaaagaaaattaagtttaatctaaagagtaggtacggttacaaaataccggagagtgaaatgtatgttccatatttcagagaagtgtgcggaacctgcggcagcagacctatttgcaacggctgcggtaactgcggcaggtgcagtcaggtaactaagtagtgcaagcgcttaaaaaggaggaatgttatagaaatagttaagtttaagacgcacttgcaaaacgtttggacaatatttattatagtaatgctgcaggacgtttttaaatggttcatccggcggaaaatatctgtcgtaagagaattaagcatactaaatattatcttcttaatttaaagttttttgtgttttagagagatgatagaagtgtgttattaaatcagctgaaaatctttaaacatttgtatgcgaaaggtattgctattgagtttatagctgtatatggtattaaatataaaaaaatatagagaaatgaggtataaaaatgaaaaattattattttaagtttttggctgtgatattatccgctgtgatggtttttggtacagtttcggttttttcggaacctcagaattcagaacctcagtttgaggaattatcgcaggattttttagactatataaatttggatgaaagtgagagaagcgggattgtcgctccattcccggcagaaatcaaacaagagcataataatgacgctgttctcagcagtgttttacctgaaagatatgacggcagggattatgagtatttacctccggtaaaaaatcaaatgagcaccggaacttgttgggctttttcagccacaacagcgcttgctgcatcaatgcagaaacagtatccgggaaatatttttgacttttcggtgcgtcatatggagaattcagaagctataaacccaaatgatttagctgaccctgattctttaaaccgttatgtggacggcggcgggtatggtttgtctccgcttggatattttatgagaggagcaggacccgttgatgaatctgaaatgccgtttcagaataatattgaagcagaaaataaggcagaccttttaataaaacccatcgctcaggtaaaagaagccgaatatatgccgcataaggaaacttttttactacccgataccactgatgaatttattgctgaagctaaatataatataatgaaatatggagccgctggatgtgcgtattatagttacgatccgttatataatatggacaaaaactcattttataataatcagcgcggtgcctatcaaaatcatgcggttactataattggttgggatgataacttttcggctgacaattttgtagcaaaaccgcctgcagacggagcttggataatacaaaacagctggggttcggattggggagacgatggatgtttttatatgtcgtattatgacgaaacgcttgatgaattaattttttatcaggattcaactccatatttggaatacgataacagatactatttagaccctgcaggatggacaagaggacttggatatcctgacaacaacggtatttcttatgggatgaatatattcgagaagcttccgggagaagaggctttaacagaggtgactataggtgtaagaggggatacggattattctatttatgtgattcctgacgctgataaaatagagccggcgtcttatgatacctcaaaagaaactccggtttgcacaggcaataccgaccatgccggatatattactgcggagcttcaaaaccctgtgattttagacggagaacgttttgcagtgatagtaaaatacagctgcccgagttatatatacagcctgccggttgaagccagaattaaggtatatactgaatactatcatttagctgctgagccgggaacaagctatatatccgctgagggtaaagactggacagaaataagcaacgagaaatatgattatgccaattgttcgataaaggcttttacaaaggatatcacgccaaagacagaagtaacgtttgagactttggacccaaagggaattatgagcgtgtatgacaaagacggcagaaaagccgccaagaaagccgacggcagttttgctttgccgaacggtaattatacttatgtccagagtacatatcattgtaaagatgttaccggaactttttccgttagcggggaggaaagtataactgttaaagtcgaaggaaaaatggagcccggagactattctccggaattaattaaaagaacttatgagtatgaaaaagaactgaacagcgatgggtccctttcagtaggatttgatttggggaaaggaactttagccgcagaaaacgctgttgcgtgtgacgaggggattccccttgaactgggtgcagactataatatctcagggaacagtattgttttgacgcctgaatatttaaatgcagtacgcaattatatgatgcctgacggcggttcttgggtattagaaattaagtttgatgatgataaattaacagaatatcagtttgttataaagtttgaatccttaacggtggaaaatgttgctgatgaactgataaacgaattgagaaaggcaaaacccggcgctttatctgcggatttggttgattcgcttcctaaatttatacaagataattttacatttctttttaatggagatcttgaagttgagtcgtctaagaattataatttcgtgacctgtgatgttatagttatgtcaaatgacggtacatataaacgtctcgtatatgataatcagatgttatataaagttgtcatggcagtagaaaaatcgcatacgttaactgtgcgcggatatggagatgtttcgggtacgctgtttatttgtcaatatgacggcagcggtttattgattgactctaagccgtatactttggaacttaaaaatggtgatgagctggattttccatatgaaattgttgaaggaagcgttagaagggaattctttttcttcgatatgaatacgcttgagcctttggcaaaatattaggttttaaaatgtgaaaggaagcaagatgcagataaacagactgtttgagataatttatattctgctcaataaagaaaccgtgacttcgaaagagctggctgaaaggtttgaggtttcagccagaactatatacagagatatagatattctttccgcggccggtatacctatttatactgagaagggcagaaacggcggtatttctctgcttcacgattttgttctcaataagacggttctgacgcaggaggagagaaacgatattctgtcttctcttaaagctgtcagcgctgtgggggcggaccgaactgatacagcgcttaaaaaacttggcgctatgtttggcggaggagcggattcctggctggaaatagatttttcgtcttgggcggattataagaaaactgccgagacgtttgaaataatcaagtcggtcattattaataaacaggtgatagagtttgagtatttcagcggttcaggcgagagaacaaaacgtgaggcagagcctttaaaactatgttttaaaggtgggtcatggtatctatatgctttctgcaggtttagaaatgattttagattttttaaactgacccgcataataaacgtgaaaataaaagaagaaattttcagcaggagtgttcccaggaagattttcacagaaaaaaatagtttcaacgatgaatttatacggttgaagatgagaatatcgaaaaagctggcttacagagtttatgatgaattcgacgaatattatgcggataaggacggcagtttcattgcctatataatgtgtccaaaggaccagtggctttattactatatctcaacttttgggaaagactgcgaggttttagagcctaaagaggttcgcagcgggtataagtctgaaatagaaaaaatattaaaaatctataaacaagaataataagttgtataaattaatagattaaattagtatatagttggcgtgttatatggctgtatggatgaatatgaggcaatgtatatgaagaaaaacaaacgtattattgtaacagttttattaatagttttgctctctgctgttatagcggccgcaggcaaggaatgctatgattttgagcgcagagcatgtttcagccggctgaccggatacacagaagaaattggcagtgatataaagagaacgcttgagagtgacagaaatattttaaacggcgctgcaaacataataaaacagtatgatatttcagagcgtgatgagatagtaaaaatcctttcttcctttgagggaatgggtttaatttcgcgtttggagcttttgcttccgggcgatatgatgcttacgggtgacggagaaactttggatatgtcaggagtgctttcttatcaggaggaactgtcaaagggtgtgcatatttctaaacgcgaaaaagattatcaaaatcagtataattatatattaagacaatgtgttcctattgagcgaaacggtgaaaatgaagccattattattggtgtggttgaccttaataagcttcctgtatattttcctgccgcagattatggcaatgagactcagatttatttggttgaaagggagacgggcaattttttgcaggacacacagcataaaacgctggggaatatgtatgggttcggcgatagaaagaccaaaaaaggttacagcagcgaccaatttgtttcggatattgccgccggaaaatccagctccgcgatttttttgtctcaaacatcaggcgagtatctttattcttacgtctcacctgtaggcatacaagattggatgattttgcttagcatcagtgaggatgaggtgttttctcaggcaaacgtgatgatgaggttcttcttcggattagctctgtcgtttttcctcattgttttaatttattttatatggatgattaaggatgtcaggcgtgaaaatttaaagatggatgaacagctcaagaacgttcagtatatgcttgaagttgaaaaggaattgtttgacgcgcatttgcatcctgagaattttaagagagcacttaaaaaggtttctgattatttaactgcagaagcggcgtttttttggataatcaacgggcattccgatattaagtattgttataacggttcgggcattgtttttgatatagatgaagataatgaaatgtctgaattgttcccgggactttttaatattcttcttgaaaggggcggcatattaagctatgatatgaaggctgttgctgaggaatttcctgtcggaggaaagaacttggctcagtttaatattaacaatcttatgcttattccggtatcaggttcaggaggtgaactgacaataatatttggcgcctgcaatatgaagcgccgttgggaaagcgatgttccgctgagacaggtttctctaagcttttttatggctttaaaccattatgaagctcattatgagctggagagacttggaagaatagacaacttgacagggcttttgaacagaaacagtttcagcgccgctttggaaagattatcgagtaataaaccaaagtcgtttggctgtgtttatattgatgttaacggtcttcatgaaataaacaattgccttggtcatcaagccggagacgatatgctgaaagctgtggcggatgcattaaagcgaaattttggcgatgacggcgtttatcggattggcggagacgagttcgtaattttaagcgaaaataagactgagactgtgatttcagagaaaattaaagctgtaagatacgaacttaaaaatcaaggttatgcgttgtcggtgggaacggcctggaaagaatcttttaacagatacgatttgataattaatgaagcagaagcaaaaatgagagatgataaaagaaagttttattgtgaaggaggagcggtcagaagttcacgcagtttggataagcaggttgaaaagatggttttggaaaaacaggacgctgacgcgtttctctcggttttagctcctgaattcaaaggggtatattttgtcgatttagacagggatacagtcagacatctctatataccgttttattttgaaaaaattttaaaagagacaggtgatgtattcagcaaagccctgctgctatatgctgctagaaatgtaagacctaaatatatagagtattttaaaagcgtgtgtgattataacggtttaaaaatgaaattgagcgataatataacgcctgaatttttatatcaaaaaaaggacggctcctggctgaagcttagaatattaaaatttaagaattacggagagaacagccatgagactttgtggatatttacggattcggaatccgaaatacaaaattaaaacgtttaataaataatcgtcagattataaggcgcctttcacggcgcctttttgttataacaacattccgttcatggataagactgaccaatatttttagattaaggggtataaattaattaaaaatgattcagttcaaagaaacggattatggatttttatattattgagtatatcaaagcaaatgaatgtcatagaattatgtgtcaatactgagcggcaattttcatcaggatttctaacgtgtttacgggaaataaaaatttgatttgttttgtcaaataaaagataagcccaggttggttaatatattattttataaaatatgacatgctgttgtcatattaatagtattataatagcattatcaaaacttaggaggtaataaaatgaaatatgaaatcgttgagttggaacccaaaaccgtggttgggataagcgcagtgacatccaataacgaccctgaaatgcagaaaaaaataggtgacttgtggacaaggctgtatccgggcggagaaatagccaagataaaaaacagagctaacagtttcgctataggtctttattcagactaccagggtgataattattgtgtgacggcaggctgtgaggtaactgaagcggataatgacgatatggtcataaaaaccattcccggaggaaaatacgcaaaattttctgtgcgcggaaatatggttgacgctgttgccgaggcgtgggaagaaatatggaaaatgaatcttgaaagaagttataaggcggattttgaggaatatcttaatgaagattttgaaaatgcagaaataaatctttatattagcttataaaatttgttttaccgtccgccggattaatttaaaagattttcccggcgggcgataattaaaatggcttgtttattaattatatacgagcgaatcatcacatttgttttctcggctgtccgcccatttctcaaattcgtttaaaggcagaggttttgaaaaaatatatccctgaaccatatcgcaattgacgcttttgagaaaatttaactgttcagaagtttcaataccttccgcaacaacgtgtatgttcagccttttggcaaggtctataaaacttatgattatattttggctctttgagtttgttatatcctcaaaaaattttcggtccagtttgattgcgtcgacattaaattcttttagaagtcccagtgaagaaaaaccaactccgaaatcatccaatgaacatagaaagccataactatgcatttggtttattgcgttttttaccagttctatttgttggttatcaaaaaatattgattctgttaattcaagttcgattactccatccggaatgttatacttgtttttcagctcaataaacggacgcagataatttaaatttctaaaatgtacccttgaaagattaacagatatggtaaaaagtttttttccgctgtctattctttgcttttggtattcacataccttttcaaatacataaaggtccagctgtattatgtttccgtttctttcaaacagaggaataaaatctgacggatagataatcccgcggtcgggatgaaaccaccttacaagggcctcagcgccgcctgtttcaccgtttttaaggtttattttgggctgaatataaacgtgaaaatcattgttttttattgagtcgtcaaacagactgcaaagtttctgttccataatcattttatttgttatctcagagttataaaatgaacaatctgaaattttattttgaagctgacaggcagtgcgggcgcggtcttgaatcattcttatgtttaagccgggctcctccactatatatgcgccttgtgagatttttatattatgtggaatatcagagttttgcgcgtatgaattaatatcggttatcatttcatcaatgcgtttttgtataacgtttttgtcaaattcttttaagcataagaaaaagtggtctgcttcactccgcgttatcatctcgtcttctttaatatggcggcttaatactttatgtatatatctaatagtatcattgccggtttcaattccataatttaaattgataagtttaaaccccttaatattcatcattataacagtataagtcatgggcggtgattctgaaattaacttttgacactccaattgaaaagcggagttgtttaaccctccggtaagactgtctgagaatgcaaactttttaagccggttttcactttttctataatatctgaatattataatcagaaacaaagcaaagataagtacgacgataccgactattataaacgagtgcaatatatagttgtttgcctcgcccgatattaaatcagccggaacaagagtcagcagtacccaattatttatgcccagcggatgatatgaaagaataaggcgcgaattgtttacggaagtaaaattgaatactccgggttctccgccggacatatgacttttcatttcttcaatagcattttttgtcttgttttcatctttggccataaatatgctatcaagctgaataaacggctttacatctgtaggtgaaattacaaccttgccatcattgtcaataatacaggaaaggccgcttccgttaaagctttttggcgcgattaggttttgtatgttttcttttttgcggacgcccgccagaacttggttaatcttaccgttagattctacgggaacggaaaataccaggctttgaccttcgatatatgtaattgatttttcgccgttatatgaattctttatgccggataaattgtttaggttttcagtatttgagggaatagttttattgtttttatcaagcaagataagagaatcgaaatctaatatttctgcctttctgtttaaaaattcttccagcaaatcttcatttggtaactttttaatagagtcgctcaataattccaaagccagttcaaaagagtttagttttgatgatatatcattggcttgctgaaatgacgcgtctttgacataagaattggtgctgttttcaagaaccgtgtttagcccggaggtgttccatagcataaaagttattacagccgttagaattatagaaacaatacaggtttgaataacaggacttacagacatactatatatttttacgtcttgtgtttttttcattttaacaactcctgaatttctatatcataattattgtgtaataattttagcatgatttttttagtaaaacaataagatatttgagtacgtatacatatagttaattgttaaataatgaattttatgttataataatctaagaaaaacatttatcgggagaagagttatgaaagataaaaccaccttatttgagtatttatatgagaatttaaaagaacagatagtcagcggcagaattaaatgcggtgaaagtcttccgtcgatgaacagtgtttctgaacagtataatataggaatacggacagtaaaagatgttttcagagctttgagcagcgagggatatattaagacagaggagagaaaggctgcggttgttatctacagcgataataaagacagccaagaatcagcggttaagtatgtattggagcgtaaatcatttattgttgaagtttatcaaaccatggccttgttgatgcctgaactgttttgtttttcgtctcaggtttgcggtcagaaatatttagatttatgggaaaagagcttgagccgcagcaagaagaaagatacgcaaagcagatggagcgtggcttctgattttctttatgatattttggaaaaatcaaataacttactgttccgcgatttatttgttagtttagaggtatatgccaggcttccgcttttttcaagccatgacggatttattgagttagtggatacaaaaagtatagggaattcgatgtgggtaatggaatcattgcttaccgggaacagaagcgaaataatttatagattcggattaatgtatgacgcggtaattaacgcaatacaaaagtatttggatataatggccgaaaaaaatccgaatgtcgaagagggagagtatgactattcctgggcggctgaaaggggaagagaacattactatactcaaatagctcgggaactgatagataaaatcggaagcggaatatataagccagacacatttttgccgcatgaggctgaactttctgaacaatatggagttagcgtatcaacagtcagaaaagctattttaatgctgaatgaactagggtttgccaaaacgtttaatgcaaaaggaacaaaagctatgctgcagaataaagaaatggcgatgaaaagtataaagaataaaaaatacaagcgggatactttaatgtatttaagcgctctgcagcttatgaccataacggttaaggctgcggcggagtcagcctttcaaaacatagataaagatgttataaatgaattggatgaaaaaatgagttgtcatgattccataaatcttgattgtattcaggaatgtataaataagtatgtgagtttgcgtcctttaaaaacaatattagaggaaacgggtgaaataatttacgggggatattattatgctttttacagagacggcagtcaagccgcaaatttactgaattttaaaagtcaaaaggcatttgaatgtttaaaacatggggataaaaaagggtttgccgcgaagacttccgaatgttacggtcatatccttaaaatagtgcgtgattatttaattggatatggattgacagaggccaaaaactttgtagtgccggaataaaaataatatataattgattagctgtgctgaaaggtttgcaaatctaatttttattaaatacaaatcagataagtaaaaatatggcaggtctgaattattcagacctgccatattataattatatgttatttttataagaaataacatattcggaagttatgaagattctatatattttaattaaatacaattgtcgattttatttaggatatatgggataacaaaaaatacggcagctgaaaatcatctcagcataggctgatttataacagctgataaaatcggctgtacgtgaaacgtcctaaatgtttttatctgcttataaaaaagctcttggcagattacggcgacatagttagttaaataaaatttttaattttactctctgtgtttacatgaaataaatttatgaaattcctcaggaatattttcggcagataaattttcatgaaccgaacatgttccggcttcctttgcggtttcataataccagcatttataattcagcatatcaagcattttttgagtttcttcaatttgccgctcgacagctttcttttgcttagtgataatttcgagacgtctgtctatagtgccatcgccctcaatacataagtcaacgaattcttttatatctttgataggcatgccggttttttttagacattcaattatctgaagccaagacatgtctttttcctgaaacattcttataccgccgctggaacgttcaataaacggcagcattccttctttgtcgtagtatctcagcgttgacggagccacatttaatctctttgccatttccccaattgtataaaccataaccagtcctccaaaaaaatagaaaaattttcaaaaaaggtattgacttaaagctaactttaagttgtataatgtatttgaacattaagaattgtatcacaaaatttaaatcaagtcaatggaggaatagaaaatgagttttaatatgtatgtaccaacaagaatattatttggtttaggagctgttaaaaaactgcatgaacaggagtttccgggaaagaaagctgttatagtaatatcaaacggcaagtcaacaaaggaaaacggatatttggatactgtaaaaagtgaaatgagcaaggcgggagttgagacggttgtttttgataagattcagccgaatccgcttaaagccacagctgaggagggcggaaagttcgctcgtgaaaacaactgtgatttcatagtagccttgggcggcggcagtgttatggacgcgtcaaaagcaatagctgtttcagcaactaatgacggagacttatgggattatgcctttggaaagacaggcaaaggtatgccgataaaaaatactccgcttcctatagttgcagtgaccacgactgccggaaccggttcggaggtggaccagtggggtgttataaccaaccctgaaactaacgaaaaaataggattcggcggtatagatgagctgtttcctataatagcggttgttgaccctgagcttatgaaaactgttccgccgcgttttacagcatatcagggatttgacgctttgtttcatagtacggagtgttatattgcaaagtgctcaaatcttatgagcgatatgtatgctttaacggcaatagaaaatattggcaattatctgccaagggcggttaaagacgggaatgatattgaggcaagagagcatgtggctttagcgaatacattatcaggagttgtaatgaccttgagcagctgtataagcgagcactctattgagcacgccatgagcgcctatcaccaggatttgcctcatggagccggtctgataatgatttctaaagagtattataagtattttatcagccagcatatttgtgacgagcgttttgtcaaaatggctaaggcgctgggtatggaaaacgcggataaagctgaggattttatcactgcgcttgaaaaactgcagaacgattgcggtgtaggagatttaaaaatgagtgatttcggaattgagaaaagtgaagccgatgttatagcagccaacgcccgtgagacaatgggaggattgtttgaagctgacccgtgtgaattgggtcatgaggactgcgctgagatagttaaaaaatcttatcgttaataggaggtctgtttatgaaaggtctggtattatattactcatacagcggtaacacagaaaaagtggctaaaatgattcaaagagccacaggttttgatatagctgaaataaaacctgtcaaaaattatgaaggggactataactcggttgtaaatcaaggaaaaaaggaagttgacaatagggttgaacctgagatagtggatttaaaatgtgacttgagccaatatgataccatagctttgggctcgccggtttggtggtatacttttgctccccctgtcagaacagtgctgtcgggaaatgattggagcggaaaggttatatatccttttgcaacaaacggcgggtggcttggtcacacctttgaagatataaaagatatgtgccggggagctgaagtaaaaaacggacttaatcttaaattcagcggaactgctatgaagacaaagaaagacgaaatagaaaagtggacagagaatattaagcaaggcggtgagttataatgaataatattggtatttttccgagaggcggagaactgcctgaaatgttcgcagaatatttcagcggaaaagcgtatctcaatatgctcactgaaaaaggagtttctataggtaatgtcacgtttgaaccgggatgcagtaaactggattatgtagcataagagtgtatagcgtgtctgtagtctgatttttgccataaataagtacaggatacacagagaatagaaaagaatgtgtattcagttaaataagaaatagatagctggtatgagagaacaaggagtctttcataccagtttttttgtgggaaaagggataggttgcacaggatctgccaggagatttcagtaggtttgatgaatagctttcttccagaagtgtggtatagtcttgtgcttggaacaggaaaactacacagaagggagacaccgatatgacaacacagccagatattatctggaatgagcagtgcctggggatacggataggagaacaggtatgcacctatctgaaaaagcatgatgcggaataccagagactgcaaaagaaaatactggaacttacagagaagtatccagtgatagaaacatttatggagacgaatcagtcaatcagcctaacggaagaagagcataaggcagtacatcgatatttccaactggagagcgaaaaggaaatgatagaagaagagtaccatttttatatgggacaggctcaaatgatttcttatggagctatgctggggaaaataaaaaaagcaatactgggaaaggatgacggtgacacacagaaactgctggaattgctgctggatacctggattgatgaggtcgaagaacagctgaaagaaaatatagcgtaccagggaatgctggaaaaaatatcaaaatatgaagaacaagttcagacaatgggattagcaaaagaaaagcgaaaaacgatagacgcatatgttactgaagtcagtgaaagatggatattatatgcggaatctttatatcaggccggtatgcagaaaatcttagaactactgaatctgtaataaggacggataaaatggggaagcacgattgaacttccccatttgtcacttctattcgtctttgccatcaatgagaaatatgtatgaaacctgaaagatttcagcaatggcttttaattcaagatcagtgacataacgcttgtttgtttcgattctggtgattacatttttatccatatcgtaaccagctaactggagtttataggcaagatcacgctgagacatattgtgagtcctgcgaagctcaatcaaccgttggctgatcagattcttctcaccagactgtgtccttggctttggcattttaaatctcttcctctctggtaaaaggatggcttgtctcactttttgcaccatctgtattgattttaacgattggacaaggtagaatcggttgtaaaagtgagacaaagtagaagagaagggagaaatatatggagcaggcaaagatagaacagcttgcatttttatatctatgcagcgagcatgataaaaggttattgctgaaaaaagaaaaaatgccgttagctgattttgacaggttgacctacttgatttaccattttggttttaaggaataccatataaaagtgtggatggaatttgcaggagagttcaaaaaggaatgggattgtctggaagcacttcaggaaatgggggctgtgttggaaacataggaaatacagaatcagaaattagcttgcataaaatgtggatgcagaatttttgtaaaaatgcacccaaagaaagcagagaatggattcaaaaattgaattaaaatatgcagtagaacatttttgtgatatcattatcaatagagcagatttgtattttatgaatttgtaaaagaataatgaagcaaaaaggtgtgaagctaattatgagtgaatatgcagatatagtaattggaaatttatcattacattggtttagaaactatttggatagcaaaatcgttagtctgtttttttcaaaaaatgaccttattgtagtaaataattgtaatatagacgatgatgataaagatgccggaacatacactaaatatatgtataggacgactgttcggcgtgcaaaagaacgcttagatgcacagggatttggacttaataattttgaaaaaatatttaatgatgaaatggttcaagcagtagactactcatcttttttgtatcatttacagggagattatgatgaagaggacaagaataatgaaattcggattaagaaaaatgtttcattaaaaaaatggaaaaatgcaatgaaaaaaattgtttcttatgaacttgcaaatggaaacatacaatttggaggaacactttcagaggttaatattacaacagagtgtgacaaagttatattttattctttgaaagatgaggatagcgaatcattttatgctttaaatcctgaaataatcaattataaatatgtatacagacttatactagaatattgtgcaaatgatatggagataatattggatttctcaaatttggataattgggcagatgattgtattcccaaagcactagcagcgacagagaacgtttcaaaaacaattgttcttgttgaagggtcaagcgataaagatattttagaatttgcgatgtcacagttatatcctcatctttcagatttattttattttatggatttcagtgatgaatctggtggaaaaagagatggaggaacatcatatgtaataaaaaatcttaaaactttttatttttcaaaaattagagcaaattttattgcaatttttgataatgatgcagagggatattctagtaaatgctcattattaaatgaaataaaaaactggccggcaaattttagaatattattatatccagaaattacaatgtttcataaatacccaactattgcacctaatgggaaaattgtgcctgatgacattaacaagaaagctgcttctattgaattgtatttgccagattccattataaaaactggtgggaactattatccaattgaatgggaatcgagaaaacgaatacgaaataaaaataatgttgaagaagcattatatcaaggagtgatttcttataaagatgatataaagcataagtttcatgaaatgcgtaataaaattgagagaggtgatgaagtttttaaaacagaagaatggaaaaatatgaaaaaattactagaaacaatagtattcgcttttaataacgaacaataaatagcaacgtaaactaatgcaaatatcatgggcagggctcttcggggttctgccctttttctttttccagaccaaaagaccacctgctggaaaagaacaagaaaaacctgaaaggatgtggtgacttatcattataggaatcgatcatggatattatgccatcaaaactccccatgtgtgtttcccgactggactgaccgggtacgattatgagccgtataccatgcagaatgtcctgcagtacaatgggaaattttatgtgtgtggaactgggcggcagacgctggtgagaagcaagacttccaatgacaattattatcttttgacaatggcagccattgcacaggagatccgctaccgccggggagagaggaaaacagatgtggttctggcagccggcctcccactggcaagttttggcagggagaaaaaaggtttccgggaatatctgtttcggaaagagcagcctctgcgtttccggtacgaggatgagagctatgagatccggattcaggatgtaaaactgttcccacagggatactctgccctggctcttcacccggaatgtgttcgggacgagccttctgttcttctcgcagacatcggtggctggaccgtagacctgatgcggctggacaacagtgttccaaacgccgctacctgccgcagcctggagcttggtgtgatccggtgcgtggatgagatcaccgagcaggtacgcagaaataccggactgtctgtaacggacattcagatcgaacgtgttctgaacggccagagctgcagcatggacccgtccgcaaaagaaattattgtccggcagggaaggctctacacggagaaaatactgtctgcaattatggaatccgggttcgatctgaaagcaattccgtccgtgatcatgggcggcggagccagcattctgaaacggcacgtgacaccgcaggacgggttgtgtcggcagatttacctgacggacgtacacgccaacgcttccggctatgagcggattgtggggcagatgtgcgcgaagtaaagaggcccgttttctcgtttcgcctgaaccttgataacccggatcaccaaaaggcatggaagattctgcaaagtgttccggatgggcagaagagcagctatctggttcaggtgatcttaaaagatcaggaaaacaaccagctggaggaaagcatccggcaggcaatccgggaagaactggcaggtgtttccatttcaggctccggggaaagtgtttcaaataaggaagaaatcccatcccagatgctggattttctctccggattagagaatgcattctgaaaaagtcaagtcttttccggtgataaaatagccaaaattcaagcagtcaaattagtataaatcacggtttttgaaaggggtgatgcctattgaatgttattagatctgcatcctttgggggcttttgaaagcctcatattcgttgggtattgtgaatagctttctgtcacgttttagggtatgttgtgtgtagaaaaaagaaaggagaacaaacgcagtggagatgaaaaacatatgcggaaagattccggtagagctgcatgagaggctaaagctggaggtcgaagagttaggaatcagcataccaaaataccttgaaatggtaatcgaagaacacatgacaagaaaaggagaaaagacgaacatggcagagttaagaaccgtagcagtacaggtaaccgaggatttattttccagactgaaagcagttctcgccaaaaacggcatgaaacagaaagacttcctgattggactgatcgaagaggcactcgaaaaagaggaagccaaatggaaatcggaaacagaagaaacggaagagccggaagaagaaccagcagaaacggaaatggaagaagctggggcagaggaaacggaacctgcggagccagagccggataaagagccaacaaagcctgagctggaagaagctggaacagaggaaaatctgacagaatcggaagcagaagagccggagccaacagagccggaaccggaagaatcggaagccgaggaagagccgacagaaccgaaaacagaagatccagagaaaacagagccagcagaagtagacgaagaagaatcagccgaaacagaactggaaacggaagagccggaagcaacagatccagaggaagcagaagaatagacatcaaaaaacagaaaacaagagattgagacggtgcagagaaatctgcactgtttttttcgcagcgaagggaggctgatagccggaacaattcgattttttgaccttttcagcggaatcggaggattccgagaaggactgcacagagcagggggcttcacctgtgtcggacactgtgaagcggatgcgtatgcagaccacaactaccgggtgctgtttgatacggaaggagagtggttctgcaatgacgcaagaaatattgaaacagaacgaatgccggactttgatcttttatgcgcgggatttccttgccaggcattctccattgctggacgaagggagggatttgccgatgcaagaggaacccttttcttcgaagttgccagactggttgcagataaacgacctgcgtattttctccttgaaaacgtacccggtctgctttcgcatgacaaagggcggacgtttcacaccatcctcagtacgttatctgaactggggtatcatgtcgaatggaaggtgcttaacagcaaggatttcggagtcccccagtcaaggaagcgggtgtatattgtcggatatcttgatgaaagatgtgccggaaaaatattacctttcccaaaaacaaatggaacagctcttatacaagtccatgctggcaaacagggagaaagagtctacgcagaagaaggactgagctgcacgctgaccagtggggctggcggcatgggcggtaagaccggattatatgaagtcggtatcccaatcaaggaaaataccagaaaagggtacaagatggcctacgagggagacagcattgacctcggctatccgggtatcaacagccgcaggggaagagtcgggcatgagatcgcccatactttgacgaccggaaaccagcaagggacactgcattttgtagatatctcgcctccgccgctggtgacagatgttgcaaggtgtctgaataccagacaagattccagcatccataaccacaggggcgaaagttccggggtgctggtggaagaaacgccaagggcagtgctgacaccggccaaagaaaaagtccgccagaatggaagaaggatgaaagaaccggaagagccaatgttcaccattacggcaaccgaccgtcatggcgtgatctaccacggcagaatccgcagactgacaccaagggagtgtctgcggctgcagggataccgggatggtcagatttccaagatggaaaaagaaacatcggataaccagctttacaagcaggccggtaatggtgtcaccgtcaatgtcattgaagcaataggcagaaatttgaaagcagtagatgaagagatccgaagcggctcacctgttccagaagcgaagggtgggtgaagcagatcgatttaaaaaaccagtatttcggtacagagattgagatgacaggcatcagtcgttacaaggctgctgccgctgttggaagaatgttcggaacagagccatattccatccgctcttacagctcatggtgtgtgaaagacccggatggaaaggtctggaagttttcctatgattccagtatccgttgtcagtacaaatctcacggaagatgtttgaatgctgacagcgactatgctacggaaatggtatccccgaaattggaatattcggaaatggggaaactccaggaagtggtgcggtgtgtcaaaaacgcaggtgcttttgtcaattcatcctgtggcatgcatgtccatgtggacgcatccaatcatacaccaaggagtctgaaaaatgcactgacgatcatgtactgcaaagaggatattctgttcaaagccttaaatgtacagaccagaagggaagatgagtactgccagaaagtccgtcctatggtattggagaagatccgcaggatgcccaacagcaccattacaatggaaaaattcaaaagggcatggtatgagggaaatgacggaagctccgagcattacaactggacaaggtattatgcattaaacctacacgctgttttttccaagggaacactggaatggcgctgttttgaaagcaccctccatgcaggaaaagttcggtcgaatatcacactggcacttgccatatccgcacaggcgatcaaccaatcttgtacccatgcaaaaaagacggagatcggggataacccggcatttacgttccgcacctttctgctccgcctcggattgatcggggacgaatacaaaaatgtgcggaagcatctgcttgccaatctggacggcgataaagcatggcggtatgacaaaagcacctatgcctgtctgcagaatccaagacggacagacgatgcaaggtaacagaataacaggaacagacaggccgggtggaaacatccggctgttcttatgacaaataaaaagaaaaagaagaaagaggtagaaaacatgaagagtaaatatcaattcaggcgaatcctttccggggtgatggcggcagtcaccatcttatccacggtcatttcaccgctgaccgtttatgcttcagaagagccgaaagcggcagaaccgccagtgtatgaagctgtaaaggatctgctggatgaaaatgaagtggtaaaagccaccgattttgaactggaagttggacaggagtttgatgtttccagtgaccgcacgaatctggaaatcgaggatgaaagcaaggtcaaggtgacattccagaaagcagagaatgacgccggggagagcttcagtaccagccatgcggacacttaccatgccgtttattatgtggaaccagtcaaccagaaccatccggtttatcagattgggagaaacctgatcgtaaaagagcctgtggcagcgtctcagagtgaaccacagacagaacaggcagttacagaagaggatacaggttctgatgatgaggaagctgcctcgcaggaagaaactgagacagagcctgtagagacagaaattgttgagccggagacagctgaatttgaaacagaggaagcggagacagaagaaccggaagaaacagaacccgaatttcaggacggactttccgaatccgagtttgatgctgcattagaggaatccgaaacagaaaatacaaccgatgaagaatccgggctgacactcagcgatgtcctggagcaggcaggggaacaggatattgacctgatggcaatggaagatggggaaaccgtttcattcaccgcagtcaataccagtacaagagtaacacgggacgtaaatgtgacaagagggactgcatactattatgcagactacggtctgggttcctacgtaacttataaatatactgtaaaatttggaaacgtgtctgcaactgcctactgtgtgcagccgtccaaggcaggaccaggggatggtgtctataagattaccaaactgggtgacagcaaagcactggcaaaagtatgctactacggcacaaaagcatccggcgaaaatggatttttctcagagaaacatcctgatttttccgctggaaaacaatttatcattgtccatctggcagcgtcttatgccaataacagcggtgacgctttttccggtacgaatgcaaccggacaggctcttgcaaaagaactatatgattactgtatgagccagccggagataccggaagtggacatgagtttctccaatgcaaatgttaccgcatatatcagcggcaacaaccagagaacagaagagatcaccttcaaggcatccgaactgcagaccatcaccatgaagctgccgtccggtgtcaaactgcataatgtgacaacgggaaaaacaagcagtgcaggtgcatccgtggagatctgcggcggtaccaaattctacttatctgcaccgctgacacaggcagtgaatgtcaaaggggaatggtctgtcaccatgaagggaagcatcatcaaagattattccgcttataagatcacaaccggaagcgagacacaggaccttgccctggtatttggcgagggtgtgaccgatgagaaatatgtagattttaaagtatcatgggtaaaacaggcaactctggagatcgtaaagaaagaccgtaagagcaacaaagccatcgcaggtgcagtttatggcgtttatagtgacaaggatggaaagaacctgatcacaaagatgccggccacagatgccaacggagcttccagcgttatgatcaccaaaacacaggataccgtatacctgaaagagatctccgtaccaaacggatatctgctggataccaaagcctacgatgtgaaactggtcatcggggataccgtaaaacagaccgttaccgatgcagagcagatggcaagcctgaccgtttacaaattaggcgaagtcctgaccggagcaaaggtgaccgatgatggtgtttcctttgtttatacagagcagaaacaaaaaggcgcggtttacaacgtttatgctgcagaggaaattgtatccgcagacggaacaatcatctacaaaaaagatgcactggttaaagccggactcaccaccggggatgacggaagtgccacactggataagctatatctggggaaatatgtggtaaaagaaatgcaggcaccacaaaatctggtatgcactggtgaaagccaggagatcaccctttcctatgccggaagtaatgtggaaaaggtcatgggaagcgtgacattcaaaaatgaccgccagaaagcaagcgtgagtgtatacaaacaggataaagaaaccaggaaatatcttccgggcggcacttatggtctgtatgccggaaatgacatcaaagcagcggacggaaccattgtggtcaagaaagatactctcattgagaaagcagtgaccggaacagacggaaaagccgtatatcaggcagacctgccgatcgccaacagctactacatgaaagagctgggtgcaccagctggatatgtgagaaacggcgaggatgtgtactcctttaccttccagtacacaacagacaaagaggcaacggtttctttcaaccatacgttccagaatgagcggatcaatgcgaagatcaaactggtaaaagaggattccgaaaccggaaagaccgcacagggagatgcaacacttgagggtgctgtttacggattgtatgcccgtgaagatatcgtacatccagatggacagacaggtgttctttacccggcaggaacacagattgcaaccctgactacggatacagagggaaatgcagaagtcgcagacctctatctcggaaagtattacgttaaagaactgactccgcctgtcggatatctggcagacacggaagaacatgatctggagtgtaatgacgagggagatctggttcagacggtagaacgtaccgtaacttctctggaagatgtgatcaaacagccgttccaggtcatcaaagccgccaacaatggaaagaccgatgccgatctgttaaaaggtgtgggattcagtgcatatctggagagcagcctgaagaaaaataaggacggttcctatgattttacatccgctactccggtcatgctgactgcagacggacagacagaaatgttcacggatgagcgtggatatgcatgctccattccgcttgcatacgggacttacattgtaagagaaaccaccacaccgcacaacttcaaaccagttgatgatttcaaagttgtgatttcagagaacaatccagagaaaccgcaggtatggcgtgtgcttctggacgaagagtttgaagcaaaattaaaaatcgtcaaaaaagatgacgagacaaagaaatctgttctggttccgaatactgaatttaaggtatacgatctggataacaagaaatatgtggaacaggtgactacttatccatccactacggtacataaatcctattttacggatgaaaacggatacctgatcctgccacagaatctggcttgtggaaattaccgcatcgaagaagtgactgcaccagatggatatacccacagcaccaataccgtggaaatcaaggtagacagtgataccgcataccaggaagatccggtcagcggtgacctgatcatcgaggtggattttgagaaccacccagctaagggcagactgaccatccgcaaagaaggcgaagtagtcaaaggttttgataaagattttacttatgaggaagccagccttgcaggagccgtgtttgaagtttacgcctccgaggatatctataccgcagaccatcagacagatgagaacggcaaccgttatctggaatatgccaaggacacactggtggcaacggtaacgaccgatgaaaccggaagtgccgtaatcgagaatcttccgctcggaaaataccgtgtagaagagaaaaaagcaccggaaggatacacctggaatgccaaaggagaagaggtaacctttacctatgccggacaggataccccggttgtagacgaagaagtgacatttaccaatgaacgccagaaggtaagcatcaccgtggaaaaacaggatgcagaaaccggaagcgtggtagctggagccgtctttggtctttataataagaatgagatcaaatccgatgacaatgtaatcgtgaaagcggacaccttattacaggagattacaagcgatgaaaagggacaggcacacttcaccctggacctgccgcttggaacttattatgtaaaagaaatttctgcaccggacggttttgtatcctctgatgaggtactggaatttgatgccacctatcagggacaagacatccagaccattaaactgaaatcgattaagaagaaccagccgacgaccatcgaggtgacaaaatccgatctgaccacaggcgtggagttgaacggagcatccctttctgttctggatgaggatggaaacgtgatcgacagctggacttccgtaaaggatgagcctcatgtgatcaaatatctgactgttggaaaaacctatatcctccgtgaatcccttgcaccgcatggttatttaaagactacggatgtgaaattcaccatcgaggataccgcagaaatacagaaagtggaaatgcaggaccatgtaccgaaagcactgctgatcgtaaacaagaagggcgaattccttgataagatcaccctgctggataacgtcaaaggtgttgtggaacatttctttgagtacattacaggaagcctgacagacgttaccttcgaaatccgtgctgccgaagatatcaaagcagctgatggcgtaagcccggactattattccaaggacgaactggtagcaactgtaactaccgatgcaaacggtgttgcagaagtatctgaccttccggttggaaaatattatgtcaaagaggtaggcacagcatatggttatatcctggatgaagaaccacgatatgtagatctttcctaccgcgatcaggataccccggttgtcgtatacgatgaggactggcagaacaaccgccagaaggtgaaagtgaacgtcctgaagaaagaaaaggataccgaccgtgtattaaaaggcggcatctttggattgtacactaggaacgacatcctgtccgcatctggaaaggtgctgatggaagcagataccctgatcgagttaaaaacaacagatgtagatggaaagatttcctttattgcagacctgccgattgacggaacctattatgtgaaggagctgtatgcaccggatggatttgtcaccaccggagaagaacaggaatttgtttttgagtaccagggagacaaagaagcagaagtgtcctatgagttcgtatttgaagatgagccgacaaccgtggaactttccaaaaccgatctgaccacaggcgaggaactgccgggagccagattacagctgacggatgaaaacggggctgttgttgaggaatggacatccaccaaggagccgcacatcatcaaagaattggttgtaggaaaatcgtacaccctgacagaaaccaagccggccgatggatatgccactgcggaaagcatcacattcaccgtggagaatactgtagagatccagaaacaggtaatggaagatgatgtgaccaaagtggagatcagcaaaacggatattaccggagataatgagatcgaaggagccaaactgaccatcacagatgaaaatggcaatatcgtagaaacctggacttccggtaaagagccgcattatatcgaaaaacttccaatcggtaaatacaccctgaaagaagagcaggctccaaacggttatgtcgtttcggaagagatcaccttcgaggtggcagacaccgcagagatccagaaggtagccatgaaagatgataccgcaaagggacgtctgatcattgagaaaacggacaaggataccggagctgcactgaaaggtgcggaatttgaattgagggatgccgatggcaaagtggtagaaaccctgaccactgatgaaaacggtcatgcaaccagcggactgcttgcaatcggaacttataaggatggcaaatttgataaggcagccacttattatctggttgagaccaaagcaccggaaggatatcagctggatgagaccaagcatgaagtgacatttacttatgtagatgacaaaaccccagtgattgaagtcatccagaaagtgacgaacgagaagttgccggaggacaccccgtctgtaagtaacccgaaaacaggcgatgacaccaacctctggattccggccctgtgcctgattctttccgcaggcggtctgattggtatgagtgtggcatccagaagaaagaagaaaaaagggggcagataggctgaaacaattatattttgcgtatggaagcaacatggatctggaccagatggcatatcggtgcccaaaggcggaggtggtagaaaccgtccgcctggaggggtatcgactgacctttgcagccacaggaagcggtcttgccaccatcttcccggaagagggaagccatgtggacggcgtcctctggtcactgaccggggactgcgaaaagagcctggatctttatgaaggctatcctgatttttacgacaaacaggaaatcaccgtcaagaataaaggcggaagagagatcaaagccattgtctatatcatgacaaaagattacatgcagaactttaatccgcccggacggtcgtacctgactgggatcttaaagggctgcagacagaaccaaatcccgacagagccgatcctgaaagcagcaaggaaaccgcctgtgccgggaaagacacagaagagtcagccaaagaagcagagaaaagccggacaggaacgatgaagaaaaaaccaaagacaggaatcttacagaggtttttcaagatcatctgccttgcagtgacgctgacaagtgccgggtttctgatttaccacatggtatatcttccaatggagaacaaaaagctggtggcagagctgaaagggaatttcccggagccggaagctccgggagcctcaggctctgaaaagaaagaccaaccagctggaagaaaatgcccggtggctgcggtagaccttgtttctcttcgggaacaatatccagatgtgcagggatggctgacaataccggacaccgggattgattacccagtgcttcagtacgaacaggagaatggggagttttacctgaaacggaattacaaaaaggaatatgacatcaacggaagcctgtttttacaggcagactgcaaagtgtctgaaagtcggaaccttatcatttacggtcacaacatgaacagtggggcaatgttcggaaatctggacttctatgcagatgaaacatattatcaggagcatccctttgcttatcttcagacagaggatagcattcaggaatatcgaattgtcacggtgctgaaagcagacaggaatttgttcccgttccaacagaaacttccagatgtggcggcagtgcaggagtacttaaaagcagctaagcagagggaagtgttcgaaaccggagatgattacctgaagtgtatatacgataaggttttgacgctcgtcacgtgttcatatgaatggagcggtgccaggaacatcgtcctggcggtgccggtttccggggcagtgtggagtcagaagtgttcgtaagcacccgaaaagtgcagaaaatgagacaaataatgaccgcacgggcagggatgtgttcaaaacagggggattatgtaagggtgtgcattggtagtatttaggttgaaaaaagtgtctgaaagtaccagaaaagtgcagaatgtgagacaacttataacccagatccggcagaaagtgttccagaaaggagcgtttcctgccgttattatttacttggaaaggatggtaacgattatgaaacgattttatacagcagaatccgtaacagaaggacatccggataagctctgcgacctgatcgcagacagcattctggacgcgtgtctgaaagaggacgaaaattccagagtggcctgcgaggtgctggcgaccaaaaggaacatcattgtggcaggagagatcaccagccgatttgagccacaggtgtttgaaatcatcaaaaaggtgctggagagtgcaggctatgaagcagaggaaatccacatggatgccctcatccacaaacagagtccggatatcgccggggcagtggagagatccagagaacgaagggcagggactgtttctgttcagagcggacttgccagcggtgccggggatcagggcatcatgattggttacgcctgcgatgagacaccgcagcttatgccgatgccagtggttctggcgaaccgcattgtaagggaactgtctgcaagccgtagaagcggatatatcacgggaatcttgccagatggaaaggcgcaggtgaccgtggagtatgaagatgacagacctgcccggctggataccgtcattgtgtcctgccagcatgaaaaggaaaaatcccttcggaagctggagcatgagatccgggagaaagtgttacgcccggcactccgtatgctgccaccggatgaggataccaagatcctgattaacccatcgggcagatttgtgtgcggaggtctggatgcagacaccggactgaccggaaggaaactaatggtggatacctacggcagcctggtacagcatggtggcggtgcattctccgggaaggattgttccaaagttgaccgttccggggcgtacatggcccgttacatcgccaaaaacatggtagctgccggacttgccagccgatgccaggtgtcccttgcctatgccattggggttgcccagccagtcatggtgcaggtggatacctttggaacgggaaagatctgtgcggatgactgcctcgccgcagcgatccctctggtgttcgggcttaccccaagccagatctgtgacaccttgcacctgaagcggccaatctaccgacagagtgcggtgttcgggcattttggaagaaaggaattcccgtgggagaaaacggataaggcagagcagctccgggataccgtgatgtaatgccgtggattccggaagaagaaatcaaacgtgcaagggagatcaccgccattgaataccttaagaaatatcagccaaaccgtctgaaaaaatcttcagccagaaatgaatgggagctgacagaccacgacagctttaagatcaacgagcagaccagccagtggcactggaaatccagagatatcgggggcaccagtgctttaaatttcctgattcatgtagacgggtgttcttttttggaggcagtgcaaatgctgaaagatgagtatcccacctatatccctcctccagtggaagcaaagccaaagaagccatttgtcctgcctacggccagcccggactgccgcagggtgttccgctatctgaaagagcggggcatcagtggcgaggtcttacagcggtgtgttcatttgggaatcttatatgagagtctgccctaccacaatgccgtgttcataggccgggatgaaaaccaggtggcaagatatgctttcctgcgtgggatttacgatgccagcggaaagtcttttaagatggaacaggccggaagtgaaaaggcatacgctttttgtgttccggcgaaatcgggatgcagacgggttgctgtttatgaagcctgtgtggatgtgcttgcccacatgacattggaacagagacagggaagccgggataagtaccgtctggagcttggcgggatcagcgcaccaaaagaagggcagagccagcggagcatgaaaaagccgcaggcattggaacattttctgtcccagcacccggagatcaccgagatcgaagtgtgtaccgacaatgactttgccggacggtgggcgtgtgaacatatccgaaaagcctacgagggaagctatcggatcatcgagaacctgccggaaatcgaaggggcagactgggcagacatggcaaaaatggctgcccgtacaccggagaaacggcagaatagggaagcgaggtgatgctttgaaagataaaatagaagtggaaatgctgtcacctctgatggcagagtttattccggactattcagatattgtgaatctggatgatgcggagccattggaaggacctgacctggtgcagtatcagacatccatcgcagaaaaggttgacgagatcaatcggctcggtatgcctgacaaccagccatgcaacctgatcgattattttgaccaaaacaaggacattaaggaaaaagtggaacgcattacaatggcggtaaaggaacaggagggcgttttatatggctgtgcaaacctgacactccgggagaatctgacaccagaggaataccgtgtggtggggcagtatctgagagggcagtacagcgatggctggggagaaagtctggaacagcgggagatcaaggtagacggtggtgaattatacttacatttctatgttggtgccggctcggatttccagatacaggtgaaagcaccggaaaacggtgtgcaggaaaagcagccggaacaaaagccgtcccgtccagaacttaagctcttagggcatgacggaaatattttctcaatccttggggatgccgcaagactgcttagacgtgccgggatgtccgaacaggccaacgaaatggcggatcgtgtccacaagagcagcaattactatgaagcgctgggaatcatcagcgaatacgtggaaaccgagctgtcggaccaccgtgaacagcccagaacgccaagaaaagaaacactgaaaaaagaggatacctgccgatgagcagttccataaagaaaagcacttccagagaaatctggaaaataagcgaccgaaaggatgatgcctatgggaaataccctgaaacttgaagatcttttaaaaccggactgtgtgccggatgagtctgccggaggggagaactggcgtatcctgcatggagataccttaaaactggtcaaaggattccagccggggatctttgatgcagttataaccgatccgccctatgcgtccgggggaaccaagcagaacgaacgcaaccgaactaccaaccagaagtacagcagcatgaaagcagaaaatgccctgccggattttgatggggataataaagaccagcgttcctggacccactggatggcagaatggctgtacgatgtgcggaaagcctgcaagagaggggctccgatctgcctctttattgactggagacagtacccgtccatcaccgatgccctccagtgggcagggtggatctggagagggactgccgtctgggacaaggggaactcccgtccgcagaaaggcagattccgccagcaggcagaatatattgtatggggaagcaacggaccgatgccgatcaaccgcccggtgtcctgccttccgggtgtgtttcgttatggaaatccccagaaccgcatccatgtgacagaaaagccgctccagctgatgaaggatgtcatccagatctgtgagccgggcggcctgatcttagacccgtttgccggagctggtactaccatccttgcggcggcagagtcggggtttcaggcagtcggcattgaagtgaccgatgcgtattataagctgggaagcgaccgtgtccgcattgcactggaagctggggaagaagcggaaaacaaagaaccacagtagccggatgtctggcagacatctgaaaaagagaagaaaagaatccagatgtccacaagacatccacagagcggaatgctttgtgggtgtttctttttggaaaaacgccgggcagaggaaacctgtccggccaggaaaggagatggtcgtattggaacaggcacttgcttatgtctgctgttctgcagaagaaggaaagaccaaagtacagcggtactgccggaagatctacgaactgggatatgtgccgatctgcccgcagtacagcttttccccattccttgatgacggggatgcagaggatatgcaggccatgcggagaatgtcccaccagatattaaggcggtgcaggatggtggtcgtctgcggaaaagagaccaccgggacgatgaacacggagatcagcatggctgacaggcttcatatcatctgtaccacactggatgggttaagcaaaatcaaggaaaacgagtgattcagagaaataacaggttcagaggggacgaagcaaaatgcgactggttttgcaagcatagcgtttggatatccaaacgcactttggggagaaccccaatcccccataccaagccgtaaacagacgaaaggagaacgaaaaaatgttgggatttatacttggcacaatgaccgaaggagtaatgggagtttttgcaatgtgtcttttcatagctgggaagcgtgaggatgaggcactggagcggtgccggatgaaacggaaggagatcatcgaccacggcgtgtgcatctgttttgtaaacagccagggagaggaactattccgtctggcagacggggaaagccttgtgcagaatgcccaaaatggagagcggaatgtatccacctgccattatctggatgccgattctgccatgatcgatgggaagaaatggaaccttctggaatttgcaaaagagatggaaaagagagggatcatgttcgccccgatggtgctgtgccaggtatcggaaagggggtgaggcccatatgaagaaaaaaatcattgctgcagcggtagccatcggcgtcctggcaggtttcctgatctggaaaaatcgtgaaatgtaatggagcaacaaccaataacccgttggaaagcaggtgaagagatgagaaaaagaaaccatgtgataccagtccgcctcaatgcgaaggagctgcgttttctggaagagcaggtagagaaaagcggcctgtcccgtgaggaatatatccgttcccttgtcatgggcggcgaagtccgggcaagaccctgtgagcatcatacggagcttttgcggaaaatatccggtctgtgcaacaatgccaaccagcttgcccatgtagctaacggctgtgggatggccggggaagagagcatccgggaaatgctccgcatgacaaaagaaacatggaggctggtcaaagaggaatggtagccgatggcatacaccagtatcatcccggtcagccgtctggacaattccatcacgtacatccgaaacaaggataagaccacaaaaaaagggcaaagtgccggctctctggaagaagccattgattacgccatgaaccgggacaagacggagcgttccatttttgaggatgccatcggctgtgtctgtgagactgcctatcaagatatggtagctacaaagaaacgataccacaagatggacggggtgcagggcttccatctggtgcagagctttgccaaaggggaagtcaccccagagctggcccaccggatcggcatggagctggcaaaaaggctcctgcagggaaaatacgaagcagtgatcactacccatctgaacacggagcattaccataaccacattgtgtttaattccgtgagcatggaagatgggaaaaaatatcacagcaacagcaggagttactacgaagatgtgcggaaagcttcggatgccttatgcctgaaatacggcttatccgtcatcgagccgaaaaacggcaaggggaaatcctacgcccagtggatggcagaacaggacggaaagccgacctggagaacctcgatccgtctggatatccgggatgcagtggcagagagcttcacatggaaacagttcctggatcagatgaagcagaggggataccagtggaagctgaaccggaagtacattgcattaaaagcaccgggaatggaacggtatatccgtctgcggagccttgggaagaattattcggaagagggcatccgacagtggatcttgcagccaaagagcaggacacctgctggaaaagaaggagcttcccgacccccgaaaaagaagttaaaagggatacaggccctgtactattcctatctgtaccagatgggtgttctgaagcagaaacccaaaaggatctccccggtgctccgggcagatatccggaaactggatgccaggatcgagcagatggaatttctccagaagcatcagatcaccacccgtgaagagctgcttgtctaccgaattccattggaagaacaggtgcaggcactcaccaaagaacggaagcggctctaccggagcgaaccggacagtgccaggatcggtcagatcaccgaagaactaaagccgcttcggaaggatatccgcctttgtatccggatcgaacagcagtccagagagatggaagaaaagatgcgtctggcagagcagatccagaggcaggcagaacaggaagagcagacggagaaaaacagacaaccgagaacagaaagcaggtgaatgatatgaattatggaggcgatgcggcggaccagatcgtccggtattcgctggacggcgtggaccacgggctcaggctttcgggtacgctggcaaagcatctggcggtatttgttgccgccgtattaaaagaccagaagaaaacgaggggcagaacccggatggtgcggatgttaaaggagaacaagccattgaagttctttaccgtgccgtccgaccgcctgagagaattctgcagtgagggcaggaaacggggactgctctatgtgatcatccgggataaaaagaacccggagatgagcgaggtcatggtctttgcggatgacgcagccaaagtcaaccgtgtcatggataagatgaaccttgattttgtaagaagcgaagtcggggaagctgtccatgaggtaactgccggaatggaagcaccggaaaccgaagcagtacaggaaaccgtacagatgccggagggcgaggtgcagttcgagatcagcgatctggacgaagcattccaggtcggtgatatggatttttcggaaggggaaaagaatcagaaccaccccgaaaaggagttttctgaactggaaaattttatcccggtgcaggaagagggggaagagaatctgtccggctcttccttgcacagcagaaatatttctaccgggcaggaaaacgggactgatggagcaaagccaagggaacaggagcgtcccagtgtccgccgggagctggagaacatcaaacgggagaaagcagaggaatcccagaagaagagccgggaaaagaaccgtggaccaaagaaaacgcagaagaaagcgagaaataaacgaaaggtgaaagcgaggtagaagatggacctgacaaaatttttagggcaggacacgcaggagcagtccacccagcggttatcgaaagaagaatatgccgcacagaaaaagcaggagagggaagaaatctggggtatgatcgatggaaaggcacaggaggtcttccagaatggggactccttaaaaggattccttgattttatgggacagtgcaagccgcagaggacagacaacctgttcctgctttatgcacagaatccggagatccggcaggtcaagacctttgaaaaatggaaggaagaaggtaaggtagtcaagaccggaagcaagggatacaacttcattgtcggacaggaatatgaaaaggacggtgtcatccagcaggggtactccatccagaaagcctatgacatcagccagatccgtaccaagcagccggaagaggcagagccaaagccgatggaccagctgatggaagcactgctgaccgacagcgaggtacggattcagattgcagaccacctgccggataaggtacaggcacagtatatcccgaacaagcggacgatctatgtccgaaatggcatgagcgaaaatgcaacgttccattccatcagccgggagctggcctgtgcatcccttgaccatcacgatggaagctacagccgggcaggggtatcggcacaggcctattgtgcggcgtatgtgacagcacagaaatacggcgtggatgtctccggtttttcctttgacaaggtatgccagatgcaggcattcggacagaaagatccgaaagaactccgctcctttatccaggatgtaaagagtgcagcctattccattggcaagcaggtagaccgcaaccttggcaaaagcgagcaggaatttatgaccgatgaatttgccatcccggaggaaaaaacggagaaacctgccaagagtaaaaagtccccggaacgctgataaaaaggggcttttccggctcttttgcagtagctttccgggaggaagtgtggtatgttgtggttgagaaaaaagaggaaaaaaggaggctcgcctatgacaagaatgcgatatgtaaagatggaccggatcatgaaccacatgctgatccatgcactccgggaagtgttccggcaggaaaaagaacaggggcttccggtggataccacacgggatctggttctgaagctggcagagcaggaagagggaaagctctacctgacagaagccgaacacagcaaatccgtggaagccttaaaccagctccgggacacatacctgaaaaacggacgctattccgatgggatcgacagcgttctgttaaagatcatgaaatccagataccgcccataccgtggaaggggaagatgaagaaaggatgtggtacaaatatacagaaatatgacacaagaaagaatagaagccatgcggagaagatatccgccgggaaccgaggtcacgcttaacagcatggagggggagagccacatgccacccggcttaaaaggtaaggtggatatggtagacgatgcagggcagatccacgtaaactgggagaatggaagcagccttgccctcgttccgggagtggacagcttccacattacggacctgccaagagcagagaggcccaaacagcagccatcccggtaacaaacagccggaagtcagactgggtgatttggcttgccggactgcctgtcatctggtgggtagcaatcctgcttgcggatgccatccagccgggcaggaatcttttcgagctaatggaggttctcacagaaaagctgaaccatcccttccagtttcattatacggaatataccatcaagtcgatgctggtctgcacgttactttacgcagccgggatcggcattttttattccagtcagaagaactaccgcagaggggaagaacatggctctgccagatggggcgatgcccggcagatctgtaagaaatatagccagaagccgtactcccagaacatcctgctgacacagaacttccgcattagccttgacacccacaagcaccgcagatgtctcaacattctcgtagtgggaggctccggtgcaggaaaatccagaggctttgccctgccaaacatcatgcagtgctgctgttcgatggtcatcaccgatccgaaagccgagctgctccgaaagacaggcggtctgctggaaaagaaaggatatgaggtgcgtgtctttgacctcatcaatcccgacacatctttttgctacaatccattcgagtatgtccacgatgacaaagacgtgctccgtcttatttccaatctgatacaaaacaccacacccaaaggttcccagtcctccgatcccttctgggagaagagcgaaaccgcactgcttcaggcactgatgctgtatctgctccacgaagctccgccggaagaacagaacttcgccatgatcatggagatgttaggctcggcacaggtaaaagaagaggacgaggactacgagtcccctctggacattttgtttgaccgtctggagatgcgggacccggacagcattgccgtcaagcagtatcacatttacaagcaggcggcaggaaagacggccaagtccatcctgatcagtgtaggtgtccggctggcagccttcaatctgccgcagatcgccaagctgaccaatactgatgaactggatctttccaacatgggagaaagaaaagttgcccttttctgttgtatcccggatgcagacacctctttgaattatctggtaggcatgatctacagccagcttttccagacgctttattacatggcagaccgtgtgcatggcggtgccctcccggttccggtcaactgcatcatggatgagtttccaaacgtatccctgccaaatgagtttgagaagatcctggcaacctgccgttcccgttccatttactgcagcatcatcatccagaacatgagccagctaaaggctctgttcaaggactcctgggaaagtctggtgggcaactgcgatgagtttttgtacctgggcggcaatgaaaaagagacacacaaatatgtatcagaattactggggaaagaaaccatagacaccaacacctacgggcagaccaaaggaaaatccggcagctactccaccaacttccagcagagcggaagggagctgttacagccggatgaagtccgtatgctggataaccagaatgcacttctgtttatccgcggggagcggcccatactggatgccaagtatgacctgatgaagcatcccaacatccggtataccgaggacggaggtgccggcccgttcaattatgcgaaagcaccgctggcgcatgatgattttacatttgacgaaacaagatatgacgattacgaactgcttctggatgaggacatcatcggggagcttttttgatgggaggaatgccaatgaatttactgaaaaataagaaacacacagaaatcaggaaagagaccgcaccgctgaagatgaagagagggcagaagaaactgtttgctctgtatgcagttacggtactgtcgatctgcattggggcgacctgcgtttatgccgcaggcgatccgctgaccgtagtcaataacctgtccacgtttatcttttccctgatccgcgccattggcctgatcctgctgggatttggtatcgtgcaggtcggtctgtccttaaagagccacgatccaagccagagggcaaacggatttctgacactggcaggcggtatcatcattacctttgcaaaagagatcctggacctgatcatgggataggagaagagtccagaaggggagccatgcgaaatgccggctccctgctcacttttgaggatgggaggtgaaactgtttgagtgataactggatcgtacagaatctaaattctgccttgcagacctggagcgacaagctggctgaaatctggacactgctgacgcaaagcccggagaatttcaagggcggggcaatctggagcgtgatgacgaacatcaacggtggactgaaagccatcgggtacggcctgctggttctgttctttgcggcagggctgataaaaacctgtgggagcttcacggatatgaaaaagccggaacacgtagtgaaagcctttatccgttttgcactggcacagggagccgttatgtccggcatggagcttctgactgcgatcttttccattgtgcagggcatcgtgacaaacatcatgtcccactccgggatggcagggggaaccgtaacggaactgccctcggagatcgtggacaagatcgaagcggtcgggatgctggaatccatccctttgtggatcgtaaccctgttaggcagtctgctaattaccgtgctttcctttgtaatgatcctgaccgtatatggaagaatgttcaagctgtacatgtacacggccatcgcaccgattccattggcaacctttgccggggagccaacccagtctgtaggaaagaactttatccgttcctacgccggggtatgtctggaaggagccatcatcgcactggcctgcatcatcttttcggtgtttgcatcaagtccgccggccatcggggacaccagcctgtccgccgtgaccattgtctggaattacgtcggggaactggtatttaacctgctggtactggtcggggcagtcaaggcatccgaccgtatcgtaaaagaaatcatgggattataggaggcgaaaaaaatggaagaaccaaagacactgagctacgactggcagtatggccgggaggaattatttctcagggtagacagttacatgagcgatgacaatctctatatcgggctttaccatatggaagatggatacccggaaagctttgcagaccttacggtaaacctgccttttgctccgctgggcggtatcaatgaagcctatatcgaccacaatttcagtaaagaaaagcttcgttttataaagcagcataagctgggaacgatacagccggataccgcatcctccggttactgcattttccagagggttgcattcgacctgaaaaaactggcagagcttgatccggaaggaacaaaaagatttatggaaagaaatggcatccggcaaagggatgtaccaaaacagaaacaaaagaaaaaacagagattacaaagagaaaggtagaaaacaacatggaagtgaaaatgaataaagaaatccgagactatcaggagtcaatgttctggggcttaagcttccggcagtgcttattttcggtactggcgattctggcagcccttggtatttatttcctcacccggaaatatgccggggaacaggtaaccggatggctgtgcgtgcttggggcggctccctttgcagcctgcggctttttccgttaccacggcatgacggcagaacagtttgcatgggcagtcatcaaatctgaactgctgtatccgaaaaggctggtattcaagtcggagaacctgtacttttcctgcatggaagagagcctgcggctgggtgaaaagatgatgggaaacggagcggagcttctggagaagaagcggacgaaacagaagaaaccaaagaagccaaagaagccaggaggaaggggtgatgcctttgattaaaaccttgagtcagacactgaaacaggacaaagaaaaattcaaagtaccgaggtctgtccagcaggcgatcccgatccgcaagatctggccggacggtatttttcaggtggagagcaagtattcccggacattccggtttacggatatcaactattccattgccagcaaagcggataagacagagatgttcctggactactccgaacttttaaatgcactggattccggctgtacggcgaagattaccctgaacaaccgtaagatcaacaaggaagagtttgagcagtccctgctgattccaatgaaaggagatggactggacgagtaccggaaagagtataacgatatgctcctttccaagatctccggtaccaacaacagcatttaccaggaacgctatctgaccgtcagcgtccacaagaagaacatcgatgaagccaggacatactttgcccgtgtgggaacggatatcatcacccatctggccaagctgtcctccatcggggaagagctggatgcagaacagaggctccagatcttccgggactttttcaaggcagacgttccgcagagctttccgtttgacatgaaagcctttgcgaaaaagggacacagcttcaaggactggatctgcccggacacgatggagttccacaacgaccatttcaagctgggcgagcagtacggcagagtcctttttatggaagattacgccagctatgtgaaagacgagatgatctccgaactgtgcagccttggcaggaatctgatgctgtctattgacatcatcccggtaccaacagatgaagcagtgcgtgagatccagaatcgactgctgggcgtagagaccaacgtaacgaactggcagagacgccagaatgcaaacaataatttttccgccgtggttccctatgatatggagcttcagagaaaagaaaccaaggagatgctggacgacttgactaccagggaccagaggatgatgttcggtatcctgacaatggtacatatggcagaaagcaagaaacaactggattctgatacggaaaccctgtattccattgcgagaaaacacctctgccagatggcaactttgaagtggcaacaggtcgatggactgaataccgtcctgccgtatggtctgcggaagatcgatgcggtgcgtacccttaccacagagtccactgccgtcttgattccgttccatacacaggagatcatgcagccgggcggcatttattatgggcagaatgcagtcagcaaaaatatgctggtggcagaccgaaggaagctgttaaatggaaactcgttccgactgggagtcagcggttcgggtaagagtttttcggcaaaagaggagatcgtagaccttgccctttccacggaagatgacatcctcatcctcgatccggagtcggagtttgcttctctggtggaagccttaaacggagaggtcatccggatttcggcaacctcagatacccatctgaatgcactggatatggattctgcctatggcaatgaccgaaatcctctgattgaaaagtcagaatttatcctttccctgtttgagcagctcgtaggagccggaaacctttcggcaaaggagaaatccatccttgaccgctgcaccgcagatgtgtaccgggattacatgaggggcggttacaaagggcaggtgccgaccttaaaggacctgtaccgacaactcatgctccagccggaggaagaagccagagggctggctctgtcttcggaactgtttatcaatggcagtctgaacacttttgcccaggaaaccaatgtcaacacgaagagccgtatcatcgactatgacatccgggagctgggcgaacagctgatgccccttggcatgctggtcacactggattcgatttttaaccgtgtgatccagaactggaagaagggaaaaacgacatggatctttgcggatgagttttatctgctgttccgctatgaatacagtgcggactttttctaccgcctgtacaagcgtatccgtaagtattccggatttgtaaccggacttacccagaacgttgaggaacttctgaaatccgataccgcccgcctgatgctggcgaacagtgagttcctgatccttttgaatcaggctaccaccgaccgggatgagctggcggcacttctgaatatttcagacaaccagttatcctacatcaccaatgtaggtgccggccacggactgatccgttgctccggaaatctggtgccgtttgaaaactcgtttccaagaaatacaaaactgtaccgcctgatgacgaccaagccgggcgaagcgtaagagcagtacagaccgggactggaggtgagagatgaaggatatcaaaaccaaagaagtcacaacaaaaccaaagactaaaaatcctgcctccagaatcccgaaggagctgatgcggacggccatactggagagcaaggaaaagtcccagaccatcgcaaatgccagggataatgacatgggggaacagtccccatccgagtatgccagtggaaaagtcgcatccgcagaggaatgggctgccagaaagtctggcagaactgtaaccagcgccggaaagacagcagcacagacttcctacgagaagatcaaactgagagttactggcaaaaaagaagcggagaaagaagctgccagaggaacaggggacacacaggctcccgatccggtcagtcgggaagcaccagagcaaaagaatcgggaacagacatctgagaacgtgaagattaaaagccgggaagctcaggaagcacagatcaaagatgtccagatccagaaagccaagcggcaaaaggcggtttcagatgctgtcaaaacaaaagaacagaaaattcgggtagccagagagacaccgagaatccagaatggacaggaactatcaggaacgaagcagttctccatccgagaccagagccggaaaaaggcagtcgcagatactgcaagacagaatgccatctgccagaaacagccggaaaccatccggatcaaggaaaagccacggaaacagttggagccgaagaccatacagcggcgtactattaagaccgcccctccatctgcgaagattagcatccagccagagcagaagctccgtgtagccagttccaatgccctgacaacccggatgcagaagcagatggaacgaagggcagcgaaacaggcggcgaagaaagcagccttgcagacttctgatggaatccgtcggatacagaaaacggcaagggcaggggagaatacattcaaggcagctagagccgccgtggaagtggtagcgaaaaccgtgcagtccatgatagctgcactgggagccgccggagcggtcatggttctgcttctggttatcatggtcgggatcattggcggtgcggcattctctggaagctcagagagcaacgaagcactcagccaggaagtactttcctatacggcaaccatccagaaatacgccaaccagtatggaatccccgaatacgtttccgtgatacaggcaatcatgatgcaggaatctggcggccgggggaccgatcccatgcagagcagtgagtgcccatacaacacccggtattccaacagcccgaatgccatccaggatgcggactactccatacaggtaggaatccagtattatgcggactgcctaagagaagccggatgcaccagcccacaggacatggacaagctgaagctgtccctgcaagggtataactacggaaacgggtacataacgtgggcgattcagaaatatggcggctacagtgcagaaaatgccctgcagttttccaatgagcaggctgcttcgcatggctggagtgcctatggtgatccagaatacgtccctcacgttctgcggtattattccagcggcggattgtttgccggcttgtttggaggcaacggccagatcgtatccgtggcactgactcagcttggaaatcagggaggccagaagttctggtcatggtatggatttgacagccatgtggcgtggtgtgcctgctttgccagctggtgtggggatcaggcaggactgatcgaaagcggcaagatgccgaagttctccctgtgcgatgacggaatcgcatggttccagagcaaggggaaatggaagagcagaggatactcgccagcacccggaaccctaatcttttttgactggaacggagatggaacctcagaccatgtaggaatcgtggagaaaaccgagggcagtaccgtatacaccgtagagggaaactccagtgatgccgtgaaccagagaagctacgatatcaataacggaacgatcatgggatatggtatactttgaaaattaaaatagaatataagttataacctatgaaaagaaatttgatatgtgtaagttgatttttttatttgattgaaattttaattttatatgaaatgaaaagaaccagtgagagaatcgttaaatttcactcactggctcaattcgtttcaaatttctcggacaactctgtcagttctttcaccgtttcctgggtgtgatgcaacagggtgtcacgcatttctggcggacagctggaataaagcattttcatctgattgacaccctcattctccagagaaatatctggatttataagcgtatctaaagagatgtgtaggacctttgccaatgctctcaaaatcaaataggaaggattcattttccctttttcgatattggcgatttgctttacagaaacatggctcagatcagaaagttcttgttgtgtcagttctttattctttcgggcttcccgcattttctgccctaaagcagttaaatcatcaatcggcataatcgttcacctcaagaatattgtatcgttccggtttgtacaaaggaataaccttattgtgcttgctaagaggtatgattatgctgattatgtgaatgaaaaacttctgttcagatgaagttacactatcttagtgacaaacgcaaagtgcagggagatatttgatggcgcattccgtagatgttttacacctaatcaaatgtggcgaggatgtggctgaaaaaaattacgagcgccagagttccctctggcgctcattttactttcgctgtgcgttttttctgtactctaatggcaacaatcccgtgctttttcggaataattctgcaaatcggcttgaagtggaatagcctactgtttgggcaacttgcccgactgtcagctctgtatatgccagcagatattctgcttggctcatgcgccgctgttgaacatattccgtgatggtgcagtcgtagtatttcttaaaacagcttttgagctttgttgttcccatgcaggcaatctgtgttagccgttccagaggaatatcaaaagcatagtgatcgctaagataagcggcaactatttggagattttcaatatcctgttgagagagcttatgggctggtttatcaggatgtttcttctgatattccaccaccattgaaacagcttctgcgactttaccctcataaaaaagttttgctgcaatcccttccccgcgatagtctttgatttctgtgagtaaccgtgacatttctggaaagtcggatgtttggtcgatcttccgaaatgcatccacaggattgatctgtgcctccgggtacagttttttcaggtagtcctcataatatgccggtgcaatctcaatcccaaccgaacggattggaatatttttatgtatcaaagccttgtatggagcgtagcctccaataaatgttttgatacaaccggcagacagtctacggtatggagataattcctccccggaaatagagtcataccgagtgatactcagacattccggcatggagcattccaacatgaaatcttcgtggaaggaaaagttatggattttaatatcatataagtctttctgtccataagtccagtaggtgccttctccaacttcgggagaaagtttccagcagtcacctaatgccccatattgctggttgtctgggtcacggataaaaccgtgttcaatcagtagcggtgtataaaactggtcaataatttcagacatgaaaacagaccgcctcctttttgcaacgattagacgaacttttgaaaggaacagacgaacattgccggaacctattgaatgttgttcgataaatgcgtattgtattaggcgaagattagaggtatctaaccgaagaatatcacaaaccacttgtcgagtcaagacaatgaaaggtaggaggtcaaaatgagtaatcaagtaaattctatgaacaaaggtctgacagtgaaagaccttgtaacaacaggtatttttactgcactgttatttgtttttgtattggtgggcggtgtcttttttgcaacgaatcctgtacttacttttttcatgccagcaggaggtgggctgcttgctggccccatttatcttttgctgattgcaaaagtacataagcgttggagcctttctataatgggcgttatcatgggtattatttggttcgtgactggtatgcactgggcttttgcattgggctacatgatcatggcgattgtcgcggactttgttgctggtgcagggaagtacaaaagcaaaaaactcaacagcctgtcttatatcctgttctctctcggtggcactggttcatatatcgtgttctttgttgaccccaacggctgggcgcagaccatgctgggaaacggaactgaacagagttacatcgacaccatgcaggcaactgcaaataccggcatcctgattgccatgtttgctgctgttatcattacatctgcaatcagcacttttgtaggctgcaaaatgctgaaaaagcagtttgaaaaagcaggtattacagcatgagcggtaaacgccacaagaaagagctttggctcgacccacgggccaagctctttcttattcttatgtgtgttttatcgtccatgtttgcgccctcacttgcatatcaatttatccttgttatgctgattgcgatattgggggctttctttggaaagtggaaatatgtcattaaggctgtatgcttttatgcggtcatctgtgccctgacaatttggatcatggcagaaatgacaggcacgctgcggacaatgtttattgcctttttaggcttgtttcataaggtctatgcgtgcggaaccttggctgggattgttctgactactacaaaagtcaatgagttcctgtctgctatgaaccgtgtccgcgcacccaaaaagttagtaattcctatggcagttatgctgcggtacattccaactattcaagaggactggcgctatatcacagacgctatgcggatgagagatgtttcaccatctctggcgggctttttaacacatccgggcatgacggttgagtgtatttatgtacctttattgatggcagcttcaaaagcggcggatgatctttctgttgcttctgtcactcgtggaattgaaaatcccaatccacgcacctgtcttgtccagataaaatgcggaattgccgattggggcgtcatgaccgttgccgtagcttatctgatttttgaattatgtgtgcggggaggtgtgatcggttgattgagtttgaaaatgtatcgttttcctatacgggacaggaacatggtgggctacgcgacatcaatttgaaaatttcggacggagaatgcgtcctgttctgtggccgcagcgggtgcggaaaaacaacgattacaaggctggtgaatggactgatccctcagttttatcagggggaacttcatggccatgtgctggtagatggtcaggaaatcagcaatatccccatgtatcagattgccgctaaggttggctccgttttccaaaatccacggacgcagtttttcaatgttgatacagacagtgagattgcctttggaattgaaaatgaagctcgccctcccaagaaattggctgagcgagtagagcagacaactgaagatttgcatattcaaaagctacgaaacaggaatatttttgagttgtccggcggagaaaagcagaaaatcgcctttgcttctgtttatgccatgaacccacagatttatctattggatgaaccatcctctaatctggatatgacttcgatccaggaactaaaggaacatttgcggctgataaaaaaacagggcaaaacggttttgatagcggaacatcgtctgtactacctgatggagttggctgaccgaattgtttatctggaaaacggagaaatcaaaggaatatacaccccggaagaatttcggcagctatctgaacctgatcgtgaacacatgggtctgcgagctgttgatctacaggcggtattcccgccaaaagcccacttgcctgcgcctccccctgtattggagctgcggaatgtgacgctccgttacaagaagcaaacaattttgcatgacattgagctatccgccggaaagggcgaagtgattggtgtggtcggccacaacggagctggaaagactacattttcccgcgctctctgtgggcttcacaaagactgcgatggacaatttttgtgggaaagcgagccgattgagcgtaaggaaaggctgaaacgctcttacatggttatgcaggatgtgaattatgaacttttcgctgacagcgtggaggcagagtgctcctttggtatacgcaatccagatcaaaccctggtaaatgcaactttggaggaattaggccttacccaatatcgggagcgccatccaaacacgctttctggcggtcaaaagcaacgagtagctgtagctgttagcatgatttgtgggaaagatctgctggtattcgatgaaccgaccagcggccttgattttgacagtatgacgcaggtggcgggactgatccgacggttgtccaatatgggaaaggttattttcattgtcacccacgattttgaatttgtctgccgtacctgctcccgtgtcctgcattttgacgaaggcgaaatgcccgatgatgtaccagttacaatggatgccctcccgaaattgagagagctgttctctgtttcagatggaaaggagaggtgatctatgaaacagaaaaaagaaaacagagtagctttgctgctccactgggccggtgagcaaaaaatctggctgttcctggcaatttttctatcggcggtcagcggtctttgcattatcgtcccttacattggaatttaccggctgatggacgccaccttcaatcatacctgcacgcaggaacttgttgtacataccgtggtaatgattgcagtggcggtaactttgcggtttgtcctgtttggctgttccggcgtagcagcccacaaaggggcctatggcgctcttttcaaagtgcgctgcatggttgcagaacacatggccagagcgcctttaggggccttgaatgaacggcgcaccggggacataaaaacggttctgaatgaagatattgaaaagttggagctgtttctggcccataaccttcctgaccttgtgtgctatctggtggggccggtagtcatctttatttatctgatgaccgtcaatattcctctggcattgatttccctggttccgctgatccttgctgttgttgtaatggggatgatgttccgcaatacggatgacctgatggaacgggccaatcactccattaccacactgaactcggttatgattgagtacatcagcggcatgaaattgattaaagcctataacatggggagcaaatcgtttcaaaagttttcagacgctatccaggaagaaaacgccatgtggaatgaaacttcccggcgcatggggccaccttatgcggcctttgttgttatcatcgaatgtgggatgttgatgatggttccaatcggcggaatgtttttcctgaaaggctcactggctgccagcgcatttttgctgttcgtctatgtaggttccatgtatctgacggaaatacgccccctacaggaactggggactaattttgccaatgtgctgaacgctgttactaagaccaaagagatactggatattccaatttatgagggtggagcggactttccccaaaatcacgatattgaacttcggaatgttcggttttcctatgatggcaagaccgatgtactgcaaggcgttaatctcaaaattaaagatggtgaacgcatggcccttgtgggacagtctggtgccggtaaaagtaccgtgattgagctgatctcccggttctatgatgtgcaggagggcgaagtgctgattggcgggaaaaatgtaaaggaactcaattatgatactatcctaaaaaatgtcgccattgtgttccaaaagaccttcctgacccgtgacagcgttttagaaaatatccgcatgggcagtaacgccactctggaaaaagtacggaccgccgcaaaagaggcgcagattgatgatttcatcatgtctttgccggatggatatgacacgaaggtgggcagcttcggctctcgcttctccggcggtgaaaaacagcggattgccattgcccgcgctatcctgaagaatgcccccattttgatcttagacgaggccacaagcgcctctgacccggaaaatcagatggagattgacaaagccattcaaaatctctgtaagggaaagactgtcattgtggtagcccatcgtttgagcgcgttgaagatgtgcgagcgtgtagcagtggttgaaaatcacacaattacctgtgtcggaacccatgaggaagtccgaaagaacaatgcttactatcggaaggcgtgggaggactacgaaacagcccggaatattacttatcagttggagggaggcgagcagcatgagtgagcatgatgtattgaaaaagaaccgtaatttttatattggcgttggcgggactgttctggaagggcttctctctggcagcctgtttatgctgctttactctgtcatgcagtttttgtggtcgggacaatttgacatgaaccgtgtcctggttctgacctgtgtgatcgcggtggtttttcttcttcgtatcctgatttacagctatggctataccaaagcgcagattggcggtgcagcggtcagcaaaaatattcggctttttatgggcaaccatttgaagcgcatcccactgtctcgattttcgcaggggcagaccggcgattatatcaacaccattacaagcgacgtaaacaactacgaaaaaatcctgacccataaagtcggagatttcgcaaagaattttgccctgtcattgatgttgattgtctttgttatgacgctctatgttccggcaggaattatcctgctgatagccgatcttcttttaatccccggcctatggctttctttccgcatggtacggaaatatggaaaagaaaagaacgatatttgtgcggagaacgtcagcagcattgttgagtatgtttctggtattcagactttccgagcttatggtgtaggcggtatgaagaacaaaactgttatcaacgccatgcgggagttttcccggatcagctttgtgtacgaatcaaaagtgcttcctattggtgcggtctttggtattttgagttggctgtcctgcccgctggttatcttgctggcctatgcaccctgggtcgcagggacactgagcacggtggactaccttttgatttgtatgctgcccctgttctgtgcaaagctggctaactcgatttttgtagaccttaccagttataagaacctgatgatctcgaaaaacaaaatcttgagtgtaatgaatgagccggaggaaactggcagcatggagccgcttcacacagctacccatgaaatcacatttgacaatgtagattttgcatatgttcccggtgaaccgatactaaaacacgccacctttacggtgccagatcaaaagctcacggccattgtcggagactctggctccggcaaatctactattttgaacctgattgcaaaatattatgaagcaacgggcgggacgatttctattggcggtaaacccattaaccatgttgccgcagagcgtgtactggagcaagtttctatggtagaccaggacatatttctttttgacgataccatccgggataatatccgacacgctcgtcctaatgctacggacacggaaatcgaggctgcctgccgggaggctaactgtgacagcttcatccgtaagatggaaaagggatacgatacgccgactggcgagaatggaaatcttctctctggcggtgagcgtcagcgaatttcaatagcccgcgccatcctgaaaaatagccccatcctgcttttggatgaagcaacagcatctcttgacattgaaaatgagcttgccgtaaagcaggccatcgccaatctgctaaaagaaaaaaagacagtggtaatgattgctcataccctttccattgtcaaaaacgctgatcaaatccttgtaatgggtgatggcaggattgctgaatctggaacccatgaggaattgcttgcgaaaggcggaaaatatgctgctatgtggaacgcagagcaaaaaatatcagcttgatgggaaataagatgtctgtcggatcgaatatgatattagcacagaaacctatgaacgactgaaagaatcagtcacgaaagaataattacatagcgcatgaatctgccccgattaaggggaaagaaaaaaccgttggttggggcaggtaattttgcacactcattttaagttattaccataacggcggttttgagaaatcagagccgccgtttctttgcttttacacaaaccaatgacgacttccagggacacggtagccgattggaggttaatttatcgtgccccgtttactttgtcaaagctcacatgatctgcatcagttaaaaaaattattgttcttcgttcgggcaagtataatattgcatcggcattatcgttctatgtaattcagtataataatggctgtttttggaatgccagttttccattgcggaaatttggcgtttttgatagccgtttttatgatgatacttttagagtatatcgctgtcgatcaccgccacactccgatttgatttcgcaaaaattcagatcggaggaaaagataagtggcttacaataaagcaaaagaagaatatagatggaaccagtggaaagcagaggaagagaagatcctgcgtgaacagggcgtggatgaagagacgatccagaagcttcgggagtatgactgggacgatttcaatgcagagcggagattccgggaacaccagacctcgcttctggactgtatggaactgctcctggaagaaaaagaaaccaaagagtcccagccggagagcgtagaagccctgctggataccgtggagaacgaagaactgcttcagatcctgttatcaactgataagaaaacccttcagatgattgtcctgaagatgatgggatatgcaccaaaagagatcagtcatcacatggaactgccggagcagacggtttatacaagactgcggagattaagggaaaagatcaaaaagtccatgaaatttgaataaaacaaaaggttctcatcggctgactattagaacgaacagacaggaggattaatacgatggatgagaaagaagtgtccgaaatgcaggaagaaatgatgacggtactggtagtcgagccgatgaaagcaccctatgtcaaaagcatccccaatgagctggaagatctgcagcaggcagtaggcggtgacattgagatgacttatccgtttgaggatgaggttggaattcttttaaacggcaatggaaaatttgaggggttgccgttaaatcgggcattgtacgatgaccgaggacaggtctatgatgccattgccggaacattccttgtggtaggactgacagaagatgattttacttcgctgacaccggagcagattgaaaagtttaaagaaaaatatcagtcaccggaagttttcaccctgtttaacggggaacttcatgtgatgaagatgccaccgcaggaacaaaaagagcagaaggaaagtcggaagaaggatgcacagcagaagaatccggcaaaaggaaaaaagaaaaacagatccggggatgcaagataaaatatttttttgtgaagtgaataaaaaaatacactgccatcggctagtaagcagagggacatccctcggctgttctttggcaagtgaatatcggcactacaggtacgttcccaaccgtagaagcgtgacagtatgagcgccatgattaagtatagggtaaagattcttagacttggagcgagaaagcatagctgtgaataaggcggtggcagcctttcgccaggatcacggacgggggataatgatacacgttaccagccagagagcggaagatggactccgggttgtaatcagaaagacccccaggacatctgtgagcggcggcaggccagccgcccgcctgtagtgtccccttccccagaagaaatacagggatagttccgggggtgcgaggtcaaatgcggaacagcaagataaaaaagaaatcaatgaagaagtgtgtcgttgatatcagataccatgcggctgtgggagactacagccgtattcttgtggtattaacgtcacatcaaggggagagaacagatggaagaaacaaaaagaagtggaatgagcaaggatcaattctggaatctgattgaaaaagcaaaggaagtgtgcggcaccgatctggatgcttcggcagtgtggatcaagcagcagctcttctatatgacaccggaggatgtcctccaattccacaatcttgtttacagttaccgggatgcggcttataagtacggcttatggacagcggcaggtattatgatggaagcagggtgcagtgatgacagtttttccgattttcggatgtggctgatcgcccagggaaaagaagtttatctgaatgccttaaaagatccggattccctttccggcgtgactccgtatgggtactgtagttttgaagcgttgggatacatctcatcgcaggtctacagtgccatgaaagggaaaaatatctatcaggacagtacggcaagaatgcagatggaatgttatgagcaggtgatccgggatattgtgtaccatcccatgatcgagtatccgctggaattaccggaagcaatggtggtatatccgaaactctgtgaatgtcatttgtccgagcaggtaaggaaagctcctcagaaagtaaggacatggaatgtttcccggacggatatccgaaggatgatggcaagagggaatgctgccataaagaaaatgcaggaacagggacagaatacaccggaagcgaccagacccgtccgtaagggtacggtaagataagctttctggcaaggagaagtaatgtgttataaaaatgaatatcagaaaagggcacatggtgaagtggaacagatctttcgggagcttctcccggaagccgggcttcatgtaagggaagaacagatccgtctctgccatgaaatgctggatgcccttatgaaaaatgaaatcacgctctgtgatgcaggagtcggcatcggaaagacctatgcctatctgacagcctgcatcctgatgcggaaatatagtgtactgcattccggttattcgggatgtgacaggcggtctgtagtggtatccacttccagtatcgccttacagaaagccatcatagaggaatatgttcctttcttatcggacgtactgttaaaagcagatctgcttcagggagagttaaaagcggtcgtccgcaagggaaaggaacattttgtatgcgattacaggctggcccagagattagaggcagtccgggacaagaataaaaatcaggcacagatggaggcattgaagtccctccggcataattttgatttagattccgtacataacctgagcggttttgaccgcaggctggtgtgcgtaccgaaattctgccccagggaatgtccggggaaagcaggatgccgttatcagaagcatctggatatttccaggaaagaggatatttttttacagatttgcaatcacaattatcttctggcagatgccatgcaccgggcaaatgggtaccgtccgcttctggcagattacagggctctggtcgtggatgaggcccataaactcccggaagccgccagccagatgtatggaagaagcattggaagggaagatgtgcaggagattgcttactttttagtcagagagcataaaggcacggatggaaaacggctgctggaaggggtttccgctcttcagatggagattcgaaagcaccggaaagatggcatcgaggacatggctggaaaagaaagtttttattttccgccgggagctggcacagccttaacccagatgcaggaaagacttcagcttatgattaaaaggctcgccgggaatattccttactggactttccggcggctggaagagatggaagagctgttcggctggtttttaaagaacgacaaacggtatattttgtttttacagcaggacagccggggacatttaacctttatggcagtcaaccgggagatcccgaagtatctggacgccaccttatggagccggggatttccggcaatcttaaccagcggcaccttaaaagccgggaacggttttgcaaggaccagacagatgaccgggctggaaaaagaaacaggtgtccgggagtgtgtggcagaatccccattctgctaccaggagaactgtctgctttacatcccggagcatttaaaaccaagaaaaaaggggagccgggaagaggccgagcagcttgccgggcagatccgtgatctggtgtgttccacttacgggcatacgctggtactgttcacatcttataccctgatgggaaatgtgcagcagcttttgcgggatcagatcccgtttccgatggtgcaggtatggagaaactcccaggaagagatcgcccggtttaagaagatggagaatgccgtgttgttcgcagccggctcctgctgggagggtgtggactttccgggtgacatggtatcgtccctgattatcgtaaaactaccgttttctgttccggaccctatccatgaagcccagagggagcagtaccgatcgctaaaatcctacatccagaccatcgtggtgccagatatgcagaagaagttgcgtcagggatttggccgggcaattcgcacggagcaggacacctgcgttgtgtctattttagatcaccgtgccacgaaaaaaggcaggtatcggagtgatgttctggaagcactgccaaagtgccagagggcagaacggatcgaagaagtagaagattttatccgaagccggaaagtggagcgttactacagctgagagcatccgtggcgttgttggttctgcccagatccgggtagcagacaggacaaaaagtttagtggtatttcaggggcggtttggagcgaattggtagtattggtgatagctttatcggcatgagttgggtatactgtgtatagcgttagaggaaaggaagtgagcagaaatgagaagatatgagctggaaacagaaagagaaggctccaccgtttatttctttatcagagatgtggaaacactggatatcgtcctgcttccaaccaaatatctgatgcacaagatacggaggaaatgttcaccgaatacggtgcggcgctccgcacttgcaatcctgtactatctggaatacatccatgaaaagaaaaaggaattgacagacgtatatcaaatgccttatgttgaacagacaaatcactttgtggaatttttatactggctgaaagccgggaagcataccagagataaaaatcacagatctccaaacaatggaacctgcaacgcatacttaagagatgtgttcaggttctatctttttatagaagaagagtaccagcagttcggggagctgaaagtcctgtcctataattattttgtagccgtggatgcagtaggcgtaaagaaaagcatacgatcaaagagtttcaaaggctatttaaaagaggaagagcataaggcgagagcagcaaagaaagatgaaattgtggaaatcttgaaagcgtgtaccaatataagagatcggcttctcatgctgcttctggcagagacaggctaccgaatcggtgagatcttaggaattgattacagtaaggacattgattatcaaaaccacataattcgggtatatttccgtgaggacaatgaaaatggagcgagagcaaagaatgcagaataccgaagtgcgaagatcagcaaagataccttcggctttttaaatctgtatatcgcagagtaccgaaaactacttcagcaccagacaagcctgtttgtgaatatttcaggggataatagcggaaaaccaatgaacgtggaagcagtatactctatgctaaaaagaatggataagaaaacagggattaagatcacgcctcatatgctccggcattactttggaaatgagcggagaaaagcaggatggtcgctggaactgatacagctggcctatggacaccgccacatccagacaaccatcaattatctggacattgtggatgatgaactgctggatgccagccaggaattctacgagaaacactcctccctgtatgggattgaggaattgctataggaggtggtttttatgcctgcgtttttacagtcttttatagaggcagaacaagaacggagcaggcggattgagcagctacgaaaagaaatccgggagtttgcaaaagaggaagcaggaagttccattacagaacagattctgctgtttctggcagatgagatggtagaacatctttcggaaatagattatgaactgcgaatgaaatttgaattatacataacaccgctgataaagcgaaattacatttaccgatataccggaacgttcgaccggatacggcaggcgtacatccgggaacggatgaaaactccggctggacagagggaatgtgaatggaaatataaaaatgaaatactttttgttccataccactcagatcctgtaatcgtaaagagtgtggaaacggtacggtgtcggagtaacatggtctggaattttaaagcggcagccagtgagaaactgaaacgtcagatttttaccgtgctggaatatattctggagaattatgaaatttccagactgagggaatataaactgaccgggttacagcttttttacgaattttgcatccgggagcagattacagatatccagcttctggagctggaacaggaaacagcatttcaggactacctgaagcagaaagtcgagaaagagcaacggcgaaaacgactgaagagcattgtggaaactgcccgtaaagtgatttttatagaaactgatgaaacaagatgggatgctaccatctggtatttagagcggtttcgtattgccaaagaaagaataaaccagagtgacagtatagaaaaaatatcatttcaggaagttctacagcccaagaatcgattgctgcttcaggaatatatgaagtacgaaattggaatcggagaactggcgctcagtacggtgtacgaaagattccgaaccattcgaaattttttgcaggagatcagcgaactggaagttaccaagtgtgatgccagcctgattgatgtatatttaaagaatttgcagaatggtgctatgggagcaaagacatttaataccaatgtttcgggaatacagttttttatgaaatttctggaagtaaaggggtatataaaaaaggttccgttttatgcatcgtattacttggaaaaacagatcccagtccaccatgacagaagtgtggaagaggatgtgtatatggaaattatccaaaacctctcacagtttcctgaacacctgagaatgatgtttttacatctctggtgtgtgggactccggatcagtgaggtctgcaccttaaaaggggatgcgtattatatccagaatggtgactgctggatgaaggtctaccaggtgaaaatgaaaaattataaaagggttcccattccggtaacattgtatcgtctgatgcaggtttatctgaaaaaacaccctaccgaaaaagaagcatacatttttcggaatcggaaaggtggagcattttccaaaagcaccttcatggggcagatgaaaaaatactgctcccagataggcatacagaatggagaatatatttttaagtctcatgattaccgacataccgtagcaaccaatttttatgagcatggcgtatcaatccaaagcatccgggactatctgggacatacgtttgaggaaatgaccatgcagtatatagattatatgccaagaaaaattgctaaagaaaatgacgcatactttgaggaagaggaaaacagcctgcttgcctgtatgcagaaaggagagaagcatggataataaactgaaattccaacaactggaatgttataagctggctaccgatgagcaaaaggaaaagctgaataaggaacaatattttgatctggataaactgccgggaaaccagcttcagacagaatttgtcgaatacatttactaccgtggaacgcaggtatccatcctgaccataaaaagggaaaggcattattttaacagcttatgtgaattttttcagaagtcatcccatcaggaaaacagcctgcttgacagagaaaaagacttctggataaagcagttgaaaatgtggatgatacaaaacggtagggctttgacgaagcataaagtgacgaacattcagactgaatcggtggaaaaagctgccctgatccggtattttgaaagccttctggaatttacactggaccgatcagaaaccaatgagctggcaaaggatatctggcatctggaaaggcttccgcttatcctgcggacaaatccgattgtcaaccataagacactaaatttcagaggaatccggcaaccagatattcgggaagaagtaaaaaaagcaatttaccatcatctgaaaaccgaagcccttggcagtataaaacgtgaactgtccgccatgaataaattttcaaagtatttggatgaaaagcattccaagatcagcacctgcgaagagattgaccgggagatcatagaacaatttttaatcaacatcaaggtagaatcaaacggagggaatggcatccgggatgacctgctaaagcttcgaaatgtgctggaaacaatcggaaaaatttatgattttccacatcttacaaaactgtttttaaaatctgattttccgccagaacggaaagcagaattcaaatcttattcggacagtgagctgaaaagactgaatgcccagattgtaaaaatggaagagcagatagcaagggcaatgatcatccaccagatgcttggaaccagaatttccgacacgctgaccttgcggaaagactgcctttataaacatgaccgtcaggatatgattatcatataccagccgaaaacaagaagatatgaaaaaccgatcagccgggagctggcacagctgattggaaaggcagtcagttatgcaaatgagcattatcctgaaagcatttatatctttgcggacgagaacaaaccggagagaccaatcagttaccaaaccttgcaggataaagtgcttcgaatgatctatgaaaaagatatccgagatgacagcgggaaattattcggatttggaacgcatatgttccggcactgttatggggtaaagctgacagaactccatgtggatgattggaccatagcaaagctcctgggtcataaaggagtgaaaagcgtccagtactaccggaaaatgagcaatcagcgactggcagatgagacaagggaagtaagaaatcttatgtcacagattatcttagcaaatctggacggatggggagaagaatatgagcaaatacgacaagatgctggaattgaataaaagaaagagcgaagaaaaagtggaacgggcagtcctgacaatacggacaatggtgttggagagagaaaaggtgtccgtaccagcactgatgcaaaagactggtttatctagaggattcttttacaagaatccgattgtaagaggtgagattgatacagcaatggaacagcaggctggtatggtggatccaaggagaaacattatcagtcaggcgatggaagcggaaatgaatctgctccggcaacagctacagaaactgaaaagcgaaaatgagaatctaataaaggaaaaccagaagttaaaaaaagcactatccaagaaagagttgaatcttatcaaacagatttaagctatatcataatgcaaagtaggtctgccagaatacagcagatctgttttgcattgtgatatagaaacagattatgcttaaaaggcattaagcaacccataataatgggtattggacatagaaagcaatatgggagtatgatgataccgataagaaatagagtgtacctgaaatgcaaactgtcacagaaaaattatgaactttatgtaaaaagttgcaaaatctattgacctagagcttacttcaggttgtaccataaaataaaaagagcaaggaggaattttttatggatatcgaacagatgaaaaaagacttaggtggaggtaacgtatttccaatcggtgaagaaaacgtagcattcgcaaagtattttacaggtgaatgctatttgaatatgcttacaacagagagagtaccagttggtctggttactttcgctccgggaacaatcaatgcataccacatccatcataaaggtggacagatccttctggttactggtggaagaggatggtaccaggaagaaggaaaatcagctcgtgaattgaaagctggagatgtagtaaatatttcaccagaagtaaaacactggcacggggcagcgaaagacagctggttccagcatctggctgttgaagttccagcagagggagcttccaacgaatggctggagtttttaccggaagaagagtataacaaattaccataaataagaaagatggaggtttgatatcatggcaaagattacacagacagcaggaagaaatgctctgggaacatttgcaccggagtttgcacatttcaacgatgatgttctgttcggagagaactggaacaatgaagatattgatttaaagacaagaagcattatcacagtcgtagcactgatggcacagggaattacagattcttctttaaaattccatttacagaatgcaaaggatcatggagtaacacagaaagaaatcgcagcgattatcacccacatagcattctatgcaggatggccaaagggatgggcagtattcaaccttgcaaaagaggtttggaacgaggaagaaatagaaaaataacctggtagaaactgctcgtcagaaaagattcgcacaaagcacaaatgtgtatgccgttaaagccagcaactacaagggattgcggagggggagtccagtttaatgcagaaataactggcacattcatcacaagggcggacagattctgctcgttacttatggctcaggctggtatcaggctgagggcgaaaaagcagtaaagctacacgccggagacgttgtcaatattacgccggaagtaaagcattggcacggagcggcaaaggacagtgtttttgtccatttggctgttgaggttccggccgaaggggcttataacgaatggctggagcctgtttcagatgaagaatttaataatttagtataaggagatataatatgaaatatataactttgaacaatggtataaaaatgcctatactcggttatggagtgtttcaagttaatccggaggaatgcgaaagatgtgtgtctgacgctattgaaacaggatataggtcaatagatacagcccaggcgtatcataacgaggatggcgttggaaatgcggttgaaaaatgcggtctgcccagagaggaattatttataacaacaaaagtatggatttcaaacagcggttacgaaagagcaaaagcctcaatagaggagtctttaaataagcttaaatcagattatattgatttgctgcttattcatcagccgttcggagattattacggaacatacagggctatgacagaggcctataaagccggaaaagtcaaagctataggggtgagcaatttttaccctgaccggcttgttgatttctgcaagtttaatgaagtggttccagcggtaaaccaagtggaaacgcacccatttttacagcagagaaaggctcgtgattggatgagaaagtacggcgttaaactcgagtcatgggggccgtttgcggaagggaaaaataatattttctcaaacccggttttaaaagaaattggtgaaagtcataataaatcggttgctcaggttattttaaggtatcttatagaaaatgatattatagtcataccaaagacaacgcataaagaaagaatgaaagaaaacattaatatttttgatttcgaactttcaaaagaggataagcaaagaattttggaattagacggaaccgaaagtttatttctgtcccattatgaccctgaaactgttgaatatttaacaggtttaaaataatataagaaaataaaatcccatattgtgtttttaaaaggctcggtaatgctgagccttttagcgtgcagaaaatagcggacttttaacccctagatcaatagggcctaaacattaaatttgtgtataatgccaaacactttatgctttgttaacaatttggtcgcttagcatgcagaaaaagcggtttgagaaaaaggttgtgcaaacaagtgagatttaatcagtctatggaactgccattgaagctgactgaaggataaaaacagctcaaaaatgctgtgcgctcatctgcagccacacatattcactttttagacgatagaggctaaacattaaattttgtgtataatgttaaacttttaataattttatcggcagtctgagcggctcaacaatatttagcggcttttaaacttgcaaaatagaatatgagtgatataatagttttaatttgattattaaaaaaggagaaattagttttatggaaaatcaccctatacctccggtgtatgataaaaattctaagatcctgatattgggaagtttcccttcggttaaatcaagagaaatgaagtttttctacggtcatccgcaaaatagattttggaaagttcttgcaggactgacgcgttctgaatgtcctcaaacgattgaagaaaagagagaatttttaattcataatcacattgccgtatgggatgttataaaaagctgtgatataattggttcgtctgacagctcgataaagaatgtgagtgtgaatgatataaaaaatataattgaaaattctgatataaaagcagtttttacaaacggaggaacagcgcataaactatataaaaaatatatggactgcgattatgaagcggtaaagcttccgtctaccagccctgccaacgccgcatattcactggataaattgataaatgaatggaaagtgattttagattatttataaatatttcttttctttgttaatatttattcagcaaataaatttatttataaagttaagataaaaaataattgtcgttaggtatgttttattttttaaattccacataagatgtttttatgtataaatttttaaacatatcatgatttatgttttgggattaaataaaaaacaatagttttattaaatataaattattttcaagacagaaataaaaattatatagagctgtaaaaaataaagccgcgatagtaaaccacataaaaaacttaataattgcgggaaaacggcgttctcttcaggcttttagccatgaaaagagcgctgtttttttgcagcatttttgaaaaagatagttttattacgttctattttttatttattagagttagattttatatctgttgaagcatattgaatttattgactgatttcggaaataataaaatgtaaaagcaatggtgcggaggaataaaaatgaaaaaatcagtctggacggacagtattaaattacctgagttcccaaaagcggacaaagaaatgaaaactgaagttttaattataggcggcggcatatgcggaatactatgcgcgtacatgctggagcaaaaaggtattgattatatacttgttgaaggaagcagaataggatatggaataacaaaaaatacgacggctaaaataacgtctcagcacgggttgatttataataagctgataaaatcagtcggacgtgaaaaagcccaaatgtatttatccgctaatgaaaaagctctaagagagtatagattaatagctgaaaatatagactgcgattttgaaacaaaagatgcgtatgtttattcgattaatgatagaaaaaagattgaggatgaggtaagcgcagtaaacagtctgggatttaatgcagaatttgcatctgagacaagccttccattcaagacagcaggcgccgtaaaatttaaaaaccaggcgcagtttaatccaatgaagtttttaaatgaaatagtaaaagggctgaatatatatgaaaatacttttataaccgatataagtgaaaattggacaaagtttgacggcggtaagatattggcagataaaataattgttgcaacacactttccgtttataaataaacacggcagttattttataaagatgtatcagaagcgttcatatgttattgcctttgaaaacgcagataatgttgacggtatgtatattgatgaagctgaaaacggtatgtctttcagaaattatgaagaccttttgctgattgggggaggaggtcacaggacaggaaagcaaggaggcaactggagagcggttaaagaattttcagaaaaatattatcctaaagctaaagaaaaattttattgggcggctcaggactgcatgagtttggacggaatcccatatataggacgttactctaaaaccactccaaacttgtatgtggcctccgggtttaacaagtggggaatgacatcgtctatggcggcggctgaaattcttgcagatttggtggttggaaagagcagtgaatatgaaccactgtttaatccaagcagaaatattttaaagccccagctttttgtcaacggttttgaagcagtaacaaatttgctgacgccgaccttaaaacgctgccctcatttggggtgtgcgcttaaatggaataaggctgagcacacctgggattgtccatgccatggctcaaggtttgaaaaaaacggggatttgatagataatcctgcgaccggaggtgttgatattgggtaactattttgacggatattattataaacaccaaaaaggagacgatgttctttctttggttgtgggcaggtcaaattcagaggagtttatacaggtaataaccagggattcttcatacaatgttccgtttataggtgagaactatttttctgataagggcgttagtttaaatataaaaactgatgaaatttccttaaacggcgatttggagtaccgggatttgtctcctataaaatatgatataatggggccctttaaatattttccaatggagtgcaggcacggaatcataagtatgcgccacacactggaaggcaggctgaaactaaacggaaaagaaatagacttcacaaacggtttgggatatatagaaaaggacagcggaaggtcgtttccgtcttcatatgtatgggttcaggctaatgattttgacgagccctgctcaattatggcttctgttgcggatataccatttttgggatttcattttaaaggctgcatttgtatcattcagtataatgggactgaatatagaatggcgacatatttgggagtaaaggttataaagtgtgccaaagacaaaataattttggagcaggggaaatataaactggagatagatatagacaaaaataacggacaagagctgagcgccccaagcaaaggtgagatgacaagaacgataatagaaacagcagcctgcgccggggagtttaggttttataaaaatgacgatatgctgttttctttaaagtcaaataatgtgagttttgaatacgaggcataatagtataatttggcgcatccatattggatgcgccaaatcaacgcaccaatgtagagtgcgacgaacacatataacgctctcatcagtctgaacaatttccaatccgcgcacccgtgtagggtgcgactcccttacggtaaaaattaatggaaaggcagcaaatatttcaatccgcgaacccgcataaggcacgacacaacttctttaattcatccgttgtaagtttaacatttcaatccacacatacgcatagtgggtgacttattttctcatgtttaggtttctctgattctattttaaaatttaaaattgctaaactggtgttaaaattttttaatttttacagcttttatctatacacatttataaactagggtctattctttttttacaatttctgcaaatttcataatgcttttgagttaaaaactcttcatcctttgttggttttactccgccatcaacaatccactgtaattcaatacaataacctagttctatttcttttttcaacattggacaatcaacatcatctactattttagtcatttattcatcaccttatatattatatttgcagtacaaacagtagtataatttcaatccacgcacccgtgtagggtgcgacagcggtgtcacaatggaaacaaggaacaactataccatttcaatacacgcacccgtgtagggtgcgaccgtctaacagaagaacacgaaataaatcaaaagttatttcaatccacgcacccgtgtagggtgcgactgcaaaaatgtataaaattggtatatttttattcttataattgttatattgcggcataatatttaaatctttaatataatatgtgtttataagaatgcctcttattatatatttttgtaaaaacgcggtgcgaacctcccggggaaatcatgtgagcttacggttcgcacctaaaatattagggggtcattaacatagtgtgatggctttatacctatgtgctcaactttgcttttgtagttgtttccgaaataataaaaacgcagactatctgtttctttgtctattattttctctaacttatgtaacagcatttttgattgtcctgcgtcaagaaaacactcaaatactgaattttgtactctttgaccatagttaacacactgttttgctacttttcttaaccttgtctttccggcgggggttacggtgtttacatcatatgtgattaaaacaagcatgaaactcacatcatttccatagtaatggaggatatgcgtccatatcgccgcggatatatcttgccagcaactgtgcttgtacaagtattgccgtgccccactgcattttttcttttgtgaaaggatgtgttattgtctcttgttttctgttctgtcattggctcagaatcgtttttcttgcttcatcacagatagtaaccgctccgctctctttttgagaaaaactatctatggtgacttcccgtctgtttattaggcttaatacaaatctgtcagcaagaacgcttctaaactcttccatcaaatcaagtccaagcgacagcctgcccggtctgtcacggtgcaggaagcctacatatgcgtctaagccggccgcctcagctgcggcagatgtttcatgtgcgagcacagtataaacataggacagcatagagtttacagggtctagaggagggcgcttgtttcttccgttaaacagaaactcgtccttttgctgaagtatcatttcatcaaatatgccaaaatatatgctcgctccgtaaatatgccgccttcaagtgtgtggagattttctttccattgctgttctatatatatgagcgcccattgtctgggacagaaagcgaaatgctggattcctcccaaagacagaaaatcatcctcattatattccattaaactcctccgcttcaaggccgcttagaggttcaactgatatagaataatccgcaagcgacttgccttcgccgctgacaactacttttaaactcctgtgtactgtggcggaggagtattgccctgctttgcagttatgtttccaccagtatacctttaaaatttccatactgccgtcaggtcttgctgatgagcaatcgttttcaaacagggtgcagagagcctttttaatctgctcggcgtcctcctcggtaaagcctgtcttttcagcaagctgaacgttaatgctgccgaaaaatttgtatactccgaaatcaaccctgtgttttgagcccattgtgtctgacgcttttgcttttccggacgcactgtttacgcttttggttatctgcatgcttgtaacgtcgataggtttaatgctcaccgcggtttggactgttacaggccctctgactccaactgatagattgtcgcctttaaacgcaaacacttgtccgaaactgcgaacgtctatccattctttgcaggcggtttctgcatatttatcaacgtctttttttattgcttttaattcttcgcacgcgtcggcgcgttcgtggaggctgtcaaagccgtcgtcttttctttcattagattgtacaaatatttattctcccaggtcttggagacggtttctgatttttcttttaaggcagacgtctgatacctcgccgtatccgtcataatttattctcggtctgttcccgtcgagcgggtctccgttagggttggctttgttaactgaaaataccacagcaaaatcaattttgttttgtaaagtgctcattagttttcctccgtttcttttgtttcgtcttttttatcatgtttttttaatagttctgctttttgacaagcatatcccaataaatactgtgggtcgagcggtttgttattcataaaatcattggcgcttatttcagcaataactttttgcatctcgtcgtacagccatgtgcttgaactataaagcttttcaacatacggaagcagtttttcatcaattaccataagcgttttggccggctgtattctgtatttgcttctaagttttatagcgttcggaggacgcttgtctcctgatttatacaaaacatagtcttcaatttgttcggcataggccaataccctgccgaaaagatagcttctgtctttgttgcttttatctaatgacatgctgtagttcatccctttcgtatcatatatgtatttatttataattgaacatgttatgctggtcgctttgctcaattcccagtcctcattaaaagattgaggatttgaaactctttgcagtgacttgttcataaaatctttgggcatgcgtttgccgtcggttatgcaggatattagtatttccatcaaatgctttttttgtttttcgtcaacatttcttccgtaggcagcatatataatatcgtttattgaaggcgcgccggtgaactcaatatgttttaattcttgttttccgtccggtaaaatcttgctgactagtttatatttgtgattccaaacgcaggtcgtatgccaggtttttattctgtcaagataatcgtttggtgaaaattcacggtagtatgtaatagacagccgccccggagttgctgattccaaaatcataataataacattgtcattatcaggtattttgtatttatatccatttactgccaactcaacaagcttggcatattgtctttcagaattataaattgctgccggcgcttcatctccaaacgggtcgccgccagccgttatgtcataggtgtcctgtaacggggtcggaatatcctcgccgccgacgcaccaaaccacaactgtttggtctccggttgaaaacccttggttactgaccagccatctgagcgcactgtgtgctttatcagagctttcaaatccaactgagaatacgttttccttatttttgaatcgtcctctatatgtgaaaccgtattcatcgtttgcagagattagtcttgcgctgtctccggttgttcgtatttttgtagggtgcttataggttacagcctgggtggttccgctgacgaaacatatagacttttgtttgcggtttttgcggtcgtattccatataggaattcatcagttcagaatttgtgttgcattcaaaagagtttccgtatttatcctcaacccgaaaacgtacaacagtctttaatatatcagcaggcttattgtctttgtcgccgttccattttaacttttcctccggaagtattaaaccggattctatcaagtcatgaaacacagtgccgcgttttatgtatttatatattgctttaacttggtttggacaattttcgtcattgcaccagtcagaaagctgggcgcagtatttttcataattttttgaattatcttgcttagctatgtatctttgcgcgtcgccggctatatattttaagttgttataaacaatatgcggcgcgttattgctgctgcgcacagcggaatcttcagtgcatggggttatcgttcttgcttctgattttgtcagcggacgtatacgcagcagctcgccggattcattcagaaatatctcggcgtgagcattttgaacggtgtgggaaggaggagcaagaggcatgctgcagcgttttaataattccgggctgtcttttaatttttcatatgtctcacagagagcgtttatccagctcatccaaatacccccccgcgttcaaattcttctgcgcctgaaaagttttttccgggtataaatggtttgattttatatttttcagtatccatcactattgaacattcttcaggacgtataaactctataattccgtttttcatctgagcattccaaagccgtgtctgcattttttcaagcccggattcatcgggataagtgataccatgaaccattatgccaaatgacatgctttcattatcataataaccgtttccttccccaaatgtgcagggttcgacatatccctgacattccctggcgcctagaaaaatatcgcgtcttccgccccggtccagcatacgtttggtgatgaaaaagtgtttattctcatttctgtcatccgacagctcttctcgctgcatgttccattcaaaatgggcttctacctggtactcggcgtctattaaatatgtatatattgacaggtcattagaattgttttgatattttggaacgcgtatgcctcttgattcggtgcgtatgggattgattattctcaccctatctatgtaccatataaacgtcggtttccagtatatactttcacatatgccttttaaggcctgatatgtgggaactgaatagctgaacttttcgccccccgctttggttatagggtcgctgaacagtgcggtgcgtccggtaaggcgaaagcttattttgttttctctgttcaaaaaaatcacctctttaatattttaaaattctaaatccggattcatgtatactccgtaattttcatcataaaaccttctgttgagcacaaatgttcctgtgtcttctataataaatattcctccgctgtctttcagctgccgtatttcattttcatacagcgatacgctgtacgcataactctttcgtaataatttggtcttttggctgatttctgagtgtccgtttaagctgttaattatttcagctccgtcttcatatggaacaagcacagaatatgtttcgctgccgataactgaaaaattatccccggctgccgcaaaggcttgttttaaaaaaggcagaggtctagcagtgtgagattcgattgaaaattcgttttttgaaagcagacagacaagcgaatcttctttaggcagtttcaccacatagtcaaactcgcttaaattgcttgttgggacttttagatattcgttgtaatacgcttctattgcttcacgtgagagcaaatcaatattttttttgtgggacatcacggcttcagtgcattcttttgcttttgctatctcagggagacttgagagattttcaccctcggcccgtataagatatacttcacgcagtccgttgaactctccttctctgttgcaccgtcctgccgtctgaatcaaactgtcaataccggctaaagctcttacagcgcacgaaaatgataaatcaacgccggcctctatcagctgggtgcttattaccacaagtttttcagctgaatcaatattggccttattattcagcttttgcgtccgttctttaatttctttgattagtttatctctatgtgcacggcagagtttggcggttagcaaaattttccggcagtcagaatttatggaatcatatacggcacgggcggtcttggtagtgttaaaaaccagcaggacagacgggtttgttattaaacgttcattgacgaattctgctatttcttcatagttcatacttttatcgcttagatttatagctttaacccttttgagagctccgtcagtttctgaactgtaaggaacaatatcaggaggaacactgagttttattggatgttcgctttcgtttgactgcggcatggtggctgtgcataaaattatggtggagccgcatactttgtgcagaaagtttattgcttcgttaaataggcttaaagttttaatgggtaccgcctgaacctcgtctataatgataacagagttgcaaagggcattcatacggcgctggcagcctggttttcgtttatatatggagttaagaaactgaaccactgttgtaagtattaccggcgcgttccacctctgtgtatataatgaatatttttcgtcatcatcgttgatgaaacctgaatggtgttccaaaaccatatcatcaccgcaaatctctttgactgcgtcggcggtttggtcaagaattgtggtgtatggtataacataataaatatggccgcaattatgcttttgggcatgatgaagtgcaaatctcagtgatgacagtgtttttccgccgccggtcggaacattgagcctgtatattcctttgttatcggaaaaatcacagcatttttgagacacttcgcatctaattttgtttagtgttgtgtttggggaaaatgacgcggctttggcttccattttatttacggcttctgaccaatcaatcggctcagctataagagggtcaatatcagcctcaaagcagtatgcgtcatagcggtcgctgtctaccaaagcagaaaataaaagcttttgcagcattccgcaggaaaaagcgttgaacggtttcatctttgctataaaatctcttacttctgcaacagcctttttataaagttctttaattttattttcgctgattacagtttcaaaaaatatttcggctgccttttgataaaaattgtcagttgtattcattttgtttaagaagccgttttccgcatctacagtaatgcagtcaaaaagcccggtatggtgtgaataaaccgcgtctataataagctgagctgtatactgctcgataacgtctgccgccgacgtataaaagtttcggtaaatatatagagctccggtttgtgcgtgatgaacagttccgcgcgccgaactgtcgtttttgcgtatgtattcctgaaactcgggagacgcctttcccatatcatgaatcaatcctgtcaagtatcccaaaatcccaagacctgcttttttcattgtttttgaacaaagaaccgcagcattttcagaatgatttaaaattgtttgtgttttgtctttatcgctaatatatcgggctataatatccacttttatctccgtatgttaaaacattaaaaaatttattgtaatttgttatattataaaataaaaagaaaaaattttgcaagacatttgtgatatttgttaaaaataattatttgtagacttaaaaacgtatacgccatagggcgcaagacagcgctttatggcgtattgttgtatgtttgaaaatttataaaatacgtttatttaaaaggcaaagttatatcgatttcaagaccgtctttattttttgcattaaatgttccgctgtgagcggttatgattttataggccataggcagcccaagtccgtgggcagtctttggaattttatttaaattggttaagattttttcatcagcaccggcgccgttgtcttttatattaatacatatgtcagtatcattttgcgaagccgatataaaaattttgcatccgtctttgttgtgaactatactgttgtttatgagattgaacaaggcgcgttcaagaagcggctcatcccccataattactgcattctcacagtttaaatttaattctattgaatatttatcggataacccgctgtttaatatatccgtaactatgtttcttattaaagtgcatatctttatctctttttttcggttaggctgcatgtcatactctaaagaagaaactaagtttaaatcttcaataagtttttttatttttaaggtttgttctgttattattttggctttttctttattttcgccgtctgtttccgaaaacagttcttcggaatatccgagtattatcgaaagaggcgtccgtatatcgtgtgagacgcctgagatccaattagaacgggcggtatcacgctgtttgattatttgattttttcgttctattgaatcagatgtagtattgatgttcttagcgacttctttaaaaataccgttttcagacatgtgtacaggtttttcttgttttaagttttgtataccttgtatcagcatttttatttttttatataggccgttgccaaaaacgcaggctaataatatagcaaggcaaagattaaatatcagcacagccagtattctttgcggcagggtatcaaaccaatgcatcgaaaactcaatattatattttccaacgctgtttttgggatatcccaatataaggagaccatagtcacagactttctcatacaccggatagtcgtttaagaaccagcgtgatataacggcaatatcatttatattataactcgccggaatatcgtccggcacgttttgaccccatactacgtttccgctttcatctataagtatacaccatgacccttggggaacggcagtttcataggcaagaatgtatccgtcttcggtgtaggtcaatgcttctgaaatgcggctgagagtttttgtctgagattcgggatatatttttgctgtgtcagccgccgtcatagagaagctgaaaaagtttatcagcagcaataaaattgatatgccggaagcaagcaggataaaaaacataaatatttttatggcggttttattcattgtctgaaacctccagtttgtatccaagcccttttacggtaataatatgtttgggctttgagggggctgtctcaatcttttctctaagacgtcttatatgcaccattaatgtgttttcgtatccgtagtaaccgtctccccatgcggcaaggcataaagcgtcataagtcacgatgcggtttttgttttcataaagtttttttaagattataaattcttttgcggttagcggaattacttcttccctaaatttaactgaagcggtttcaagatttataactctgtccgagagtttaatgtctgtattcttaataaccggtttataagttcgttttaaaacggcagtaactcttagaacaaattcacttgtaaggaatggttttactatatagtcatcggctcccagcccgagaccggtgagcctgtcgtccgcttcgccgcgcgctgttaaaaaaataacgggtgactgggaaaacttccgtatatcctcatatagagcaaaaccattgccgtccggaaggtttacatcaagcacgaaaagggatatgttttgttctttggcaatttgcaaagcattgctgcagttttcggatttaaagatgtgataaaagccgctttcaaatagtttgttttcaagaagctttaacaattctttttcatcgtcaacaataagtatttttttattttttatttcatccatttttatcacctgactgtattataccataatcggctgatagataaagcgaatatttttaattttttctgatttaaggtcagcgtaaggttaagttaagtctgatgaaagaatgaggtgttaaaatcgttataaattaaatgagaaaggaagttttatcatgtcaaatcaattagtaagaacgttcggattatctaaaagatatggtgattcactgtctgtcagtaatttggatatgacggtaagcgaagggaaaatatatggttttttgggaccaaacggagcgggaaaaagcaccacgcttaagatgctgctgggtcttgtccgcccttccggcggagaaattgatgtattcggcaaacggtttaactcaaaaaatagaatgaaaattcttaaaaatattggctcgctgatagaaacgccctcgtattacggacatttaaccggaaaagaaaatttggaaataattcagactatactcaaagttccaaaatctaatattgacaaggtgcttaaaatagtgcgccttgaatcccaggctgagaaaaaggtcagggcgtattcgctgggaatgaagcagagacttgggattgcttcggcgatgctggcgtttcctaaattactgatactggacgagccgacaaatgggcttgacccgtcgggaatacaggaaatcagggatttgatacggtcattgccgaaaaagtatggaatgactgtgatagtttcaagccacttgctttcggagatagaccaaatggcggacgatattggaataatagctaaagggcgtatgatgtttcaaggcagtcttgaagcgcttcatactatgggagaaggaaaaagccttgaggaaattttcttagagttaacaaaaggggaggagagcctgtgaagagatatttattttgtgagtataagaaaacaagaagaaaatatatttttgttatggcagttgccataaccgctgtggcgttatgctggggattatatggaaagtataatgagagcgcattaaaaagcggctggatgatgatgctctatcagcttccgcttttgaatacaatttttatgccgttgctggcaattgtagtggcctcaagatttgccggtatagaaacctcaatgatgaaacaattatgttcggttatgccgaagcaaaggctgtacgacgctaaactaatatatagcttatctattataattgtttcattgcttatacagtttgccgcagtctatatagcaggcagatgttttggattcagcggcaggtttcctatagaattgtatgccttatattttatgtttacaatagttccggccgtggaaatatatgtttttcaattcagtgtttctatgctttttaaaaatcaggcagttccgttttttattggagcgattggagaatttattggattatttgcactgtttcttcctcaatacccatggataaggaactcggttatttgggggcattacggagctcttcagtttgtgggaggggattgggacaaagtgacaaggataagcacgttttacttaatggatataaattgggttatgtttgcagtatcgatattattatgcgtagccttttattttataggacggactttatttgtccgcaaggaggtataaaaatgattttaagtattataaacgctgacagaaaaaaattaaaaagagcgccgctgtggcttgcttttatatttatgccgataatcccggccttgctgggcactttgaattattcagccaatttggaaatattggaaaacggctggtatagtctatggacgcagaacactctgtttacatgttatttttttctgccgataatgctgggtatttactgctcatatttaatcagtattgaaagagcgaatcataactggaataaggtgctttcaatgcccgtcccggtttggcaggtgtttttgtcaaagctgataatttcttcgtttatgttgattatcagcgagatctggataggtgttttattcattgtttcaggaaatttggcgggtattgactctgctcttccttcggaattgcttgtttggctggggtgcggaactttgggcggaatagttttggtgtctgctcagcttttggtttctttaataattaagaattttgcagctcctgtcggtatagctttaataggcggactttcgggtttagccgcgctggcaaaagatttcggccatatatacccatattcgcttatggcgtttggaatgaattccaatgcgcctcagcgtctaatggaagggggatatttaaattttactttgacatgtattatctatattgttattttcacaacaatcggaagcgtctatctttcagtaaaggaacaaaaataaataacatagttaataagactgtggctgcaaatcatcagccacagtctttattaattgaaagcaagcttcagcttacatacgtttatatgggtgaagatttaaagtgttttgcgcatatgtcagtgcttgtttatgccatatcgcctgtaagctgcaggatttcacatgttaaacgacactttcaatatatcagcacagattttattatattctaaaagtttcttgtttttaacctttctgtatatttactgtttttgggttacaattatattttattaaataaaattatattgccgattaaaataatttatagaagtatttatataaattgtttgttagattttgttcacacattagggtattaaagcataaatacattgatttatattttcacctattttgtcggtttatttgctgtttaaaaaactttctatatcctccggtgttatcttgccgtgttctttttcaaaatcgtcaataagcgagcgcattaaatacaatatttgaccgctgccgcttctgccgttatacctggcgacataataaaacttgttaagaaaatctgaatctactctaatgctaatatgttttttcttattcataagtattccctcctataattaatactgcactaagttttagtgatttatgaattgattttacactacaaatgtgatataatttcacaaatgcactaagtattagtgcacaatatttaaaggagaaatttacgtgaaaaatataaaatataaaattcatagaatttatcgtcttgcttctaaagtaaacttatatttaaacttatctgtaaaacctgacgataaacgtataaaagcaggacttaatgagattaaaacagttatagaaaaaatattatcagagagctaagaagaaatataaaagtgtctttttaggtatatttttaatatttaataaatagaaaaaagtttatttttaagtataaacgcgatagaggaagtattattaataatatatgaaaataaaaatatatttaattgaattttttgtgataaaattagatataactttatataacatatattaaaaagtttaaacatttttatataaatattttattatatttctgcattattaaatcaggttttatccgctgtaaaagcagaggagtcccggtaaaattttaaattttattttatgataatgttatgctgtctgattatatgaacgctgtgattcaatagcagttttagtaaaagatacttaattattgaaagctaatgtaagttaatttaattataacacgcgcactttaaaaaagttaagtcacagttataaattaggaaaacgaattttttgtattcaaattaatttttctgtccgccatattaacgtctttaagctgctaacattttaataagcagcgatgtattttaaccatcccaaaaacacaatatatagtaataaacaaattggagcaaattttttttgaactctacctacaatgtggagaggttataataaaattaacagaaatataaaaattatatataaaaaatatgtgtttgcaagcatcggagggctgtgaccacacttttcttaaaaagtgtgtgttatacatatgattttattttgccataatctacaatgtctgtgaccccaccattctggtgggtgtgatacaaaataacttgttttgattaaccttcaatgtcaataatatgaatacgcaaatattattatgaatactcaatgaagatgaaatctgccgcgtaaggcgcgcagtcacggtaaagtttattattaaataggatataaaaaactgttttaaatacgttcacgctccgcgtgagatgactgctcacctaacgaggaggacgtgtacgcaatatatcacaattaataacgtatataaattatatagaaataccatctgcttatatgctatataaataaaattattttataatggataaaatttataaaaagttcttgacattagaattttatgtgctataatctatatcatacttatttggtatgaaaactaggaatggaggaaaagtgcagatggatagaagaaaagaatggaagtttgaaacgaaacagcttcacgtcggacaggaggaagcggatttggctacaggtgcccgcgctgttcctatatatatgagctcgtcttatgtgtttaaggattctcagcaggcagctgacaggtttgctctgcgtgagggcggaaatatatatggaagactgacaaatcccacacagagcgcttttgaagagcgtatagcggctcttgaggggggcgttgccgctttggcggttgccagcggagcagctgccataacgtatactttccaaaatttagccaaaagcggagaacatattgtgtcctccaaaaccatatacggcggaacttacaatcttcttgccagcactcttccggattatggtattacggcaacatttgttgacccgtcagatacgcagaattttgaagacgcggttcaggaaaacaccaaagctatatttattgaaactttaggaaacccaaattcaaatgtttcggatatagaggaaattgcaaaaatagctcataaccataatattcctttagttgttgactcaacgttcacctcgcctaatttgataaggccgattgagtacggcgcggatatagttgttcacagcgctacaaagtttatcggagggcatggcacagctctgggcggagtaataatcgacggcggaaattttgattgggaaggctcaggaaagttccctgatttggtaaatcccaatccgagctatcacggtgtcagctttactaaagacgtgggagcggctgcttttgttacaaaaatcagggcggttctgcttagggatacaggagccactctgtcaccgttccatgcgtttttgtttttgcaggggcttgagactctttcgttaagggttgaaaggcatgttgaaaacacgcttaaaatagttgaatttttaaataatcatgaaaaagttgaggctgttcaccatccgtccttgccgggagaaccaacgcatgagctttatgaaaagtattataagaacggtgcgggttctatatttacctttgagattaaaggcggtacggaagaggcacagcggtttatagacaatcttgaaattttttctctgctggcaaatgtggcggacgcaaaaagtctggtaattcatccggcaaccaccacgcattcacagctgagcgccgaagagctggaggaacaagggataaaaccaaatacaattaggctctctatcggacttgaaaatgcagatgacttgattgcggcgctgggagacgcttttgaaacaatataacaaatacctccgttttgcaggagtattaattaagttttgaggcacctattacgttatagcattaaagcatgattgagctgctttgtgaaaaaaactttgaatggtatggtattattttcatatttttgatataatagttacaatataaattgtctgaaagagggaaaaacaatgagtaaagttgtaaagagtattactgaacttataggaaacacgccgatgctggaactgacaggtattgaagaaagtcatagtctggaagcgtctgttatcgctaagcttgaatattttaatccttgcggaagcgtaaaggacagagttgctaaaaatatgattgagaatgcggaaaaaaatggtgacttaaagcccgggtcggttattattgagccgaccagcggaaataccggaatcggtttggcttctgttggagtttcaaaaggatacagagttattataacaatgcccgagaccatgagcgctgaaagaagaaacttgatgaaagcatacggcgcagagctcgtgttaactgagggctcaaaggggatgaacggagctattgcaaaggctgaggaattggcaaaagaaatacccggagcgtttataccggggcagttttcaaatccgtcaaatccacaggcgcactttgaaacaacaggaccggaaatatgggagcaaaccggcggcaatgttgatattttagtttcaggtgttggaaccggcggaactataagcggagtgggaaagtttttaaaatctaagaatccgaatataaaaattattgcggtggagcctgaatcatctccggttttgtcaggcggaaagccgggtcctcatggaatccagggcataggagcaggatttattcccgaaactttgaatacagagatttatgatgagatagtcaccgtcgctgacagtgacgcctatcagaccgggaggaaactggcaaagacagaagggctacttgtgggaatctcgtcaggcgcggctgtttgggcggctgttcaggctgcaaaacgtgcggaaaacaagggcaagactattgttgccgtacttcctgacacaggcgagaggtatttatcgactcctatgttcacacaggcatagaaattattgagacttcagaaacgctaaaaaacacgtgatgttctaatgacctaagttttggtttgtttagaacattgcgtgtttttattataaaacgatttttttattaacttttatttattctgttcgaacattgggtatcatggaaaggacataataaagtggacagaaacttttaaggtcattaataataaaaagaagtataaaacacattcgattttttgttttgttttctgttgactttccgcctacaatgtaatgattagaataaagaggacgtaaatgtaagagtgaatttttataacacaaacccggacgatggggtcacagttacaccttccaatgcttgcaaaatcatatttattataaaatttatttagaatggatagttaacattttaaaagtatggtaacagccataccgttgtttgctatactacattctttatataatttttattatataaccttaacatttttgtgcaatatatagcagcatttccagtttattgatataagccgctttgtatcatacacactttttaagccgtcggcagttttaatttcataggtgtgtatcttacaccgtttgttatttgttctgagtcggtgttctcgaatccgaggcggtgatatattggaactgcaaacggcgaagagtttacggaaatattaccggttaagctgtctttttttatgaactctaaaagagattttcctatccctttattatggtatctgccgtcgacaaaaaataacgcaatatgacatcctttattgcgcgttgcgataataccaaccaactcagcatttagaaatgctccataccaatgcagtctgtttaaataatttgggtcatgaatgctattgtaaaattcgtcaactccgtgtttactgtattcaggcgcttcgtattctaaaaatactttccagaccaattttagggcttgttctatttcgtttttataaagttctcgtaaatgcaaataaccactccttaatggatgtacagctaatatttatttgcttgtattggtaagtaatttttaaaacggcttaaaccggttttatagttttcggctgtaaacctctaatatataaggttcttttgtttttaaatctattttttcttcagaatattgataagaaaaaccgcaggataatgccaaagctttggatatcttgttattagcccgtgttgaataaaaaaactcttttcctctcaaagtgttggcacagtattcaagcaataactgtaaggtttgtttgcccaagcctttgccggtatattcgggtcccagcgcaatgccggcgtcctgaaaaatatgtggggatatttcctcaaccccggcaaagccaatagcctgaccatgttctttttcgtatatgaagtatgtatcatgcgtcttttgataagtgatggttttctttattctctcttttgctgattcttctgttttggttatttgccattgcatatatttggctgtttccggtcttgaccaaacatttttgtgcattgattcccaatcctcaaattttgcttttcttaatacaatatcatctgtttccattggattcatatagattcctctcattttttattcaataataattcatctgaagtatagattcatataatagatatgtttgtaagctgcagagaaccgcaggttatatctttaggagttataaaattaaatatttatatatcagccgtcaactgattttagggcgttcatctgataatatctgccttttttagccattagctcgctgtggtttccgctctcaattatctgacctttgtctattactataatattgtcggcgtctcttattgttgaaagcctgtgggcaattattatgctggtgcggtttttcatcagacgaatcagcgccctctgaatgtctttttcagtctttgtgtctaccgagcttgtcgcctcgtccagtatcagtatcgggctgtcgcacagcaatgctctagatattgcaatcagctgtcgctgtccctcgcttaacgtgtcctggcttccggataccaaagtcagatagccgtggggaagccgtctgataaatccgtcggcgtgcgaaagtttggcggcttttataacttcgctttcagtggcttcgggtttggaatatcttatattgtctaatatcgttccggtaaacaggctggtatcctgcagaactacagaaaaacagttttcaagactttttcgttttatgtctttaacgtccactccatcaattaatattttgcctgaatccacatcgtaaaacctggttatcagattaacgattgttgtctttcctgaaccggtttcacctaccaaggcaacattctgtccggggtttaccttgaaagaaatattttttagtatttgtttttcatcgctgtatgaaaagctgacgtcttcaaattccaccctgcctttcacattatctaagtctaaagcatcttccgaatccgctgcttcctcgttttcatccagtatctcaaagacgcgctccgcaccggcaagcgcagactgaatattgttgaacagcccggcaacagaattgagagggttggcgaattgttttgaatacgtcataaagctgactgcagttcctatcagcagaccgtattttgtgcagagtattcctccgactatagcggttattgaaaaagtaaggttgtttattatgttcatcagcggcatcatatatcccgcccatatttgagcgctggttccgcttttctttaactcttggttgacttttgaaaaatcggtttgtgtgctttcctctttggaaaaggcttttatcattttaagtccgtatatgctttcctcaataataccgtttatctcgcctaaacttcgctgttggtcataaaaatgttttctgcttcttttagcgattactcttgtgagtatgtataccaaaggcacgcaggtcaaaacagccagggtcagcggtatgctcagagaaagcattatgataagcgagcctgagattgtgagtattgcagaagcaagctgagttgccgactgtgcgattgttgtgcttatggtgtcggcgtcattggtgatgcggctcatggtgtcgccgcgcggcgttgtgtcaaaaaaagacagcggaagtttttgcagtttagaaaatatttcgcttcttaaagtcctgaccaatttttgagacacacttaaaattgccgtatcactaattgttgttatcagccagtttgacagatagagagcggctataaccgaaactaaaattataagggaatgattattaaccgttctgagctcggtgttaaatgtgttgaaagtcttacccacaaagtagggaatcaatactgatattccggaagccagcaatgtaagaaatacagcggagataactatgcctttaaagcgcatatacacttttataaggcgcatcagagtgcctttttggtcttttgctctctcggtgttgctgaacctggcggctccgcctacttttggtcctcccattctgggcagctcaatattttttgccatattatcacatcccttccgtgatactgccaatctgagaatcaaatatttctctgtaaatgctgcattcctcaagcagttcgtcatgagttccgaatccaacgcgttctccgtccgataataccaaaatattatcagcaaacatggctgtcgaacaccgctgggttatcaggataacggtggatttattatcttctgacaggaggttgtctctaacctttgtttcggtgagtgtatcaagggcgctggtagcgtcgtcaagaaccaaaatcggtgagtttttgataagtcctcgggctatggatattctctgcttttggccgcctgaaatattaacgccgccgcttcctaagtatgtgtcgataccgttttccatttcatatatgaaatcggcgcctgatgcttttattgcagcttcaacttgagctttttcggcttttgggttgccccatgttatattgtccagaaccgtgccggaaaacagcatagctttttgaggcacaagggcgacgctttttctcacagtttcaatattaagtttttttatatctttgccgtcaaacatgatactgctgttcttgtcagggtcatataatctgagcaggagccaggcgagcgttgattttcctgagccggtcgggcctataacagccaggcttttcccggcaggaacataaaaggataaattttttatagccggaaccccgctgcctcccggatatgaaaaagtcacattgttaaactcaaccgtacctgaaataacggcgtctgagttattctctgagttcttgaaatcatcctcacagtttagtatctcggttattcttgaaactgaagctttggtttttacaaaagtattaaatatatttgttatcatcagcagagaacttaaaatctgcgccatatacactataaaggctgaaatctgaccgggctgggtcagaccgagagtgaaaagcctgcttccggcaagcagtgcggccgcggagcctaaaccaacaacaagggtcagtataggtgaaataaatgttattactatttgagcgtgcacgccttttttcataaggttcgcattatcgtcttcaaaccttgaggcttcgtcggaatatgttccaaacgcttttataagcctaactcccattaagtattcttcaactaccgtattaagtctgtccattgccgcctggagttttccgaaccggggatatgacagcctcatccctaagtataacagcagaccgactattataacaaccaaatagattattatgcttagctgcaggttgagtattgaagcgaggattatactgccgatacaggttagaggagccttaaaaaatattctcatagtgccgtttacgaattgtgtaagctgagtaacgtcgtttgtcattctgatgattagagagccgctttcgattttatcggcgcttccctgcctgaaattaagaatttttgaaaataaatcgtatcttaaatcggctccgaagctctgagaaactttgctggctattatatttcttgagacggcgaacactgcacccagagcagcagcaaaaatcatgcgtccgccccataggtatacgttctgtatcataccaagctctatgccgtcgtttattatatgagacatgagcgtcggtcccaaaaggtcgcagagagcttctagagctacgcatgatacagcaataaaaaaccagtatttatatttggtaaaatagcgcatgtatattttcaagtgctgtcgacctccattgattttattggtgtagatataatattaaaagcagaaaaaatttattagccaaaagggttaatgataaatttttctaagtatgttcacgctgcatgttagatagcagctcacctaacaaggcgcacatgcacgccctgctgtactaaaaacactccttatttttatgcctttaaaaagttttagatattatcttttgggtattgcggataacgttttttatcttcctcggttatttgacgtattggtctgcagggaacaccaactgctataacattgggcggaatgtctttttttacaacacttccggcacctattacagaattatctcctatttctgcaccgcccaaaatgacagtgccggccccaatccaaacattgtttcctatctttatcggttttgccacttctaaacctgcgtttctttgttcagcgtcaatcgcatgttcggcggttgtgatgcacacgtttggagcaataaatacatggtcgcctatttcaaccttggcgccgtctgtgattacaagattatgatttgagtagaaaaaatctccaatatataggttatatccaaaatcgcaccagaacggagcggtaacttttgcgttttcgcccaggtttccaataatttgttttagcagacgatttttgttttcctcatctgaaggtttaatctgattatattcataacataaatcagtgcacttttcgatttcatttacgatttcagaatcataatttgcgttgtataagtatcctgcttttgctttttctttctcagtcatttttatctctcctaaaaatatatttttataataatctatattttataaaatatatcataaaatttaaaagttatattttgatttagcgcctaatgagatgtgtaaacgtataatattacaaccaagtttgattactctgcaatgtctgtgaccccaccagtatggtgggtgtaatacaaagtaacttgttttattatagccttcaatgtcaataaattacttagttgtgatgtattgtgaccccaccagtatggtgggtgtaatacaaagtgcttagttgtgatgtattgtggttgtacatcccgttaggtaactgtcatatcacgcgaagcgtagaggtgcttagaatagtttgttatgaatcttattataatgaacttttccgtgactgcgcgccttacgcggcgtacttcgtacgccctccgaagcttgctataccacatttttatatgatttatttttaatatatttgattttacaatatatctccacttaatttggtctttctattcgagtattcatattattatttgcgtattcaaattattgacaatgaaggtttatcaaaacaagtcattttgtatcacacccaccataacggtggggtcacagacaatgaaggtttatcaaaacaagtcattttgtatcacacccaccataacggtggggtcacagacatcgtaggtttattaaaataagtccctgtggctcacacgtggtcacagttacactcttccgaagcttgctgtaccacattttttataaatatttgttatataaacttgatttgtttgtctgtttttttggagactttccggtaattataaaactcaaaatatatttataacaaaatattgaacatttcacagctcttaaaaacttttaattttattctgcatttaagagtatatcataaccggttgagtaaatctattgtatattttatatgaaagaaatgtaatattttaatcagccggttaataaattaatcaagctgtgggtaaataacaatatagttatggaaatatgaagaaacattattaatgaaataaattatacctgtatccgcaatttgcacaagtaatttactctcaatgttaaaaatttatttacaaattttttgtgaaaagctattgacaaagattgggtgtggtgctattattataccaggttagcactcgacttgtgtgagtgctaacaagtaaattgttttatacaaaggagggcaggcttatggcatcgctggatgacagaaaaaagctaattcttcaggctattgttgaagactatatcaaaaacgctgagcctgttggttccagaagcattgctaaaaagaccagtcttaacctcagcgcggcgacaatccgtaacgagatgtgtgatttggaggatatgggaatgctgattcagccgcatacctccgccggacgtataccatcaaatgccggatttaggttttatgttgacaacttaatgcatagatatcaaatgacggctttggagataaaaaggcttagagccgctatgatgaataactttagggagcttgacaatattattaagggcgtgtcgtcagcattttcttccattacgagtttgccgacgtttgctatgcttcctatgaataaatacggcaatatcaaaaatgttaagctggccgacgttgacggcagaacgataatggttattgtttcagactcttcaggtcttattaaaaataagctgctgagactgaggaatactgttacgcctgaggaagttgcaaagctgaacagagttataaatgaaaatatatcaggtcttgatttagacggctttataagtcttgacaatgttatgggtataaaggacgctgttggagaaaacgttgaaatcctttcatctgtgctggagcttatatatgaggctcagagagaaattgagagcaaacaggtggttgttgaggggacgtctaatatcctgcggtatcctgaatataatgatgtggaaaaaattaaaaatatattggaattttttgatgacgaaaacgtgcttggcgaaattgtggacgcggttcagtttgaaggagacggcggcgtggatatatttatcggcgacgaacttccgcttccccagctgaaagagaacagcgttgttgtttcccagtaccaggtcggagaagatttggtaggcatagttggagttatcggtcctcagagaatggattatgctaaagttgtttcaggcataaagttcttctctgaaaatttaggtcagatgcttagcagcagattcagaccggacgatgatgaaaatttcgattataacggcggaaaagaggatggttaaaagtgaaatctaaagaagaaaatcagcaggaaactatggataataaagaaagcaaaatagagaaatgcatggaagaccaaaaacagcaggacgaatcggctgaagctccggttcaggagacagagaatcctgaaattaatgaagaagagactttggctcaaaagctggaagaagcaaaagacagatttttaagaaaagttgctgagtttgataatttcaagaagcgcaccgctaaagagaaaacagagaatttctctttaggaatctgtgaagctgttgaaaagcttctccccgtgctggataaccttgacagagcgattgcggctgccgagagcaatgatgacaaagaagctctgcttgagggaataaaaatggttagaaaacagttctgtgaagcgctctcaggtattggagtgagtgaaattgaggctgttgggaaagagtttgacccggataagcataacgcggttatgatggaggacagcgacttgccttccaacactgttattgaggaatttgctaagggttacgcttataacagggatgacaatgttaaagtgatacgtcattctatggttaaggtttcaaattagttattaatctagttaacaattttactaatcatataaaataaatttattggaggtaattataatgagcaagataataggtatagacttaggtacaacaaactcgtgtgttgcggttatggaaggcggagagccaacggttattccaaaccctgaaggagccagaacaacaccgtcagtcgttgcgttcacaaaggacggcgagcgtttggtaggtcaggttgctaaaagacaggcaatcacaaacccggataagacaatcagctcaatcaagcgtgatatgggtactgacagaaaagttgatatagacggaaagaaatatacacctcaggaaatttcggctatgattcttcaaaagttaaagagtgacgctgaggcatatttgggcgaaactgtaactcaggctgtaatcactgttccggcttacttcagcgattctcagagacaggcaacaaaagacgccggcaaaatcgcaggtctcgaagtaaaaagaattataaacgagcctactgccgcttcacttgcatacggtctagctaaagatgttgaccaaaaagttatggtatatgacttgggcggaggtactttcgatgtatctatacttgaaatcggcgacggcgtatttgaagttttggcaacaagcggaaacaaccgtttgggcggcgacgactttgacgataaagttatgaattatctcgctgatgagtttaaaaaggataacggtattgatttaagacaggataagatggcgcttcaaagacttaaagaagcggcagaaaaagcaaaaattgaactgtcaggcgttacatcaacaaatatcaatcttccgtttatcactgctgacgccagcggtcctaagcatcttgatatgacccttacaagagctaagtttgatgagcttacagctgaccttgttgagaagacaatgggtccggcaagagacgctatgaaagaagctgggttatcggctgaccaaatcgataaagtattgctggtaggcggttcttcaagaatcccggccgttcaggacgctgttaagaagctgacaaatcaggatcctcataagggtatcaaccctgacgagtgtgttgctataggcgctgctgttcaggccggagttttgacaggcgacgttgaagatttggtgcttttggacgtaacaccgctgtctttaggtattgagacaatgggcggcgtgttcacaaagctgatagatagaaacaccacaattcctacaaacaagagccaggtgttcagcacggctgctgacggacagaccagcgttgaggttcatgttctgcagggcgagcgtgagatggcggcttataataagactttgggaagattcagtctcacagatattccgccggcaccgcgcggagttcctcagatagaggtaagctttgatatagacgccaatggtattgttaacgttaaagctaaagatttgggcacaggtaaggagcaggcaataacaatcactgcaagcaccaacctttcggacgaggatattgacaaggctgttaaggaagcagagcagtatgcagagcaggataagaaagcaaaagaggaagttgacgttcgcaaccaggcagacagcatggtttatcagaccgaaaaaactttgggcgagcttggggataaagtgacagaggaagaaaagagcggtattcaggctgaagttgataagctgaaagaactgctcaaggctacgccgatggatgttgaagcagtaaagactcagacagaagaagtgtcaaagaagttctatgctgtaagcgagaagctttataaggctgctgcagagcaggcgcaggcagaacaggcagctgcgggtgcacaggacgcaggagctcagaacaatggcggagatgacaacgttgtagacgctgattatacagaatccgagtaatataaacaattgtgtcaggaaggaataaaagtatggcagataagagagattattatgaagtccttggcgtaaataaaggcgcatcggctgacgagataaaaaaggcatatagaaaattggcgaaaaagtatcatccggaccttaatccggatgataaggccggagccgaagctaaatttaaagaggccagcgaggcatatgaagttttgagcgaccctgataagaaatcgagatacgaccagttcggccatgcaggcgttgaccctaatgccgctgcaggatacggcggaggcggctttggaggattcggaggctttgaggattttgacctgggtgatattttcggaagcttcttcggcggaggggcgtctcgccgtaaccctaacgctccgcaaagaggcggagatatccatatgcacattgatttgacttttgaagaggcttgctttggaactaaaaaggaaataactatcagccatatggaacaatgtacatcctgtcacggaagcggagccgctgagggcagtcatcctgagagatgttctgcctgcggaggaacaggtcaggttaagtcagttcagagaacaccgtttggaagtatgcagacggttagaacttgtgaggcctgcggcggaaaaggaactataatcaccgacccgtgcagaacatgccgaggcgagggaatagtcagaagaagcaagaagataaacgttaatattccgggcggaattgataacgggcagagcctgagtgttcgcggcgagggcgacgcaggcaaaaacggcggaccgcccggagatgtgcttttgacagtcagggttaagccgcataagatttttgtccgccaaggcagtgacataatgtgcgattatccgatttcatttgtacaggcaacgctgggcggagaggtgaaagtgcctaccgttgacggaagcgttgtatacaatatccctgagggaactcagcccggaactgtgttcagactaaagggaaaaggcgctgttaagctgaactcaaataaccgtggcgaccagtatgttaaggtacaggttgagataccgaaaggaataaacgaaaagcaaaaggaaatattaagacagtttgacgacagcgttgacccgtccaaatataagaagcgaaaatcctttatggataagttaaaagatttgtttgaataaaatatcacagactgcaccgtatatagtgcagtctgttttcatacaaaataaaaaagatttaaaggtttctagtgaacgtcggcagggcagacaaagtctgccgcgttaggtgaactgccatctcacgcgaagcgtgaatatatttagaacagtttgtagtaaactttaccgcggctgcgcgcctaacgaggcaaactccgtttgtacatcacaactaagtttgattattgacactgtaggtttatcaatacaaatcactttgtattacacacacttttttaaagtgtggtcacagcccttcgatgcttgcaaaccacatttttatacaatcatattataaattgtcttaacatctggactttttaggtatttttggtgaacatcggcagggtgtgcttacgcacacctcgttaggtgaactgccatctcacgcgaagcgtgaacatacttaaaatggtatgtcataaatattttataatagtagactttaccgcggctgcgcgccttacgaggcaaatttcatttgccctgccgacgcttgccatacacatttttattatatatgaccttaacatctgttaaatctattgagacttttcaggtgttttggtgaacatcggcagggtgtgcctatgcacacctcgttaggtgagcacccatctcacgcgaagcgtgaatatgcttagaacagtataatctaaaaattaatatattaaaataataatttttataaaagataagtgacgcggttatttaaaatattaaagctatacaaatagtaaatgtattattttttgaggtcaatattgtaataaatgaattattgtagtataatgtaaaaaaagttttgaggagaaatttatggattggataaaagtcagcattattacaacaaataaaggaatagacccggttagctcagttttaaatgatttgggatatgacgggctggaaattgcggataaagacgatttcaaagaatttttggagaataaccgcaaatattgggattatgtggatgaggaactggagagacttaaagaagcggatacaaagataactgtatatctggacggcggcaatgatggtttgtcagagctggagaaaatagaaaaatctattaagttattaaaggaagccgatacaaataatagcttcggttctttaaaaattattactgaaaatgtaagagatgaggattggtctgaaaattggaagcaatattttaaacctctcgaaattggtgataaaatattgatacagccggagtggcagcctttggagtctgagacggacaggattgtttttaaggttaatccgggaatgacgtttgggacaggttctcatgacagtacaagattttgtatagaagagatagagaagaatatacacgagggcgacactgttttggacctgggctgcggaagcggaattctttcggttattgcattgctcctgggagcgtcagacgcttgtgcggttgatatagatgaaaattctgaaacagtagcatattcaaatcttgaaatgaatggacttgataagaacaattatcatgtttatatcggagatattattgaggacagcggtctacgggacaggtttgcagaatacgatattgttgttgccaatattgtagcggatgtgattatcgcactcagtccatatgttcgtagatttatgaagaaagacggaatttttatatgttcaggaattatcaatgaaagggcggaggaggtaaaatcagctcttgaaaaagccggtttgaagatagttgaagcaaagcagtcggatgaatggaccgcatatacctgtaagtgattgttttgaattttatttttacccaaaatgaaattaatttatattattgatgtaaatttaagattgtgccgaacgaaattgctgattatgatgtgtttcacacaagtgagccgcgttaggcgagcgctcgtttcacgcggggcgtgaatatacttagaacaatttgtaataattctttttaattataaacttttccgggactgcgcgccttacgaggcaaacaaagtttgccctccgatgcttgctgtatcacattttttcatatgaacttaacttttttgtccagtttttcgtagcctatccacagacattaaaggttttaggataaagagttatatagttcattttcattttcttaaaaaattttgttacatctcctgaaatttgaaaaactctaaaaatttattaagtaaaagttataaattaacgaaatctttaacttttcataataatttatttttaagcttttataaaaattttttctatttttatatatagtttaaacagtatcattgagaatctaaagaaatataaataacaaaataaaaggtggtaatagtgagcgtcggtaggccgcatttatgcggcgcgtaaggtgagcagcgcggacagaatataaaactaaaagttatactaatatattatccaacgcctactcacataacaatgtggtttgcggtcatatagcatattcaaattatttcgcatatacagattattaacattcgccgagagcacgatgtactctcggcgtttatattattggttaatatattgggtcctcatttcttctttaaaaaatagatttacaaaatccactgtactgtcgctgagtttttcttcattgataacttctctggcagtaagcgggtcgtcggtgagtatattgtctatgtcatatttgcagatattaataatattcgatggctcattgactgtccaaacaaacacttttttattattctggtgaatctgatctactatatcataatctataaatgtttcctcaatactgaacccatcaataaaagtcatttcagaaatattccctgcggccacagtcatgtcgtacagggtttttatattagggtcaatctctttgacctttttcagcgcttctatatcaagagaagcaagcatgcagtcgttttcaaatccgtttgcctttacaatgtcaatgacattcttttcgaaatcggtttcatgacctgttggctttatttctatattaagttttattttacctttgcataattttattacttcatcaagagtcggtagtctcaggtatgagtattcgtctgaaaaccacgaaccgacatcatatgtttcaagttcagcgtatgtcatttcccaaatatttttatctacgcctgatattctttttatattagcgtcatgggaaatcacaacaatattatctgcagtttggtgaacgtcaagctctatccagtcggccccttgttcgatcgccgccgcatatgccggaatactgttttccggataatccacagaactgccgcggtgggccgatatttcaggctcgttattaatattaaaagcaaagtcgtcaggagcgcctgcagctgtcagaatagtaaatcctataaaaataacagatactattcctaaacatacatagttgagaagtatgtgcttttttccttttggaggaatatatttgggaatcggttcctgttttttgtttttcagcttatagtatatgacgctgagagaagcataggaaatagtcaaacttaaagtttgcactgcaatacttatcatatctgcggcacggacggctttcagcgaatatagatattgcatatcgggttcgcagaagaattttataataagtattgagctaactgaaaatacggtttttataataaagcctataaaaaatataagcacaaccggtgcaactctgcccaataatacaataaaaaagttctttttggtcagcgccagactttttttgcttgctgatacaaaatttttcgattcaaagcagaagcatgtatagttcagagagaagcgaatagataatatgaacaatatagtatataagcaaaacattagtatagataaaatgttgctttcatatatgtaatcctgaataaattcagggattgcgtccactccggtgaatcctgaaatagcagtggtgaaaagcagggtatataaaaatatcaatataactccgcttttgaacggcttaaaagtacattttccggctagtttaaacatttgcacaattgaaatatccttctgattataagaagcatgaacataccaggttacagacataattttaaatattaccatcaggcagctcactaataaaaccgcaagccatataaaaattgtggcgggtcttgaaagatagtaaataatcttatcgtttgaaagatacgtgagtccggaaagcgacatcgttttatcaatagaaaagctgagtatcggatagataagaaaaactgttataaccgaataaataatttcaaatgccaatagagtgctcaaatttcttgacagcagctttagacaaagcctgcaatagttaaataattttttcattttgtatctccatatagttttggctgtttatttgaaaatattatatcgtattttattttaaaaatcaacttttacgtctaaattaatatattttgtgctgcaaataggttatattgattttactgtatatttaccgtagacaaataaataaaattacaaaatagccttttataaacagaacatatattttaatgtatattttattggaagataaagcagaataatccattataagctaataaaattttgttgtgtataatggagtgtgtttttgatgactatggatttgctaagagttgcggcagcctcggtaggttctattattgcattgtttgttttgacaaagctgctgggttataaacaaatgtctcagctttctatgtttgactacatcaatggcattagtataggttctatcgccgccgaaatggcaacaacggttgacggtagttttatgaagccgcttcttgctatgactatatacgcggttttagtatattttattgatttgctggctgttaaatctctgaagtttagaagattctttggcggcaggtctttggttttatttgaaaacggaaaactatataaagaaaatttgagaaaagcaaagatagacgtatgcgaatttttgactgagtgcaggctcttgggttactttgatataaacgatatatctatggcgatgatggagaacaacggaaaaatatctgtccttccgaccaccggcgcgcggcccgttaatgtggaggatatggataagaacatgcagggagttaatcctaaaaaaccgtcaagggcaagtataaatgttattttagacgggattattctttatgataatctaaaatacacaggtaataatgacatatggctgaaaaatgagcttggaaagcagggtatatcagacgtaaaaaaggtgtttttagcaacggttgatgaaaacaacaaactgtcagtatttaaggaactgagcgaatcgcccgataatgatttgtttcaatagggcttataaactattttattacagcatatataaaatgactcctgcttttgttggagtcatttttaatttagaagataaggccggtttcataaaacatacagcaatataatattaatttagtattgctataccgctactaatataatgttgaaaataatgtaacttaaaacatataagagcaggataatacaaatggaaagttaacagaaacttgccaaaaaatggtgtctatagcgaacatcggaagggtgtgcgtagcacaccgcgttaggtgagcatacatctcacgcaaagcgtgaacgtatttaaaacagtttgttatatcttatttagaaataaacttaaccgcggctgcgcgccttacgaggcagatttcatctgccctaccgaagcttgcaaacccatatttttatatattatctttatatttctgttagttttattataacctttacatattgtaagtggaagtcaacagaaacttgccccaaaatagtgtttttagtgaacatcggcagggtgtgcgtagcacaccgcgttaggtgaacatacatctcacgcaaagcgtgaacgtatttaaaacagtttgttataattatatttaataattaacttaaccgcggctgcgcgccttgcgaggcagatttcatcttcattgagtattcatgttattatttgcgtattcatattattctttgagtattcatgttattatttgcgtattcatattattgacattgaaggttaatcaaaacaagttattttgtatcacccccaccatgctggtggggtcacagacattgaaggttaaacaaaaaaagtttctatggctcacccccaccatacaggtggggtcacagactttgttggatgtaaagaaatgagtatgtatagcacacactttttaaaaaagtgtggtcacagccatatcgatgcttgcaaaatcatatttctattatatttgatctttaaacttctgataattttattaaaataaaaagtcgtcttattttatttattgtgatattgcttgtgaatatataaaagtttgacccaatatgtataatgttctgattttatgatttgctaaaccgattgacttttggtcagttatacagtataatattagtaagtttataagaattaaaattgatttgttcttttttgatttgtatttattttgtgttttgtaatctatcacttcttatgcgtcaataatattcgtcacaaataaatatttgtcaaagcaatcaagacgttttctttcagcaagattttattttatggaggtaagtaaatgaaaattaaaaaaacaattgctgccgctttaactgttgttatgctgtcaacagctgcttcaggggtatttgcttcaggggcaaatgaaaatatttccgggggaattaacggcggcgcagaggaaacccagagttatttaggggataatgaaagcgagttattggttagcccgtccccgggtatttttgacgataatgaggaaggcgcagaagacgttcagcctaccctttatcccagcggaatacaaacggcggagcctgatattaatattgaatcttccagtccggagccatatcctgagacaactgacgttccgtctgaggagccggcaaacgatgtgatgatttcatcgtaccaggttaatttcagctgccggcttgacggatggccgcgaaaggattatgctgtatttaatatatgttcggaagatggaaaaatccttgattcacacacaaagtatattactgatacggagagtttttcaatagattttaatataccggattctaaagtgggaactgtcttttatttggaggtaacaggcgttgattcaatagattattattcggataattatccggtgccgcttactgaaaagattccgctgtatacatattggtcggagccggatgaaaacggagacagggttccggtgagctcggcgcatatgaccgcacacgtcagaacacagtgtcctattaatatatacgctgacggagaatatgtctctctgtcttcgcctgctatatttgacggctcgtatataatagcaccgctgtcagagattgccggggcaataggcatatccgactgtacttacttccctgaatataatagcgtaaaggttaagaccggcgataacgaaatgcttgtcaatattggatattcgtatctgacagcgtttggcagcgatataaatctagaccttccggtttccaatattaacagcctgacatatatagaattaagaccgtttatagaggccttcggaagcactcttgaatattacgacaatggttcttatattgatataaaacttactaaatcccccatggctgtaagctctatagctgagcaggaggcaagaataaacgagagcggagttggaagctcgaccgattatcttatctgggtaaacaaagaaaagtttagatgcaccgtattctcaggttctaaaggcaattggaaatgggtaaaagattttactgtcggaataggagctgagggaagagaaacaataacgggcgtgtttgaatatattgactatacgaatatgtggccttatgattcgtattatgttggcccggttatggtattctacggcaattatgcactgcattcaacgtttttgaaatatgacggaaccccatatgataacactgttggggcgaagatttctcatggctgtgtgcgctgccaggcaaaatatataaactggatggtagataatatacctatgaagacccgtgtatatgtaactgaatcttaaaatattataatgagccggctgcaattttgcagccggcttttaatatccctgtaattctaaatataattcaaataaatgatatattgtggtttggtggttctgaattaagaatatactacctaaatttagcaaatcaatgttacattaagtcgtgtatttgttacttatttttgttatatcgttgattatacgtataaaagtaaaattattcctattttttcacttattattgttgacaagtgaaatgctttttgatacacttatttaggaaatatttttcagtgggagataattatggaagatttatacgaaaatgtcgaagattgtagaatattaattaacaacagtcagcttgatgatgaagttattaaactatgcgataagataaatacgaagattgatgaaaagtatggcagcgtggcgcggttctccagaacggttaacgtaccctattcaactttaaactgtattcttaaaaacggtttgtcaaacagtaagttttctatggttttagatatatgcaggcggcttagagttgatatatttgatatagaaaaatatggaattaaagctgcggatatatccataatatcaaaaatttcgtcgcttgatgagcgcggaatcggcgttatttcgggcattatagaggaggaatataaacgatgtataaaaattataaccaatagttgacaaataaatgtaattatgttagaatgaaataaaggaggtgttttaatggatgaactaactctgctgattaagcaagaaatcaaaaaacaatttcgcagtgtacgccaatttgcgttcagtgtaggaatcgcacagacaactgttgtcagcgctctgaagaacggtgtttccggcacaggatttagtacagtgatgaaaatttgtaaagctttagacattcaagtatttgattactctatcccgctcgtgatcaatgataacgtagtcacattacttaaaaagtataatgctcttgacaaattagctgaacatacagttcagactgtactcaacgtagagtatgaaagatgtaaagcagacgcaatgaagagctcaaagcgttagttttacaaagtttgtttagttgtggaatcttcgtctgtaaaagcacaggcaaatcataatatgtctttcagattgtggcatattaaatacaatgatatttacaatcttgactcatatatcatagccttgcagttgtttttactgcagggtctatggtatattttattttagtttattaagttaatatcaggaatcgtatccggataactgactgtagttctggattcaattttttcagggcagttttgggtcttaaagctgacattaatatttttaatttttaaattatctttatcaagcgtcagtgttcggttaattgttatttcatcttcgttgatattaaatgttcttttataatatgaagcatattggtctgatttatttaggcgctcagtaaatataaccgtatattcactgtcatcttgtgagaccgaggaaatctccaggtcttttataccgtttaattcaagtatatcgttgtaatcagataaatagttttgatactcatcataagttatatcagtttggttttcctgaatccctaagtggattccgctttcatcagcaggatccaaaaccgtatagtaatattccggggataatacgaaccaggttccgctgtttaggtccgcaccgtatatccatatatcgccgtctttgttttcagcgcagataattgactgggcagatttagtctctccattctcaatataatactgcgcagtagaaatttgagttatctccccgggcggtgtaagattttgtattgtattcacgtttaaaatatcttctgcagttagattatcacttgtagttatgtcgtttttttgatttgctgatgtacatcctgagaaaataataataattaaagaaataattattattattttagttgtagaaattttattcataattgtcacccgaatatttattagattacaaatacagttaaaactgagttgtttgccgccataaatgcgtccggtattttcttaaactatgtataccaactgtattatgaggaacatcatttattgaatataatcctgcgacggcgttgacggcaagtatattataaatgataaacttatgtgacatgagtttattatattgataatttatttatgagaaataattatttgaaatttataaaggcagctttttagtatgattgtaatcttacagtttgctgaattataaataaaacattattatagtttattttgatatagaatatgtgctctatattagtttgctttccaaatagatttgaaatgtaaaatatatagagcacatatttttgtgtacgtattaaatttattttgccgctttggcaacagcttcagcaactgcagggcttacgcgcgggtcgaaggctttagggattatatagtcctcgcttagttcctcgtcagaaataagtccggcgatagccttgcaggcagcaatcttcatctcctcggttatgctgcttgccatagcgtctaaggctcctctgaaaatccccgggaaagcgataacattgtttatctgattaggaaaatcagaacggcctgtgccaacaacgcgagcgccggcctctttggcaaggtcaggcattatctccggcgtagggtttgccatagcgaacacaattgcgtcgtccgccatagactcaaccatttcttttgttacaatgttcggtgcggacactccgataaatacgtctgcgtcctgcataacatcagccaagctgcctgtctttccgtcacggtttgttattttagacattttttcctgctctgaattcagtccgttcatgttctcgcatatagcgccgattttatcaaccaaaataatattttcagcacccatattcatcagcattctgcagattgctattccggcgcttccggctccgttaatgacaatctgagcgtcttcaatttttttgttaacaactctgagcgcgttaatgattccggctgacactactattgctgtgccgtgctggtcgtcatgaaaaaccggaatatcaagctcctcctgaagccgtctttcaatttcaaaacagcgcggcgctgaaatatcctctaaatttattccgccgaaggtaggagcaatattttttacggtttcaactatttcatcaacgtcattggtatcaaggcaaatcggaaaagcgtcaacgccggcaaagtttttaaacagcacgcacttgccttccataaccggcatacccgcctcagggcctatgtttcccagtccgagaacggcgcttccgtcggttacaacagcgacaagattgccttttcttgtgtagtcgtatacctttcttatgtcctttgcgatttcacggcacggttccgcaactcccggcgtatatgcggtggaaagctcgtctttgttattagtttcggcgcgggcggtaacttctattttccctttcaaacgtttgtgcaattcaattgcggctttgttgtaatccattttatcatctctccttgttcttatcatataatattttaagaccgtccaaggtgagcagactgtcaaccttgtcaatctcgtctgactctttagatatcattgtggcgagtccgcctgttgcaacaacagtggcgtcctctccgatttctttttttatacggcgtataatcccgtcagcttgtcctgcctgtccgtacacagcgccgctctgtatagcgtcgattgtgtttcttccgataaccgaagacggttttataatctctaccttaggaagcttagcggttttttcaaaaagcgcgtccattgagatttttattccggcggctataacgccgcctacatagtttccgttcctgtccaccgcgcagaatgtggtggcggttccaaagtcaactataacaagcggcggtttatacttgtgtattgcggcaacggcgttgactattctgtctgcgcccagctcgcggggattgtccattctgatattcattccggtttttatcccgggtccgacaaccataggcgtgcagtccagataacgtttaacaccgtttgtaagcgagtgcataacagtggggacaacagacgctatcataacgtcgtctatctcatctggttttaccccttcattcaacagaaattgtgttataagcataccgtattcatcgctggctttgtttttatctgtggccatgcgccagtgacggcgcagattatcgttttcatagagtgcggcaacaatgtttgtgttgccaacgtcaattgtaagcagcatattatcttcctatctgattcaattttttaatactttttatcttttattaagaataaattataataaaatatttatagtttcttgatttcagcgtttacaccgctgtcggttatattgagaaccgcataagagtatctggcacagcccggattaagcataagaatcccgtccgtttctctgataagagcgctgtgggtatgtccgaaaatacatatgtcggctttaacgtcgtgagctttctgtcttaatgtatacattccgctttttacattatagcggtgaccgtgggtcagaaaaatacgtttgccggaaaactcaaacagtctgtcataaggaacgtcgttaacgtaccaatcgttgttgccgagaacatactcaaatggaatatcagggtatgcggcggcaatgtcgtccgcgtcacgctgaatatctccggcaaaaattattaatgaaatatctttttcactttcaacagcattcattatgctttgaaaactgccgtgagaatcgcttaacactaaagctttcattaataagcctccgtttcagtaataataaaatattatagcacataaatatttttttgtcactatttttataaaaatacatacaatgtaatgtgaaaggagttgtatctaatatggacataaatgatttaacaaagggtgttaatcagaataatctcaataatactcttaaacagttcggaaacgtaatgtcgaaagatcagatgaaccaggtggtaaacactataaaaaacacaaatcaggagcagctgaaacaacagctcagcaagatagacccgaaagagattaataaggttctctcaagcaatccggggcttcaaagggcaataggctccaatcctgacgtgatgaagaagttgaacgctatattttcaaagaacgggaagtagttttaagtatattcaaaacttactctgaaaggtggcgattatatgaatgaagagcagaatatggattttgactttggttcggctatagaaaaaattcaagagatgatgggaacggacgacggacagtcaaagcttaataatataatcaacgcctttgtgggttctgatgaagataatgcgaacagtcaggaacaagacagcccgtttcctgatatggatcagatggatatgatgataaaactcggaaatgttatgtctgcgatgaagaccacaggcaacagcaaaaatgcggctctgctttacgctttaaagccgtacctgcgtgaatcaagacaggaaaagacggacagcgcggtaaagataatggttatggtaaaggcctttgctctgctcaaagacagcgaccttaatctgaacttttaggaggcggagctatgtacaaacgttatcaatccccgccaggaagcaaaccggcgggtaatccgagacctcagaaccatccccggagcagtcatcaggatatgggcggagaccgttttcagaacagctataatgatatgggtgataaccattttcagagcagtcatcaggacatgggagggaaccattttcagggcggtcatcaggacatgggaagaaaccattcccaaagcggtcatcaggatacaggaagaaattattctcagagcagccgccggaatatgggaagcggtcattccaatgcaggttccgggaatcgacaaaatcagagggcaaatcagaattatgacacacctcggcataattcgaacgataactttgagtatgacggacatagggatgatatgaactggaatcgggcggcggactataaccataggaatgagcctcggggagcgccaaacccgccggccggcggactgggaggacttttgagcggtcttttcggcggaggaaagtcaggcggaagaagagaagagccgaacatagtaaaatcaattttaagttttattcccccgggaatatataataccgaaacaaaaaaaattcttggcatattaacagcggaggatcttctgcttgccgctctcatactaatgattgcagacagtgacgaaaacgatgacctggcgctgcttatagctttggtatacatatttatggcataaaaaatagtgactattatcaaaataggataataaaaagtaattaaattgttatataacgccgttgacaataaattcgtttaataatataattaaaatagttaaataggcgtgttgtgtttttaggaatttattaaataatataagtgaaaatatagtttcagtattattttggaggttttatactaatgaaaaaggttttggggtgtgttttgctggcggcaatcctggtgatttgtctcggtatgagaggagttgttccggttgatgtcgaccaaaaggctgacgatactaaggtgacaatgtatgcggaagacggcaggagcgaacagtttgacccgtctgaggctgaagctcagaagagcgttggctggtatgataattttaatgacgtaataaccaccatgtggaaagatgacggaagcagtatagtagtgtttaaagctgatgtgtctaagtacgaaaaagacggatatactacaaatcatgattctatcttttcaaaggtttttaatccggctacagaggaagaaaaggacgttttgaaaagtgaagtgcagacatacattgataacggctggaagcgcggcaacggaaaagttgaccctgataagccaatggtgtgtctgacatttgatgacggaccgaatccggctaccactacaaaacttctgaaagctcttgaagaaaataacgcgagagcaacgttcttcatgctgggcaacctggttaaaaacgtcaagggcggaagcgatacaataaataaaatgaaggatatcggctgtgagctgggaagtcatacctatgaccatacacagcttactaaacttggaactgacgctttaaagaagcaggttcaggatacaaacgacaatattaacgacattgcaggtcaaggcgcaactgttcttcgtccgccgtacggctcatataatgataatgtcaaatcagtttgtcagagtttagaccagcctataatattgtggtctattgatactttggattggaagaccaaaaatgccgacacttcatttagaaatgttatggatcaggtgaaagacggagatataattttgttccatgatatttatgagccttctgttgaagctgctatcagacttataccggcactgcaggacgcaggataccagctggtaacagtatctgagatgggcgaagcgaagattggcggactaaaacccggagaggtttacaccgatttttgggacagcactgttaagaagctgacaaacagcagctcaagcagtgagaagagttccggtagctcggacagcgaaaagagttccggaagttcaaataatgataagaagtcaaacagttcaaacagtgacaagggaacaagttcttcaaaaagttctgattaatatatcttaaacgtaaaagtttatttcagactataatatgcaatgaatgagttttaaataccgcacaattacgtgcggtattttttgttaagcactgacaggggaagtaagtatattttgaattgaacttttgaaatttttattatagaatgaaaaaatttttagcgtatttattttagtattggaagataatttgaaatgtttttgccacgagttgatataaatgtatgagatttctattatgaagaggtaaactgtgtataatttttttagtaacatatttagaacaattctgcagtattaattgacagacaataaaaatataaataagaaatgcacataaataaggacttatctatatccggtatattatgtgcagcatttttaacattgaatgttcttagtttgattaattttttatttatatctcattgataattatcgaatatttttatgctaaaaaataaaaattaattattaaaaaacatatgacgcgttatgtcatttaatatgataatatagtcgtaacggaaaccggcttatttcctatttggagataaatatgagattggtctatgctgctgttgcatagataatgttatgaagaaacaccagacagattatagaataaatataaagtttaataaaaatagttaatatagttggtaagatagtaatcaagatagtaactaaggcagtagaccattatataaacaaaaccaaacaatactaaactaaactatacaaaacaaaacaaaactatttataaattatataattattttactttatattttcttttaaaatatgaagtgcacagaacaaatacataaaatagtagaataaaaaacttaatgatgaggatatagaataggtaattaatcttgcagaaagttataaatataataataaaagatattaacaaattcgtggctgcgcacctcgcaaggcgcataaatgcgtttgcgtattcaaattattatttgcgtattcatattattgtaggtaaatgaaaacaagttattttgaatcacacccaccatgctggtggggtcacagaccttgtaggtaaatgaaaacaagttattttgaatcacacccaccatactggtggggtcacagacattgaaggtttatcaaaacaagtatttaaggctcatacgcaccttttaggtgcggtcacatacattatggatttggtaaaacattttgttttgtatcacacctaccgatgtttgccaaaagaatagtttttataagatgaaattaataggaactcgaaaagcctgtattcacggttaaaaaattgtttgtcaaataataaggctcgatatgctgtgaaaaaggaataaaattctgaacaaaaagctgaatcacattaaagtgtaatgagtaaaataaaacatcagctttaacttaaaagtattcataggtttttattacatagaattgcataaacaaataattatgtatatttatggattatatactataagaaaacaaatttgtgttgactttctgatgtaagatatttataatttaattatgaaacagcgcacaatgtttttcgtgaaacattattgttctgtgcgaaaaataggatatggcgtcgtatgaaaaaattaattgggggtattcttatgagaaatgtaaacgatcaggataatagaccgtccggcggcggcaacggttttaacaccggccctgtaaatcaaaatccgccaaactatcacggcggacaggaaagggttggcggcaatgccaatattggcggaagcgttccgggatcgggagacggaaggtatacacctccgaatcagtttaacggatacaatcaatatgggggatataataacaatggatacggcggtcctccgaagaaaagcaatacgggtcttattgtggcaatttctattttatcaggtgtaattttgataagtattgcggttatgtgtcttatatttacaggggttttatcacccggcagacaggcggcaaatcaggcggtttccgttgtcgctactgaagctccaacaataagtccggctacagcggctccggctgctcaggcgcccgcagcgcctccggttcagaatgtaccgtcgctataaggtaaatcgtcagtatgtctatcgctggcgaaaacgctacgacggtacgctcgcctccttagccgataaatcacataaaccccaccatcatcccaatcagcataccgctgatgagttgaaattgattactgatatgcgccgccgtaatcccaatgctggacttgttgtgttttgggtacgctacgcgtgagatgtctgctcacctaacgagacgcgcaagcgcgtccttccgatgttcactaaaaaactccgcatataagaaaatatttaaatattttaaagttatataaaatgcggtttagcaagcaccggagggcaaacgcagtttgccgcgttaggcgcgcagtcttgggaccgttttatataaaacggattatgacaaattgtcgcatatatgttcacgctacgcgtgagatgtctgctcacctaacgagacgcgcaagcgcgtccttccgatgttcactaaaaaactccgcatataagaaaagggaaagttacaaggctttttcttttgtgcgtgaagcgcaaaagaaattagcgggggcgagcgccccttggagccgcaggcgacctaagcgagcagcactttttctttggtgaagcgtttctttttcttgctagaaaaagaaatggttcaaacgcctattataagtaaaataatatatattatatggggtcatatacatagtagatatatattatttttaataaacaaaatattatatatcaaatttataatatccgattctctttgcatataaccccatataatatatattattttacttataataggtgtttgtaccatttaattattactcaaaagactggttttgtagtgaacatcggtagggcgcatttatgcgcctcgttaggtgagctatcttctgaatacgcagtgttcaatatatcaagtaaatattcatattccttttttactctcacagtattctatctttcagcttttcttgcctcagccgaaagctttattatcttatcatattcttacccttcttgtcaatccttttttacccttaactttttacaaatacttaacctattatttatcacttctttggatattttgcatatttattcccattttgattatatatgacgttttatgtcatttcacttttacacctatttaacacaaaacagcgcttccattaaatgaaagcgccgttttgataaacacctttaaatattattaatctttaggaactgtctcccagtcttttaagaatctgtctattcctatatctgtcaaaggatgtttagtcatctgcattattaccggatacggtattgtagcaatgtgcgctccgcatcttgccgcttcaattgcatgaataggtgttctgatgcttgcggcaataatctctgtatcaattgcatggatatcaaatatttcaacaatttcctcaatcaaagtcattcctgtctgtcccacatcatcaagtctgccgaggaacggactaacatatgtggctcccgctcttgctgcaagaagagcctgtgcagccgagaaaattaaagttacatttgtctttattccctttgcagtaagttgtttaaccgcgcccaaacctgccggagtcataggaatttttataactaaatttttattgttaattgtcttaacgagctcttcagcttctttgaccattccttctgtatcaaggcttataacctcagcgcttataggaccgtcaactatggttgtaatctcttttacaacatcaataaaatttttcccttcttttgctataagagacggatttgtagtaacaccacaaattacgcccatatcatttacttctcttatgtaatcaacattggctgtatcaacgaaaattttcattgttttctcctcttcctgcagttaactgctatattttaattatttttatatttttctataaccgctctcacagtttcaacagcgggcccgcccgtcagttttctctgattcacacaggctgttagggatatttcttcatatatatcatcatcaaacaaagctgaaaaacttttaaattcctctattgtcagcgagtctataactttatccttttcaatgcaataagccaccattctgccaacaacagcatgcgcatccctaaacggcagaccgtgcttaaccaaataatcagcaacatcagtcgcatttgtgaatccgccttttgcaccggtcagcatagcatctttattaacagtcatagttgcaagcatctttgaaaataccggcaagcacatcttcactgtatcaaccgcatcaaaaatctgttctttatcttcctgcatgtccttattatacgcaagaggtatgcctttcatgacagtaaataatccaatcatatcgccatatactctgccggtctttcccctcacaagttcagccacatcaggatttttcttctgaggcataatactggagcctgtgctgtaagcatcatccaattcaataaatttaaattcgtgcgaactccatagaataatctcttcagacaatctgctgagatgcatcataacggtcgacaaatcaaaagctaactctaacacaaaatccctatccgacactccgtctaagctgttttgtgtaactgaatcaaatcccaacttctctgctacaaaatccctgtccaggtcatatgttgttccggctaaagcaccgcttcccaaaggcataacgtttaacctctttctgcagtctgttaaacgctcgctgtctcttctcagcatttcataataagccataagatgatgagcaaatgttataggctgagccttttgcagatgggtgtaacccggcattactgtttcaaggtgcttctctgaaatattaagtataactgactttaaatcttctatatcactaagtatttcatcaatttcatcacgcaaatacatacgtatatccaatgcgacctgatcatttctgcttcttccggtatgaagacgttttcccacatcgcctattctggaaatcaagatcgtttcaatattcatgtgtatatcttcggcatctatttcaaactctaccttattattctcaatatctgcttttatctcaccaagcgtcttaacaatcaactcggcgtcagcctcgggaattatgccttggcgacccagcatttctgcatgagcctgactccctttaatatcctgagcatacattctggcatcaaaacgtattgatgaattaaaatcgtcaaccaatgtgtctgtagattttgaaaaacgtccgccccataattttgccataatctttctcctgtacttcagtttatagtaatcaaattattttaaccttatttcttaaatttcttattcatcatagctctgaccttaagcggcagtccaaagaggtttataaatccttcgctgtccttatggctataaagctcatgactgtctccgaaacttgcaatatcctcattatacagtgaatatggagatttggttccggcaggcgtaacacagcccttatatagtttcaatttaacttcaccggtaacggtttcttccattgaatcaaccatagctgagagagcttctctcaaaggtgtataccattttccgtcatataccagctctgcaaatttaattgcagcctgacgtttaaatgcctgagtatccctgtccagacacaaaaattccaattcctgaatagcggcataaagaattgttccgcccggagtctcgtatactcctctggatttcattccgacaagtctgtcttcaacaatatccgcaatacctataccattttttccgccaagttcattaagtttttcaaccaatgggcggggatccatctttttaccgtcaacagaaacaggaacgccctgttcaaatcctatagtcacgtaggttggcttatcaggagccttttcaggcgatacacccagttttaaaagactgtcaagctgaggctcgtttgcgggatcctcaagatccataccctcatggctgatgtgccaaatatttctgtctcttgaatataaatctttctttgtaacaggaacatctatattatgcgcttcagcataatccacagcgtcttcacgagacttaatatcccatattctccaaggagcaataattttaagctcaggagccaaagcttttattgtcagctcaaaacgaacctggtcattgcccttgccggttgcaccgtgacaaatagcaacggcgccttcttctttagctatttcaaccagtcttctggcaataatcggacgtgcgtgagacgtacccaaaaggtacttaccctcgtatattgcaccggctttcaaagtcggaaaaataaaatctgaaacgtactcatcgcgcaaatcctcgatatagagctttgaagcgcccgctttttttgctctttcctcaagaccgtcagtttccttcccctgaccaacatcaccgcatacggctataacatcataatcataattctccttaagccacggaatgatgatagaagtgtcaagtccgccggaatacgccagaaccactttttcttttgccattttaaagacctccagtatttacttaatttactttatatctatacttcctgaatattatataacaaataaaattcatttgcaataataatttataattaattggaatatttttattatgaatcagattgtcaaaagttttatttaaaatactattaaaaattactctacgattctgtaaatttattaataaaaataagttacactatttcaaaatctcttatttccgataatttagaaagaaacttaatccttccaaattaatataaatttattaatttggaaggattaaatcttaataagttttaatttgtttcaaatattctctttataatatattgatacaattcatataatagaaaatttctttaaaactttttacaaaccaatttataacaaatgcaactagcatatacatttggcgtaataaaacagaaaagaccggattataccggtcttcttctgcttttaattttagaataataaaaataaagatcaaacacatcaaaacctatctcaacaggaaaataaaattaatagtctctattgtaacgcatttcacctcagcatttaatttcagaaaacaaagttgtgtatttttatcacggtattataattattgaaacaatttatttatatcaacgtttaacaatttagcaatgatataaatttctttatctgtagcaattctgaattgcccttctaatttcgaataactggtagaatttatattcacgccatttgactgaatctgtgcaataaaatccttttgtttaatcttcctttcagtcctcagtttagtaatgttagctcctactatattactggttcctaaaggatgcttacgagttttcataatctcacctctttttcttaaaattcttttttagaattatattgctcaaaaccgttgacataattccgtaaaagaattataattatttttgtaaaactaaaatttataaaacatataatttaggagggaaacaaaatgaaagacaaaattcaaggatttgtaattggcgcagtttcagcatcgctgctgataagcggcggagtatatgcttacagcggaaacaaaacaatatcagccgaatatgacaatataaaggtttatatcgacaatgtgatggctgatttgaaggacacaaacggcaaaacagttgaaccattcataagcgatggcacaacatatcttccagtaagaggaattgcgcaggcgtcaggtatgcaggtggaatgggacggcatttcaaacagtgtatatctgtggaataaactgtcacccggaaattcatatatggtagacaccatagagccgtatgataattcttttaattttcatatctacaaagcaagtgagggaaactcctttaagatggcaggagaactgtatagcaatgggtataatataaatccttactataaaagctggggtacatttaatttaaacggaaaatatgactctctgactttcacatatggtccggtaaacggttattttgaaggagaaagtgcgtctctaaatttcattgtggacggaaaacctgtaaaaacgatcacctgccaaggtgaagaccttcccgcttctgcaaccgtaccgctaaatcatgggcttcaattaaaaatagtaggggacggtgatttttggatgggtatggctgatgtaattttaaattaaaaatggcatactctatcggtgttacagtttaccgaaaagtcgattagtctattataaaggagaaaattttatgataaaaaaaggactgagtttgttatcagcattaagtgtgattattaacctatgcttgccactaaatatatttgcatataatgactcattttatacatatattgagcaatatggccaagcaccggaacacaacatgtatactcaaaaaattaatggaacagaaccaaacgggaatgaaggtgttgttgcttctaaaataatcgattttgacaatgacggacaatatgagttattaatattattattgaaaagggattactcccagaacaaaaatgctttagactttattgtggttgaaaacaatgacggagaaattgaggaacagtcgcgcataagattgtctgataattcatcctgcttaaatggatatagaaacgaagatataaaaattgtcttaaaagacaactatttaggatatgtctataaggagcaaccgtttgaaggaaccggctatacgtataaagtatgcagttacgacggagaagatataaatgtcttgactaatctatacaatccgggctatacttccggggtggcactatatgatgttaaaaattgtgcaaaagaagactactacgataaaggtatctgtttatttggaaatgaaggttcagataattatggagtttacaattcatatgatgaagcgattgcaaacaccatgtggcaatgcggaatatctacatattcaccggaatatgatatccataatttgtattttgataattgtgaattattgtgcagcttagaggctttcggaaaagaagactataaaaatggaacaatgaatgcaatttcaactattgtcagttattctgatattacaaaagatattaaagttgtgctcgataatgattatattctgtttgaccaaaaaccggtaatgcaaaatgacagggttatggtaccgctccgctcggttttcgaagcactgggatatgctgtaagctggaacgaaagcaccatgactgcaattgcttcaaaaggaagtgaacagatatttgttacaattggtgttctaaatattaaacacaataacggcacatatatcagcgatacggcgcctacaattattgccgacaggacattagtccctgttagggcaatcgccgagacagctgggtgtaatgtaacatgggatgacgacttattaactgttaatattaccaaaaaatagaaaaaactatatattcgattaattcgaactctttagtacgtaaaaaaagccaagcaaaatgcttggcttttttaaattattatataagatagaataaaaaagaaataaagaaataatttaaaaatatttatattactaatcttcttttatatactcaggatgaatctttttaagtttttcaagatcggtttcataattcgacaaatgatttgttattatatttgccgccttttcagcgtcgtgctcttttattgcatctgcgatacttttatgctgctgataaatttcctgacatctctcacgttttaaattcagttttctaatcctgtcaaaatgtatttgaatattatgtatcagctcataacttctgctcctatttgctatagccgcaagcgttttgtgaaattcattatcaagaccataaaactcacgtcttttattgtgttccaaacaaagcctctgtttaaaaagctgttcctccattggcatcaacataaaagaatcttcgatttcacacaatattctcgaaatttctttttccagtattaatctgagaaatcgagcctcctcaaccaaatcaaggtcaataagagaaataaacgtccctatctgaggtcttatttctaaaatattaaccccttccaattctataaaagcttccctgattggagtacggcttaaattcagttccttggctatttctgtctcactgattttatcccccggtgcaagttccaaagagattatattttcctcgagaacacgcaatgcgtattctctgtttgtttctttttcatttttctttggcgtgacagtcattaatgatacctccagacaaaacgcctatttattaataaatttccatagcaattctaacatataaaaatttttatgtcaataaatgaaaactttttaataggataattacatatatataagccggaagaaaaacttccggcttaatcttatcctaaatatttaatcagagtattttttacagcaccgggcccggcgtttaattccgaaaaatacttttctaccagctgacctaatcccacctcatataaatctactccgaaaatctttttatcttttaaaagcttttctattttattatgaatactgtctaagtcagtacagccaaactcaatgtctttcacaattcctccggcataatcaagcatagggtccgggcttggctcaaaaacattgccgctgtcgtctatacccattaaatatctgcaccatccggccaataccaatgggataaatttaagctcttttattttatcaagcttttcatacgcctttatagtttccccgaatcttatcggcaatttttgtgaagtatcgcaagctattctttgcggcgcgtcaggaataaaggggttcggaagcctttcatttattgtctcgtcaataaactctttaggtgaaattatacccgggtcaactactaccggcagtccttcatcatatcctatcttttttatcagtttaacaagattatcgtctttcatctcgtcactaattttattataacctaaaagacagccgtatattgcaagacaagtatgaagaggattaagacatgtgcaaactttcattttttcagctttatcaactgtctcagcacttgtataaattattccgccttcattaagaggaggctttccccctgcaaagctgtcttcaataaccaaatactgatacttctcagcatttacaaacggagcgacaaaagtatgctttttagtttcaacaggcgcggcattttctattccgtcagcttctaaaatctttaaaacctcatcagacggtcttggcgttattttatctatcatgctgcatggatatgaaacactatattgtatatacggcaaaaattcgccgtctgctaaaagattgttaacccaactcttagcaaactcataaactgattctttaagttttattccattatgggaacagttatccatactcaccagggttatcggtcttgccccattcttatatctatgataaagaagtgcggccaggcggcccatatacgtcttagcgttttcaggtcctttttcgaaatcggcttttactccgtcataaaattcgcccttagtgtcttttaaattataacccttttctgttatagtgaacgacgccatttccaaactctttgaagaaaagatttctttaagccgctccgtatcagtctcgttatcaaaatcaaaagttaaagcctccgccacgctggctataacttcttttgaaacagttccgtctgtgttaagcgttacagaaatagtcagattatcaaaatctttaaaactcttatctataatctcataatcataaccttcagctacaattatacctctgtccattatgcccttgtttaaaagtttctggcaaaccgccgccggaaatgctctgaaaatatttccggctccaaaatgaacccatattggattttctgaagttttcttaatcatttcgtctatattatactcaggcaaagtataacccagcttttcccactcacttttattctgaacaattgagcgtcttgacaatttcatagtgtttccccctactctttttcaatagcttccagaagtccgttcaggtatgtcgctcccaaagctctgtcgtatagaccatatcccggcatcgcaacctcgccccaaatcattcttccatggtcagggcgtataggaccgtcaaaaccggtttcatatagcgtcttcattattttatacatatccatagaaccatctctcgaaagatgtgccgcctcctcaaatttccccggagaatgatgacgcaggtttcttatatgagcaaaatgcactctgccctttgtcgccttgataatgtcacatatatcattatcagggttagaacctagagaccctgtacataaagttaaaccgttaaacttactgtctaccgcatttaaaagttttaaaatattttccttattatttattatcctcggaagattaaacaccggccatgcagggtcgtctggatgtattgccatcattatatcatgtttttcgcaaaccggctgtattttttttagaaaatatacaagattgtcaaacagatttttttctcctacatccttataagcttcaaacagctcttttacatgagccagtctctcaggctcccagcccggcattacaaatccctgactgttcgaatctatctgcttaaacatctcatccgggtttatttcatctattttatcctggtcatatgaaagtacagtcgaaccatcgtcacgcttttttgcaagctctgaacgggtccagtcaaagacaggcataaaattataacacaccagctttatatcagcctttgccaaattctcaagcgttgttatatagttctcaatatatttgtctctgtccggcagaccgatttttattgagtcatgaatattaacgctctctattccttctacttttaaccccgaagcttcaactttatttttcatttccattatatcttcatacgtccaggcttccccaacaggaatattatataaagttgttattacccctgttactccgggaatctgtcttatcttccagagttcaacgctgtcattgccctcgccaaaccatctcagtgtcattttcatattttattctcctatctgccccatcaatttattttattcgcaatgcacggggcaaacaatgcgaaagttaaatttatataaatttaaaatcccataagtctcggtaaaaacattgagattgccggaacaaaggtaacaagcagaagtaccaatataataaccccataatatgggaggagcggttttataaccctctcaatagatgtttttgccaccctaactccaacaaacaaaatgttacctacaggaggtgttattgttcctatacataagttaaataccagcataattccgaactgtattgccgtcattcctatcaaatcactggtaactaccggtaggaatattggcgtaaatatcaatattgccggtgtaatatccataaatgttccgacaactaaaagtataacgttgattataagcaaaataacaattttattattgcttattccaagcaaagcgtttgaaatcgccgcaggaatacctgtaaacgctaaaatccacgccattatacttgaaacgcctatcagaaaaacaatgataccggttgtctctgcactgtctttaaatattttatataaatcttttatctttattgttctgtaacaaaacgacagaatcaaactatacaccaccgcaactacagaaccttcggtagccgtaaatataccggcaatgattccgcctataacgataactatcaaaagcaaacttggtatagcgtccataactatcttcacagcgtctttagctttaacgcggcgattgcttctgtatcccttttttctggcaataaagaaagccaccaccatacaagcaagcccccacaaaatgcccgggatatatccgcccataaacaaggccgcaacagaagttcctccgcttaccaaggaataagtaatcaatacgttactcggaggaattagcagtccggtcggcgctgttgcaatatttgccgttgccgaatactcaacatcatagccttcctcttcctcaataggacctataattgaacccattgccgaagcagaagcgacgcccgaacccgaaatcgctccaaacatcatattagctactgcgtttgtatgtgccagagctcccggaaccctgccggtaagcagtaatgcaaaatttatcagtctcgtcgcaattccgcccttattcattatatttcccgctagaataaagaacggtatcgctatcaaggtaaatactgatattcccgaaaacaatctttgcgcgcctgtcaaaactgccgcgttgaaatccattatcggaaggatagcaagtatagatgaaataccaatagagattgaaatcggtactcctgcaagcagcaggacaattaaaactacgcccactattaaacctgaaattgctgctattgacataattacttatccccctttactattgctttttgtacgacagcgcttttattgctgataactgtctccttttttgcactcagaggtttaacctccttagcgcggagaagttcatatatatttattactccaaacaatattacaaaaattccgcatatcggaactataacataaatcatggacattggtattccaagcgaggctgtaacctgagtcattgtaagctttgttatgcttgttccgccgtaaatcatgataagcgccgcaaacaatataactaaaagctctgaaaaaatatatatccatcttagggcgtttcccgaaaacttatcagctagaaaacccattctcatatgttctctttttgcgaatacgagagcggcggccagcagcgccagccaagtaaatgaatacgttaaaagctcttctgaaacggtactgggtgcattaaatacatatcttgttacgatttgatatgttcctacaattgttataaacgcaaacattatgacgcatataacctcaagaatcttagtcagaatatttttaagtttaatcattactgcccgcctccttttgtatagcatcataaataggacgaagctttggattttcatttaatatttctttatgcagaggaagaactttttctctgaaagcagtaacatctacttctaaaaattcaacgcccattcctttggcaatatcttttgcttcttccacagcgtcactccagctctcacgctcagctctgttgcacacctcagccgcttcatcaaatacctgtctttcctcaggcggcaaatcctgcaaaaactttaggtttgcgataagcatatccggcaccatctgatgttcgttatagctgtaatactttgccacctcaccgtgcttattattagtaagcgcaagctcattattttctgctccgtttataacgttctgctgtattgccgtatatacttccccaaatgacataggagttgccgaggcgccaaaggcttccatcatcttaacgtttgtcgggctttgctgaactcttatctttttaccctttaaatcatccggcgttctgataggggtagtggcgtaaaagtttctgactcctgcgtcaagccatgtcaccgcttcgaatcctgacgcgtcagtagatgtaaaaattcctttcatcatctcatcgttttccattatgctgtgataatgctcttcactgttgaagagatatgggatactgaatatttggtaaatatcgtcaaaggtttcaagatttcctgtgctggccacgcagtaatcaatagctcctgtctgaaccagttcaatagccttaaccgacgctcccaaaatctcattggggaatatttgaatatcgtacttgtcgccaagtcttgactcaacatattcttcaaatgcgagaagcccaatatgatcaggatgcgtctctgactgtgaatgtgaaattcgaactatccgcttgcctgaaaatgcggagccggagcagcccgatacgacgaaagccgctgccgcaattaaagcaaaacttagcattaaagccgtcaagcgttttaactttttcataatctttctccccttacaaatttagtatagttgtatacttttcattctagtatacaagtttcttacaatgttattctactaccttaacacacatatgtcaacaggtaaaagtcaacaaatctgttttcctctttttagctataattaccacaagcgttttaaatatggctcggtataaaaaatttttattagcctttaagacacactgttttgtattttacatacatctctatggttaagatttagcaattcccattttataactttacattttaatcttttccatatatccaaaaatacttatcatattatttccaaataattatattttataagcatgtgataaaatagtttaataattgaatttatagtttcaaacagataatattgacgttataaccacagcatgcttttatctaatccatgagataaaaaattttaacttttattaagactttaaaattcataataataaattagcgggaaatttactaaataaattttcttgccaaaaaactagattagcgcgttaacattcaataaaaaatttaataattataaaagtaatagaaaaatataacgtaatagtgaattagagtaaataataacattttaaaactacattattaaccaattaaactaacttactagataaatggatattatggattaacattataaaaataatcagacgtatataaaaagactttaacgcgctgctcttcagataaaaataatcaatataaaataatcttatatgtacggaaataacaagtaagtaaaaaccttattttatataaaccttcagaatccgcaataaatcaatataaatatttttatttcaatttcagcctctttttaaaaaaataactattataaatatggattcagcaacctttctaaactattaagtataaatttgcacttgtcgatacagcactctttttaaactactatatacatttttataaagttatcaattcagcactctttatagactattatgtatatcttttcagctgttgattcagcaatctctataaacaatttaaatcgcaaataacaaacgaaaaggttttagcgcccgggtctggcgggcgcaaccgggctaggctatacaaagtaacaatataaaacaacaagatcggaatgttgtgaaattatattaatgataatattattttaacgtagtataaaaatcagaaaatatttacttgataacttaaccccatttaatatctatccattttattcgattgttgcctagcccggttgcgcccgccagacccgggcgctaaaaccttttttgttatttacaattttaatttcggatgttaaagtaatattatttatctttattccagatattgaactcaaaattaaactcattatattacttaaaactatttatatctgttcaatacaaataataaaaccttatatgttatcgtgtactttttaatcaataaaaattgaaactatataatctcccgggatataacggataaattattagatactaaaaaaaccttttgcactggctgctgccataacgcaaaaggttttttatactttattataaaacttttattttacagtacctaaaaagtccatttctgtctcatgcttcttatcacgtcccataagatttttaagcgccatgccgggagccattccctcaaacagtaccttataagcctcgttaactatcggcatctcaacaccggctgaatcagcaagctctttggccgcatggcaagtctttattccctcaactaccatttttacctcatcgcgcgcctgctcgggagtttttccctgacctatcaaaattccggcgcgtcggttcctggaatgcatacttgtgcaagtcactatcaaatcgcccacacctgataatccattaaaagtctcgtgctttgctccgagagccacacccaaacgagacatttcaaccaaacccctggtcattaaagcggctttcgtgttgtctccaagccccataccgtcaacaataccggcacataaagctattacattcttcaaagagccgccaagctctacgcccagcacatccgtgttggtataaaccctaaagtttggattcataaaaatatcctgtataatttttgcggtttcgcaattttcacaagccacaacatttgtagtaggtatatctcttgaaacttcctcagcgtggctcggtcccgacataacaacaacttcacagtttggaatttcttcttttattacttttgaaagtgttgagtgcgtcccctcttccaaacctttggaaatattaacaattatctgcccgtcttttataaatcccgacatattctttgcggttgttcttatagcatgcgacggagttgccgttacaataacatccgcatcttgacagcactctgataattcagaagtaaaccttacgccgtccggaaatttaactcccggcaaaaacggcttattttctctatacttttttaaatcttcgctttcctcttttaagtaagaccacaaggtaactctgtgaccatttttcgccaacattatagcaacggcgcttccccagccgccgcttcctatcacactgatatttgccataatctcatcctttcttgcttcccagcttattttcagtaccgtttaccaagcgctttatatttgccctgtgcataaaaacagcaagcacagccaaaatcacacagaatagtatatacgcaatatctccgcctccgaaaattaaagacaaaataactaacagaactgaacctaaaatacttccgagagacacatatttggaaaccgccataactattaaagcgaaaaccaaaactattaatcctatccaccaattagcaaacagcatcgcaaccatagaaaccaaaatacccttgccgccgtgaaatccaaaatatatagggaagttatgccccaaaacagcgcaaacgcctgcaacataaaccggtgtgtttccatatacactgtcaatcccagtcatatttgaaattaacattgcaatcagaatcgcggcaactgcctttagacagtcgcagaccgtcacaattgccgccgcctttttgccatatgttctcagcgcattagtagcccctgcgtttccgctgccttttgttcttatatcttcaccgccaaaaatacgtccgactattatagcgctgcttacgcttcctataagataagcaattaccccaattgctatcagccacaatatttccattttactctctccttagttttctatttcttcttgcctttttctcttattataaacttgattggagtgccctcaaatccgaacctcgctctgaactggttttctatatatctgacataagaatagtgggcaagctttgcgtcattgacaaataatacaaacgtgggcggttttatatctgcctgtgtcgtatagtatattttcagcctctttcccttatcgctcggcggctgaaccgctgagacagcctcgcccaaaacatcatttaaaatacctgttgatatacgttttgtgttctgttcaacaactttatccatcatctcaaaaaggctgtccaccctctgacctgtaactgccgaaataaacacagacggggcgtacatcataaaattaaagccttcttttacttttatcttaaagtttttcatggtatttgtttctttctcaaccaaatcccatttattgacaacaactatacttgcctttccggcttcatgaacatatccggcaatcttagtgtcctgttcggttatcccttccgctgcgtctatcattataagacaaacatccgctctgtcgattgcattaagggaacggctcacactgtatctttcaacattctcatttatacggccgcgttttctcataccggcggtatcaatcaacatatatttttttccgtcccgttcataaaacgtgtctattgcgtctctagtggttccggctatatcgcttactataactctgttctcaccgagtatctgattcaccaaagaggattttccggcatttggtttaccgacaatagcaacatgtataacatccgactcgtcgctgttctcgttatcctccggaaaatactgaactatctcatctaacaaatctccgacgcccaaaccatgaacggatgaaaccggccaggggtctccaataccaaggttataaaactcgtatatttccattggcggatcaccggggttgtccaccttattagccaccaatataacaggcgtgccgcatttctgaagcatagccgcaacgtctttatcagcagcggtcatgccgtctttgacgtttaccataaacacaataacatcagccatatctatagcgagctcagcctgagccttcatctgctccagtattacgtcatcgcttccgggttcaattccgcccgtatctataagggtgaaatccctgccgcaccattcagcgtcaacatatattctatctctggtaacaccgggcgtatcctcaattattgaaatacgtcttccagcgaccttattaaaaaaagtggactttcccacattcggacgtcctacaacagctacaacaggtttcatattctgcctcctcaaagcctaattctatactgtagtataccacaataatttccattcatcaagaatttattttcaacaaaaaacaccgtgcgccgagcacacggtgttaatcaagccaaaattattcgccaaccgaaataacttcttttcccttataagtcccgcaggccttacaaaccctatgagacagcttgagtgctccacactgaggacactctaccatacctggtacagaaagcttccagtttgctcttctcttatctcttctagcctttgacgtctttctctttggaactgccatttatgccacacctctttccaattcatcaaatatttatgaggaaatcctcgaaacagtgttacttaaagaaacgctgcattttctacttattaactaatctatgtccaaactgttgagtatatcaaacctagggtcaacttcccttgtatcgcatgaacagctgccgttattaagattagttccgcacttgaaacataatcctttgcagtcctctcggcacaaatgctttatcggaacgttaagaaccatatttgaatatacatactcgtccagcgaaattatatctcctgataagtaatttatatccggattttgattttcttcatcctcagagtcggaaaatctttcaatttctttgaatctttcagatatattaaaattcatctcgcttgagaactcttccgcacatctgtcacagacaaactgaagctttgccgtgccttttgcttcgagttcaaaagttcctccaaaattacgaattactcccaaaacttttacgggctccagtatcttaaaatcatcaccgggcattcccgcaatatttacttcacagttaataggtatctctttaccttcataattcttaatcggagctatattaatatccatttatatcacctaaatccctaaagaaaacacaaacagacagcgattattatatctaatcacggcctgtttgtcaatatctttttacaaatttcttaaaaaatatttaaattcacgctattttgaagccaagtaactgttaatcttgccaaccaactcgtcacaatctacaccgtgaaccatgcatgcctgctcaatgctctcaccgcttgaagaaggacagcccaaacagtgcattccgatttgaataaagaaatccgctgttcccggatccatctttaaaacatctataataatagtatctttggtaacctgatttgccatatatattaactcctttcaaaatctgtagctctattataccctattttcaataaaaatcaagagtattttacaaacttttcagctattccagtatttactacattaatcatttaacagcgtccacagcatgttcccaaattgtatgagctattttatcagcttcattgtattcttcagccatagacgtaagctgtgaaaaatcgccgttatccgctgcttccactctggatttaagaccttcaaaaatcttatatatcgttccgacagtttttgtcagttcatcatgagcttctttctgatcttcaccgcaaagcatagctgccgctcccacttcactgtaccagtgttcagtgctatcaagacccttttcatataaagctttccactctgcgtagttatcctgtgataagcttcctacaccgtttagaaccttatccatatctccgttcacaaaggctcctacctcgtcagtaaatgaattgatatagtttatatacttgtcccctaccaaactgcctgaactgctgttttgcgaagttcctgatgaatcaacactcttttttgaagatgtatcaccgtttccgcagctgcttaaaacacttgccagcattataactaccgcaccaaaaacaatcatattttttatatttttcccaaatttcatattttgcaccattcacctttcatgatgatattgttcattataacacatcgccgcataattgacaagtttttacaccgcactttttattccggctaaccttgttttgataaacctgaatatagttatagctcccgtctttattacccaccaaagcatccagaaaataaatgaaccaagataggctgatagagttatagtccaaaatctttgcactacattgctcatttttatttctgtcaaaagataatcattcagccataaaattatcaggcaatgcgatagataaatgttataacactgggaatccaaagctcttgtaaaccgggtaagctgttttcttttgtcacatatccaacagaagaacataaagaaaaaaagtattgccgatgtacaatagagaatatgtacttcttccatccacggtacagccatattgtatgtagcatacgccaaataaatatccaggaatcctgaaaataagaatagtgctgtaattaaaatttttcggttcagtataatctctttaaacttttgataattcataccaacatagcatccgcatacccagtataacaaatattttgtaaaaataacatcagagaactggaacacatgattcggcaagattatgtatagtatattcgataaattatatcccaaaactaccgagattaaaaccgaaaaagctatcccgacagccggagtgacacgccttaacgcatagacccataaaggcattaatatataaaactgaactattataataacaaaataaaagtgacccactaaatctccgcgccaccacgcatgaaacagcccgtcccacgaaaattcaaaataatggtggtttacaaaaaaaatataaaatataaacacccacaaaagataaggtaaaatcactcttgttatacggcccttgtagaatttaacataatcaatttttttatctgtcaagaacagcttcacaccgctcagaaaaataaatgcaggcacaacaaaagtgctgaatctccaaggtataaagacagcattaaaagcagtatccaaactggtagtctcaccaattatgactgaagcacaatgaataaatataacaagaaacgcacaaaaaatattcatatgcgaaagttccggtttcgctgtccgccgtgcaatttgccgtcccatcccttattcaccacctgttaaacagatatattattttaactagttagcgtttattctgcgcctttcgctcctgagctcaccgcgttttttagcgagttcccactccattttatcctcgtcagtttcaagtataagcccaggaacttcagtcggtctgtcatcatcgtcaagggctaccaaaaccaaataagctttattaatggttctcttcatgccgttcaaatcttctaccatagtgcggacgcacacttccattgaagtccgtcccacatgggttacttttcccgcaagcaccaaggtatcgttcggatatgccggcgctctgaaacagagagtgtcaaccatagccgtggttaccttgcatccgctgtgtctcctggcaacaattccggccacgacatctatccactccatcagtcttccgccgaacaatcttccgtatccgtttaagtcaggagacgtaaccatttgcacttgttcagtatatgaatacgaaacttttctatttttaactacaggttctgccatttttttcatctcctcttgaattacagaacaattcactttagatagtataccattttcaattcaatatatcaacgtctgtaatattattgttaacaattcatatcggcaaatttcatagaaatattgataaattctgctctttatgatatattaattagaaataaattaatgaggtaatcaaatgaagcaaagcgatataaaaacaccatattatttaattgatgaaaatttaattataaaaaatttagagattttaaaaagtgtttccgacaaaaccggagcaaaaattctgcttgcacaaaaagcgttttcaatgtattcattgtatccgcttataggaaaatatcttgccggtaccacagcaagttctctgtttgaagctaaactgggccacgaagaaatgccgggcacagaaactcatatttacgctccggcttacagcgatgaagatttttctgaaataataaaaatctgtgaccacatagttttcaactcattttcccagtggaataaatataaaaatattgtgtcaggaacaggaattgaatgcggtataagaataaatcctgaatattctgaaattgaaactgacatatataatccatgctttaaaggctccagaatgggagtcactttaagaaactttgaacacagcaacctcgacggaataagcggacttcactttcacactatgtgcgagcagaattctgacgttttatggaggaccgttcaaaaagtagatgaaaaattcggaaagtatataaaaaatatggaatggataaacatgggcggaggtcatcatatcacaagggaagattatgatatagaacttctgtgcaaatctataaattatttttctgacaaatatggtgtcgccgtctatttggaacccggagaagcagttgctctcaatgccggatatttgacatcaagcgttatggatataataaataatgaaattgatatcgcaatattggatacttcggcagcatgccatatgccggacgttttagaaatgccttatcgccccaacgttattgacgccgggaatcccggggaatatccatacacttaccgtttggccggtccaacctgtctggccggtgatattatcggtgactactcctttaaagaacctttaaaacccggtgataaaatcaccttttgcgatatggctatttacaccactgttaaaaataacacttttaacggtataaacctgcccagcatagttctgagacatcaaaacggagatacggaacttatcaaaacttttgggtatcaggactttaagtcaagactataaatttaagataggaaattgttatgaaagagaatatgcaagaaaaaataattgattttttaataaacaacggcgccggacaagtgggattctgccgcctagacaacgatgattttggcacaaacgattttaatttaaaatatgccatatcatatacaataccgctgtctgacgcagtagtggagcagataaacgataaacccacgcatacatatttccaccactacaggtcagtaaacacattgattgacaataactctttaaaaaccggtctgatacttcaaaaagccggatataagtatgttcctgtccctgcctctcagtccgtcaatggacttaaaggaatattttcacataaatatgcggctgtaaaagcaggtttaggctatatcggcaagagcggtctgtttatttcaaatatcaacggacccagagttcggctcggaacaattttgactgactgcgcagaatttgattttaatacaaatattttagaatgccaatgcggaagctgtacgctttgcgtaaaagcctgccctgcaatggctatcacaggtgaaacgtggaatcccggggaaccgagagaaaaaatcattgacgctctggcgtgcagccagcatatgaaaaaagcataccaaaacataggccgcggagttgtgtgcggtatatgtatgagggtatgccctaaaggattttccaaatccacagaataatatgctaagctctgaacctatatcctgcgccccaaacggtttcaatgtacttattttcagagttcttctcaattttgtctcttattctttgtatatgaacagtaaccgttgaagcgtctccgaatgcttccaaaccccaaacgcggtcaaaaagcacctctttgttaaaaactatatttggattttcaagaagaaataaaagcaaatcatattcttttacggtcattattacttctttgccgtcactgaacacccgtcttgaccctttatctactttaagccctctgatttctattatctccggcttcacagcgtcagagccgcttctgagggtcttgtatctcgaaatatgggttttaactctagccaccatctctgaaggagagaaaggtttagctatataatcatcagcgcccagtccaagtccgcgtattttgtctatatcttcacttctagcagataaaaatattaccggaacatctttaacctttctaagctcaccgcacactgaaaacccgtcgcgccggggaagcataacgtcaattatcacaaggtcataatcattttccaaagcctttttcaacccggattctccatcatttgccaactcacattcaaatccgttggctgacaaataatccatctcaagttcagctatacttttatcatcctcaattattaatattttcatataaaccaatccttttgtcttaatcttccaaaatatactttttcagtcttatataaacagttactccattcttatcgcctccggaacgcatccatatctttccgccgtgttcttttattattctgcatgctatagaaagaccgagaccattacctgaaacgtttaaatttcttgccgggtcagctctaaaaaacgtctcaaacactttcttttcttcctgcttacttatcccaattccattgtctgaaaaactcaaaattacccaaccgtcattttctattaactcaacacttagttttccgggaatatcaggctttctgtattttatagaattgcttattatattggaaagcaccctgtttaatttttcacagtcaaaccttacatatatttcttcacagccgcttaaattttcaccaatatcaagctctataccggctcttgataaatcaattgagaattcctccagcactgaacgcacaaaacctcttatatcccaaacctgtatatcgtacggcgcactgtctaaatccaacttagaatactccgaaagattatttaccatagcctcaagggtattagccttagtctgtatcgtgttaagataacgctccaacatttccggcgtatcggctactccatcctttatcccctcaacatatccttttattgaggtaataggagtttttaagtcatgcgagatgttggctataagcattctgtgttctgtctctcgctttatttcttcatctacagattttttcagcctgactcttaagttttcaatcgaatcatagacttctttaatttcacggtcacctgaacatgtaaactcatagctgaggtcgccttccgtcaaatgttccatagcgccggacatttttttaagcggcgctattatactttttgacagatatgccgttactcctatacaacaagcaagaacaactacaatcaatataaaaagccaaaccagcagcaatctaaaaatcataggattattaaggctgggagtaataccgttaatttgaatagatatacttggtacataacttaaaacaagtacgaaaataaatgctgatatgagcaccataatgaaaatcggcaataccagcattacaatcgatgataacataagtttctttttaattgacatatatccgcctccgtaatccagcggtttatcttatcagcattccttaaacctaaacaaataataacctacagcagtaaaggttaatccgtaacccagcataagcaaaattttgctgaataatgctgatattggcagtccggcgcctaaccacagtttatgccactgcatatatccggtaaatactaatccgcttagatttgaaaaataaattcccagcacattcaggcctatatatactattatagccaaaaacatcgcaaatgtcgagttttttacaagctgatttatcataattgtcataagcgccaaaactgccaaaggcaccatatccaaaatatatgcccatactgcatatcctaaattcactacgcttcctgaaacaataatatcaaatatgcttgaagatatcagaactaccgccatatttacagcagctatagtaataactgccaaaacctttcctacaaaaaccttatatcttgctgtggggcgcataaacaccgcgcgtatagtcttgtcctgaaattctcccgcaaacaggtcgcacgaagcaagcattataataaatggaactatagcctgaacgaacaacgtcatgagcgaaataggagaacttatattattcatggtccaagttccctttgaaatagacgtcactatcagttttgaaaataccgctacagcgcaaatcaaaatttctattattataaaaactatgtattttttactgctcataagcttagcgcattcattcctgtaattagccagcaatccactcatattacacgcctcctttcagtatccttagcgtcgcctactatagaaagaaaataatcttccaacgaagggaaattttcaagaacttcctccatactgttcatagccagcagtctgccgtcatatataactgctaccttgtcgcatagtttttcaagttctgacgcaacatgtccggatattaaaaaggttgttttatttttttcagacatttctttaataacactgcggatatgaacaactccttcaatatccagcccgttagtaggttcatcaagtattacaagtctaggacgcggcaaaagagccaaagctatcccaagcctttgacgcattcccagcgagaagcttccggctttatccttagagtatttatcaagacctactaatgacaaagcattatttatagcctctgtttctgttcttttatcaggatatttataaaacctagccgcagcttttaaattctgataagcgctcattctgtcataaagtgccggagtttctatcaagcatccaacactctccattgcagattcgaaatcatcatctatatcatatccaaaaatctgtatttcaccttcgtcaatcctattcatgcctattattgatttcatagccgttgtttttcccgaaccgttaggacccagcaaacctacaatatcaccctcattaacattgagggtgatattgtttactccgcggccgtttctgaataatttttttaagctatgaactgatagaacagtattattcttattatccatatttaactgcctttctgattcttaaattgttatacacgcaccgtttttcttatgccgcgtcattaaccgcttctgagctttcattattcactacggtaacaacatttccgttttcatctctaagttttccatcgctgcttacagtataagtcgaaaaagtaccgtcttcattatttgcttgaagattgactgaaccgtttatatcgccttcaacatcttcatcactttctgttatagtcatatgacctgaaccgtcttcttccactgcatacttagttgttacgcttacagacatatcctcatattcatcagcgttcactctctcaatgctggttgttccataatctttaaatgcagcgtctaaactcatatttaaattcttctgagctcctgagttgtcataacctgtcaaaacaactttaccgttaaatgcggagattcttccggcattatcaatggatacgctgccgcttattgtattcacgtacggctcatttttgttcaggaacatttcagacattgtctggatattaacgttttcttcatcgaagatttcattagaattttcatagtttgctctcaatgacgcgttaaataatgaaaatgctgctgtcatatatttaggaagctgttcccctgtcatgttaattgtataagttctgtttccgtcatttgaatcagtgagaactatattattttttatgtcgcctattaaagtatccgccaaagtttcaaggaagccaatctgtttatccaaaacttctgtattcgtaaacaactcttcagaaatatccctgtcactcattttgtactttgttttgtgagtctccggaccttcatcggtattataagtgtatgatgataatctgtaaccgtcttgaatagtcattaaattgtcagtatccaccagtgttccggtttcatcatacgattgtgacgaagtctgcatttttacatccccgccggcatctttttttatcagcgcttttccgccaaaaagatttgagccttccaaatcagctgaaacgtttatatccgcagtaacattgtcagaagagaaaaaggtattttttgcagcttctttaaccacgccatatccattggcgttgtcaaaattagcaaataccgccattcccaggactgcaactccaacgcctatgcacgccgcagctcggatgattctgtttcttgtctttttcatacatttgcctcgctttcataattgatagattttttgttttgagttttgagtttagatttaacatatgtctcaatctatgttaagagtataaatcccaaaaattgaaaacaaataaagcaattataaaatatttataaactaaaataaagtttttattaattgatacattaaaaacactcccccgggaaaaatttgatattatccgccaaaagttagacacttatagagaggtatatcagttcccggaggaattaactatttacttatactgtttgaaataggttctattccgtctgttgagttccaaacaaacaccttgatttcattggtttccgatacggctaatggtatgaatatattggatgaatctccaacattcattgttatatcactggtttcaacagcggtcaaagcccctgtctccctgtcatacgccgctgcaattattacgttcgatccgattccttctttattttttgttagatttatatttatgccattttcagcttccgctatcgaattcaaagtatacataaattcagaagccggctgaactgtaggagttacttcaggaacctccgaacccccctggacacccacggtaatattatcaatacctaagctgtttgcagaagaaccacgagtagaacattgaacttttgtaggcaaaagctgcggaacctcatcaatttttttagtaccggagccaagcgtaaccgttcctctcaatgtatagtcagaactgtcagcttctttagtataaacctttactttattatcgctctttgtatattcaagttttaagctataccatttattaggactgaaactaaatccggaaatctgagtatccttaggctttgtagcggaagcgcccatagagaaataatcatttaacttcagcgttccgccttccactgtcatcacttcaaacactctgccgtctttagcggtagtatatgtattatccgggttggcgttatttgaatcaaatattctaaacagcggtgtatccttagctgtgtctccgctcatgaaatcttcttcaaatattatcttatctccgtctaaaacagtttccggcaaatatgaccagccgtcctgaccggcgcctttatcagtaaactgaatatagttatttccttcagctctttgggttattgcaggcggcacagcgccgtcagcagccgatgttccgaaatctatatttattgattttccgttattatttgagatagtattattatcatcactatttccataaatatcccctgactttagattgtcaaaatcccagctttgtccaattataggagcgtctgtcggtaatggtgtagcagtgggttcagctgttggtttagctgtaggtgttggttttgttgggtcaagtgtcggcggcggtgacggcggagttacagaatccgcccaatacaatacatcttttaccttcggcgaccaggttacattgccggaagcaatcgaacctatctcaagagaactaaagtctgcagaatcaattgatatattttcaatagtatatccattctcaccggaatcgtcgctcaatatcaatttagctgttccatttgttaaatcaagggaaattttaattctccagttcgaagagcttctcttggttatattgggcgagccaaagactgttcctgatgaaatatttgtttttgctcctgttcctgaataataataggcctcatttgcccctgattccgaatattcctgacctattgccaaaactgttttttctgttgaatccaatagcttaatctcataagtataagctcttcctgtccaattccatgctcctccggcgtctttagtaccgcctgttccaaatgcaaattccagttcagcattaccgccgtatgccgtttcaaaatcagctttgaagcttctgcctccatcagagctgtcttgtgtaaactgccactcttttgaacttgagaaagttaaagctgctccttcgcttccgtcatatacaaattttgaacctgtttcgtcattactgctgtcgtatatatactgcttagcttcaagaactacttcaagcgcagctccgctgttttcaggcacttcaaatgcccctttactcaatatatacctatctagttctacctcataattatgggttcccggaagcagtcttgcagataccattccattttcatcagttgtcataatctgactgtctattttaacactggcgcctgaaagcagatttccgctgctatctttcacggtcactacactctcaggaagcggcgcatagtataagttaggctgaacatattctgaaatatctttatcataacctatataatagctttgatgcggaggctgattgtaagcagtattctgccaagctattgcactgcggtactggctgtcgtgcataaatgttgtaaatttatagtcagtcggactgagagacgcaaacacgcgaagtgctgagttatcggaatgtcttaatataatttcctctctccaatcgccgaacaaatcggcctgcagatttgggttggtttttgtgctgttaataaactttacagaattattagtataaatagtccagagtctgccaaacgatagggtatcgtcattccacttacttattctgtcgccgttaaaatgctcacggtacaaatccccgtcccaataaatcggaaagttaggatatgatccatcatgcaaagttgttttgctgattaattcgccgccaatagtacgtacaccaaaagctgcatcccaagcgagcactccatatttaggactaaaataatccattactcctcttccgtcgtcaccgctcgctttaaaatgccatatctcttttcccgccgcatctctaaatccggttccccagttaggtttttcttctaaaactccgaaaatttcctgttttccgtcattattaaagtctgaaacgtgaatagcgtctccatgtccccatcctgttgaatgagccaccgttccgtcattatctatagcagcgctgccgtatactatctcatcacagccgtcgccgtccaaatccgctacggaaacattatggttaccctgtcccgcaagactgccgtaacctgagaccgtgctgtcacatctccagcgcttatttaagttcttcccgtcccagtcatatgccactacaatagcttttccataatatccgcgggcagttacaagacttggatgtactccgtcaagataagctgtgcatgccaaaaatctgtctactctgtttgttttatcactggtctttccccaagtagtggtatctcctcttcccggatcataatcaaccgtctgcattgccgctccggtctgaccgttaaagattgtcagatattcaggtccgtcaatgataaatccgcttgagttaacataagacgccgaattatcagcgctttttattgcctctgtagttcctgcctgtgttacataattacctgctccgtctatggttccgggcgctgtttttactgccaattcagcttttccgtcaccgtcataatcataaacctggaattgagtatagtgagctcctgctctgatattagctcccatatcaattctccaaagctgggttccatccatttcatagcaatccaaatatactctgccggtctttcccgactgagaattatcttttgaattattggggtcccatttaagaattatttcatactcgccgtcaccgtcaacatcgccgacggacacatcgttcgcccctcctataggactgtttgactttccgctgtcatatactatctcataatcacttgccggtgacggaatattcagcggtatatcaaaatatgtatacggaacggattcctgtcccttatctgcatgacctgccaatatggttataggttcacatttctcgccttcctgtccgttaattacaggcgctattgtatacttatccgtctctgaaccttcaagatcagtgtaattggtattgttaatggaatctaccaatttttgctcgtttttataaatgttaaaaacagtgtccatgggctcgcttcctaatagcctccagctcaaataaactccgcctgacggtgccgttgctccaaaagcacctctgcccaatttctccatctgccttggctgctctgaactctgctgtaattcagaattcaattcaggaccatcctgaactgccattgcaggaatacatcctgccaacatcatgattgacagtataacgcaaaataactttttcttcataaaattaaccctccaatcgaaaagatatatacaaattataccactctttttataaattttcattataaaaagacggcataatttacagttattttgcttttttatttgactaaataaatttcaagtttcatatacagctattttatttgaaatattactgtttaataatattttttaagcttttaatagaagaacaaaatcacaaaataaatacaatgatgagacaggtaatatatattttttcaaatctgtttcataactatatttttgtaaatatataattaatctgcaaaagttccactgtactccaatacattatgaaatacatctatttcgttcgcaaaatcaaacttgccgcatttttacttttataaaatttttatttactttaatctgaaaagtaacaattatttacgctataataaaattgttttccctaaaattatatataaaaaatccggaacaattttgtcccggaatatattatatttagctaatctaccaaaataggtgcgttgtcttccttccagggaagtccaaacttatttaaatcctccataaatgggtcgggatccatttcttcaacattataaactccaggctttttccactttccgctgagaaccattgcagcgccaatcattgcaggaactccagtagtatatgacaccgcctgggagccgacttctttatagcattcctgatggtcgcaaacgttataaagataatatgtcttttcctccccgtcctttttcccggtgaatatacatccaatattagttttacccacagttctaggtcccaatgaagccggatcaggaagcacagcttttaaaaactgcagcggtataattttacggccctcataaattatcggttctattgacgtcattccaacgttctccaaacattttaaatgcgtgagataactctctccgaatgtcataaaaaacctgatacgttttataccttttatattaagccctaaagattcaagttcctcatgatgaagcagatacatatctttaacgcctacttcgtcaaaattatactcccgttttatttccataggctttgtctctatccatttgccatcctgccaatagcttccgtttgccgaaacctcacgaatatttatctccggattgaagttggttgcaaacggatacccatggtcgccgccattgcagtcgagtatatcaatataatttatttcatcgaatatatgtttttgagcatacgcacagaacacaccggtcacaccagggtcaaaaccgcttcccaaaatggctgttattccagctttctcaaacttttcacgataagcccactgccatttatattcaaacttggcagtatcgggcggttcatagtttgcagtatccaaataatccactttcatctcaagacacgcgtccattatagtcaaatcctggtacggcagcgcgacgtttattactatttcaggcttatataaattaattaactttataagctcgtctacgctgtcagcgtcaaccttagcagtttctatattagtgccgctcccgacttttttcttatactcttcacagcgttctttcaggctgtcacacttctccttcgttctgctcgctatcataatatctgaaaagacttcaaaattttcacagcacttatgtgccaccacaccggccactccaccggctccaattatcaatgctctgctcattttatcctcctaaaaacatattctatcttccgctcaacgctaaaagtaattctcgcaatattttgcacgcaattgctgtactggcaccgctttggtcataatgcggacaaagctccaccacgtcagctgctattatattcagaccgccgcacactttaatcaccgcgtcctgaagttccttataacttatgccgcccggttccggcgtaccggttcccggaaataccgaagggtctaatacatctaaatccacagtgaaatagacaggcaagtttgcttcttttaactcacatattaagtcgtcaagaccatttaaatcaaacttatttatagtattatgtttttttgcccactcaaactcatacttctctccgcttcgtataccaaactgccatatctttttatcgcctaagagttctgaacatctacgtatcaccgtagcatgactgagttccactccgaacatttcatctcttaaatcagtatgtgcgtcaaagtgtattattcttaaatcatcgccgtatttatcataacaagcccttaccccgccaagcgtgactaaatgttctccgccaatcatcacaggggttttgttttctttaatgatctcagcagcaaaatcttcaattattgataacacctgctcagtatctcccagcggaagttctaaatcgccgcagtcaaatatttttgtatcggttaaatccctgtcctgataagggctgtaggtctcaagaccccaagaatcggctcgcatggtctgaggtgcaaaacgcgttcccggtctgaatgatgtcgttgaatcaaacggcgctccgaaaacacatatccttgactcctcatactcagcgtcacagcctaaaaaaaacggcagatttgatataatagtattatcaggcattctcaagcaactcctttacataattcggaagggcaaaactgcccttatgcaggtcagtattataatattccgtctttatccccaatttattccatttgtcagcgtccaaatccttaagcgggtcaaacttattagacgcaaacccaaacagccagtgacctgacgggtaggtcggaatatgagcctggtatagcttatggattgggaaaaccccttttattctgctgtgagcccgaactaaagagttagcataattatcataatatgggctttcgtgctggtttacaaatattccattctcattaagagcttttgaacagtttccgtaaaactctcttgtgaacagaccttcaccgggaccaaacgggtctgtggaatccactattattaaatcatattcattcctttttgacctgataaattttaaaccgtcctcataatacaccgtaacgcgtttgtcttcaaaccccactctcattccggggaaaaacctcatcgaaacttcaacaactgccctgtctatctctaccaaatcaatattttctattccttcataccgcaccagctgttttacagtgcctccgtctccgccgcctatcactaaaacattttttatttcaggattaacagacatcggcacatgggttatcatctcgtgataaataaactcgtctttttcagccaccatcattaagccgtcaagcgttaaaaatgttccaaactcctttgaggtcataacatctattctctgataatcagtttttccggtatataattgtttgtctacccttattgaaaattttacatcttcgctatgattctcagaataccacagttccatcttttcaccccttttatcaactgctaaataacatttatataatctatatttatatcctcggcgccggtcataaaacagcccttttctttagcataggcaatataatcaagtatatcgggcgttatcatttcaccgggagccagtattgggattcccggaggataacacataacaaactcactgcataccatcccggcactcttctctataggaacagattttttatccgaataaaaagctttttttggcgtcattatcacttcaggtgaaatatactcatggtcgaacattccggcacttggctttctatgtatcctctctatctcactcagtgacgaaataagacgctcaatcatcaaaggagtatctccgactgaaataatcgcaagtatattccctatatcgccaaactctatttgaatatcataataatccctcagcatgtcatatacttcgatacccgcaagccctatatccctggtgtgtatagaaagcttggccaagtcaaaatcatatattgcgtctccatccaccagatccctgccaaacgcataatatccacctattttgtttacctctcccctggcataatcggcaagttccaaaacctttcggtatatttcctttccgttcaaagctagattctttcttgaaaggtcaagagacgacatcaagagatatgaaccgctcgttgtttgggtcaggtttataatctgtcttgtatacccctcgctcacatagttatttataagcaaaaatgagctttgagtgagagaaccaccgtttttgtgcatacttacggaagccatatcagctccggcttccatagcactgacaggcagattatcaccaaaataaaagtgagttccatgagcctcgtcaacaagaaccagcataccggctctgtgcgctatttccactaccttttttaaatcactgcatattccgtaatatgtgggattattcacaaaaactgcttttgcgtcaggattgttttctatagctttttcaacttcttttacactcattcctaaaggtatccccagagctttgttcactccgggatttacataaaccggtatggcaccgttcacgaccaaagcattaatagcgcttctgtgaacatttcttggaagtattattttttctccttcttttactgccgcaaataccattgcctgaacagcgcttgttgtgccgtttaccataaagaaagcgtgttttgcgccgaacgcttcggcggcaagttcctccgcctcgcgtataacagacaccggatgacaaaggttatccagcggcttcatagaattaacatctacgtccatacactgctgacccaaaaatgaggtcagctcaggatttcctttgcctcgcttatgtcccggaacatcaaaaggcacaacacgcattgatttaaatctttttaacgcctcataaataggggctttgctttgctccaaaccatcagtccccctaatatatattctttccgctgaaaatctcaatcatctcacgtctgagactgttgctgatgtcaagtctaaccttaggctctaactcatatacatcagttttaaacagataattctgcaaatctatatctttaatcagcattcttgtgtgaaaaatattcgactggtaaacatttacgtctatagcgtcatatttctccagtgtttttctgtctataaagtcctgtatcgaagtaatatcatggtcaataaacagcttttttccatccaggtcgcgcgtaaatcccctgactctataatcagccgttatgatatctgaatcaaaactgcctattaaataatccaaagctttaagcggagatattttaccgcaggtagaaacgcatatatccactcgaaaagttgaaatagcattatcaggatgatattcaggataagtatgaactgttacatggctcttatccaaatgcagcataacctcatcagccgtaatatggctgacaggaggctgtgaaggaatcatagactcatcgcttatcataagattgacgctggctccctgagggtcataatcctgctttgatatactaagaacgttcgctccaataatatctgtgacatcgcatagaatttttgtcagacgctcagaattgtactgttcgtcaatatacgcaatataatccttttgttcgcgctcactcttggcatagcacacatcatatatattaaaactcaaagtttttgtcagattgttgaatgcataaagcttaattttatcctgcatatgtcacatctccttgcacattttaggaattttatcaaggaaacaattatactatataatagaaagtatttcaatacatttaaggcaaaatatttttattttatgaaaggaacttttaaatgactattactgttttactttttcttgttggcctgtttttaataataaagggcggagatgtatttgtggacagagccgtttggattgcagaagtatttaacataccaaagtttataatcggcgcgacaattgtaagtatagccaccacattacctgaaattttggtttccaccattgcaacgttttcaggcaacaactcaatagctatgggcaacgccgtcgggtctgtgaccgccaatacagcaatgattatggctataagcataatatttctaagttcaacaatagaaaccaaaaattttaaattcggtatgatatgtctcatatcttcagcattcatccttatgatgatatgtaaaaacggtacggtatctgcgctcggaagccttctcgcttttggagtggttattatatttacttggaacaacctttcatcatcaaaacagaacacagttcttaaaaccagcaacggaaatgtaatccttccggcgatacctataataaaaccgactaaaaagcaggtttttataaattcatcattatttgtgctaagcgctgcagccattacagtaggagccaaactcttggtagaatcaggcacagatatagcaaaagcattaggtgtatccgaaagggttatcgggctgacaattatcgccatcggcacctctctccctgaacttgttacgactattaccgccattgctaaaaaacacagcagtctgtcaataggtaacataataggagctaatataatagacctttcattaataataccaatatgctcatttatatcaacaggaaagttcggcgtacctctgacctttgaaccgcagtatgaaatgcttgatattccaatctgtcttggatttatccttattgcgtgcctgccgccgctgcttaaaaagaaattttacaaatttcagggggtcgctttgctagtattatatttcctatacataggtttttcggtactttaaaaaataaaaatattgactcactcagtagatttccgctttttatcataaaaatatgcacctccaaaagcgtataacttttagaggtgcatattatatctaattcttatcttatatattttttattttttctaagcgcaaaatatactactatataaagcaaaaaataatgcttgcttttcataagcttaaacattgtagaatcagacttataatctttatccggcatctcttttacacatcttacagaaatttctttaaatcttttataccgctccttaaagcttaactcccattttgggttaaagagaagcatcatgctttttgttgtgctctggataaagcctgaacaaatatcattcaatacctgacgattctcaggattccagctatatatgtatttcattctgaatccgttcaaactactgactatttcaaaataatcaatcgggaatttattaaatgcctgccgcatatcattgggataatgaatataaaatatctcatctattaaggctatcttttcagccgaattcacataacgcattacaaatacttcatcctggttccgtcttaaagccgggaactcaacattattcgacttaattatatccaggctgaaaatcttattccacggcgcaccctgaacttcccatcttcgtttatcgcctgtgaatatgtcataattctgtctcacataactcccggtaaaaacttcgtttggataatcattgaactttctttcagtcccatcgctgaatatcattttataaccaaacactatcatatcgcaggaatatttttcaaacttttctatgagcgactcaattgcgttcggcaccatacaatcgtcagcatccgggaaataagcgtattttcctgctgcattttttattccggtattacgagccggacccgacccctgattgtcctgatgaaaaacctttattctgttatctttaaccgccagttctctgcacacttccagactattatcctttgaaccgtcatccacaagaataagttcaatattttgataagtttgattaagtaccgacggaaccgactttcttaaatgttctcccatattatatacaggcataattatgcttacgagaggtttttgcataacattcatcccccaatgttttattttgcgttgttttttatttcactcattacctttaaatcctcaataatgcaaagcctgattatttttttatcaactaaatatttatactttctaaaatcaggctcaaactctctgcagggaagttcattattaaaaacttccacaacgttttttaccgctttatatcttttaaacactttatatcttggaatagcgagaaacagcatttgaatatatatatcaaagtttaccgccaaatttctgcatattttctccaaaacttttttattgtctctattccaattataaactacattcatctgtaaatttttaaaagctgcaacgctttcaatataattctttaaatacttttctccctttttaactatcccagacatataataataataaagcacgtcctcaataaaacataccgaaccggcatttgacagaaacaaaatattaaacgcttcatcttcgctcttactgattttaggaacagataatttattattctttataatctcagccctatacagcttgttcgccatactgccatatataccatattcactgtcacggtcaataaactcatcataattttcacgaatatatttaccgctgaaatatttaggcttatacgattttctcattatacattcatcttgaccgttcacccattcatatccgcaaaccgccatatcagccccagtattctcaatagcagaaacaagcttttccacggcgttttccttgattctatcatcagcgtccggaaagtagtaatacttaccggacgcatgtgacattcctgtgtttctcgctccggctgctccttggttttcttgatgataaactcttattctagtatctgcagctgccaattgctgcataactcttaaactgtcatcagcagaaccgtcgtcaatcataattatttctaaatttttataagtttgatttataaaagtcttggcggaagtatataatacttccgccatgttataaaccggcactataatactaaccaattgttcttccataaccagtttccctatactaataccagcataaatctacaacgcaaagctccggtttattattgattctcggaataatatgcgagcttccaagccctctgctgataatcacattactgtttcctatttgatgaaaaccatcaacaagcttggggaagaatccctgtcccgtcgcataaagtccgccaacaaacggaattcgcacctgaccaccgtgagcatgaccgcaaagagccaaatctataggataatcttctaaaattcccataaactcatcgggatagtgaaccagtaaaagtttaaagtaatcttcctcaatatacttatcaaaaaattgatgaccatatctctcaaactgctccggtccctgagaaagtccgcctatgttcaattttgtatcctttatgtcaactatttcagacgcgtcgtctaaaacatgtactccaacagccttaaggtctttggttatattagaatctttaaataatttagcctcgtactcattatttcccaaagcatagtaaacaggtgcaatattcacgagcttttcacaaagatttgtcacaacgctgtaatcgtcatttttcagattgttcatatcacccacacatgctataatatcaggagtcaacttatcaatctgttccaccagccttatattatccttaccaaactctttaaggtgcaaatctgcaagcacgactatgcggatattgtccgaaaccttatctgaacgcacctgataaaatgttacatctatttcagattggttcagtaaattaaacgcacagactgcgagaacaattatcaatattaccgcaataatacgccacttatattttgaaaacaattcaaagtatttcttcatagacttatctctccaatataacggtctctgattttattattttttcttttttggagcatacatatcaagattcaagctctttggctcctcagactttttgctccgatatgattttttcactctcagcttaggcgcataaggattattatcatcaattttcgatatgacgcttgaatctttaatattatccgtacttttttttacaagaaccttaacttcttcgatattttctgaggtatcagaaaccatatcgtgttcaactttagtattcaatttcgcctgaatatctttttttggttcatctacgcttttaatattatcaggttttgacataacagattctttagaattagagacgtaatctttattaacattagacaccgtttctgttacagccttatatttcacattcgacttatcattcttagaatccgtccactcaatagaaggatagctatccgaaatattttttgagttatatttgatgccggaggaacgtccgggaatagtttcttttttctcagacacacgttccgcccttattcctgccataacagcatccgttaccagcttaactatctcctcattatacactcctctgctattctgttctgcccctgtataaatatcgcttttgacatcttggctgacagttttagtatgcttaacaacacttttttttgaaccactgtgatttttatttttgctgtgtttttgtgaatttttacttatcgttgtatcgcctgcacatgtgctgttgtcattaggtccgtttttgggagacttattctttggatttactccgcctccgggtccatcatcgtctccgccgtcatctctgtcttcataattttctgctctttcacttttaatatttgtatttgcatttatatcgcggaacgatgcgcttattaaacctcttgcgtcatatatacccttatttcttgtttcttcaatagcataagaaaatgctatatcctgttttggattttgggaattataatgctcaacataactcgtcagaacatcaataaacatttcggcctttttataactgcaattttcaaacatacacataaactggtcgcttccattatagcctacaaaaccgtagtcctcagcagtctcacgcaaaatctgtccaaactctccaagcagagtatcgcctgctgttcttcctatttgactgtttactgccttcaaaacatcaaggcggataagtataaaggtaaagttatcaggcaacggtttttcttcatactgatttatcagcatatcacactttgcacgattcggcagcttagtctttctgtccatatacataagatattcaataaagtcctgcatacgaccgagcaaaatagcgccgagacagccgcaaattaagaacaacacaacagctatcattaaataaagcttaatatttattctctcgttcacattaatactggtgagagaagtaatatttgacgcgcctagatattgattgaattcatctactgtcttttcaacaatttcataattcttatccagactgtcaataagttctttcatattgttttgtatctcttttattgcctcgtcagcatttgaagccggctcagccgtttcaaagatatttaaaagttcttctctgtgttctttatcaacctgcgtatactggcggtcaatttcaagagaaacatactgatttataagtgcgtcatatgtagtttcagtattaatctgatgtttgtattcatcttcatatacatcctttaatatataatcgcttgtattatcagaatcagtaccctttccatagtggtactgtataccctccttacttttttgactgtactgagttataagagcataaagcgggtctattttttctgaaaggttagctaaatcaatctgatactggcttattcggtttctataatctttaatcaaaactgattggtccttagacactttttgatttaaaatcttagagtacaactcaggaatattatagttcagctcctctttatacatattatagaggtcgttaaatgaatatcctgtagccgcagacctaaaagccggataatgaaactttttgtcatacaaataattataaatatcagtagcagaggtatccaagatttctgcgctctcaatataatcataactgccgctttcaatatttgaagcattattcggcaaaactgtctgatttatatatttttctccgtaattaataaaataattttttaaaatagaatcaagaacgcttgcagcataccctttgctgtaatcacttccaacgctgaacgtaactaagtaatcagtcggatgatacacatattcttctccgtcttttagtatcgcttcttttcttgactcttcatctgccggaataattggctctacagcgcacttagaacgaatagaatcagctccggtatttaaatccaaatcctcaagaacactggttattacctttgacgaataaatctcactgacatccaaactatctccgctgggagtcaaaccattgcttgcctctgaattagaatatcttaaaacagtctgcgccgtatacgtctgttttgacatagcatactgataaacgagaacggcgcccaagatacaaacaatcacaatcaaatatttccatttttttatatatcttaaaatttcaaagtttctcatacgtgcgccctcctatttctaagctttcttttgctcataaaatagaacaaagcacaaattaaaacaaaaaatacagcgcccaaagctattacctttttaagtgataacttctgaactaaagatagctctacatttttaaatgttaaataatccttagttttatatttaatatattccctgtctgtggcaagtgcaatctcagaaatatttttaaactcattatttatatttttgagcatttcctcagccttttcataatccccaacagccggagttctctcacttaacttatttattatatctgtatttatctcaatttcttttaacgtgtcctttgccgctgacaaatgaaattcagcgtcttttgccagataatcaatacctatattggttctggacatataatattcgtttttctcattgacagccggtatcataacagttcctatcatagcttcatcgtattttgatatgccgtcctgacgcacactgtaatccgccatagatttttgatactgcatatcaagaacagaatttttataatacaaagtctgaataaactgctccttttccttagcaagacctgtttcaagaacaaacgatttatattttgaaatgtcatattccagcaagttttgtaccattctctttaccgtctggaacgtctgtcccgtctctacagatttatatgtaccattttctgaaactcttccggacaaatactcatccatttgatttgctaatattgtaagctcatcgcctatttcaacatattccatatcggttatatcatccatattataagtaagcgcagtctttttatcggcataattctcgtgaaatacatcattataagctttgcaaatcatggtcataatatctttagcagaatatttttttgcttctttatttttggtatacgaaacattaaaacttgttgagataaaataattgctctcctcggtattaatagcttttgaatttgcgttccctacagaaatatgctctgaaagctgctcaggagttatatctcctgtgagtcccaaatattgtatcgcacgttctaaaaccgcatttgattttagctcatacatattaaatcttgttgaatttggattaagacctttagaaccctcctcataattcaaagacattgtagtatttacggtgtttccgctttgatatgcaaaaaagacacacaaaatcagcataaatgctattgtagaaaaaataattttaaacttctttttccataacaaaaacacaatagtttttgtcgatgaaagtccaagtttagcagggtctttttctgcaactacagctgtgttttccatatattcttttttattcaaaacagatttttttatattcatatttttgaattttccaaaatcttctttaatatattcctttaacttttcaaaaattatcaataaaatcacccaacttagtaataatgacaagactttcgtcttaccgcagtttatggtttagctttttcttatataaagttacactttcttctccgcgctttgataaaatctcaaattcactcttttccccatcatttaaaacaacaagctttcttttaagcttcccttttcccaaactgttctcatttccaatgtgaagagcataacacattggaatcagccgcaaaacggttcctgtatagaaataaaataatgtattgtcagtcatataagtcaaaaagatatataattcacaaagaaaaaataatcttaccgtttccagtccaaactttgattttatccaattatattgaaaaatcagagtataccatccccaggcaaaaaatccccaaaatcccatttcaatatacacacgcataaaatcattatgcaagtcaatcatgccgttaaaggctttaccgccttcctgcctgatttctgccatcatcatatggacatactcaaagccgtgaccaatataagtcggagaaatcttataatatttgtcaacagctccatataaaacatttctgcccattacatccacaccgagtttatccattatcatcataaaaatattatattttatgctgaataaatataaaaatgaaaaaatcactccgcatataagtatagttttcattataccaaactgcacacggggagtaagcttttcaagcccccatgcagccagcagcattaaaatacaactagctatagcgattctcttaaatccaagaccgaacaaaaacaaagccaaaattatatttatgactttcatcttctttgaacttatcttatcaaagaaaataaagtaaatcagaaaaaatccataagtaaacgttacatcatgaatttctaaccctttcatatatccttccgcagttccgccctgggttagaaaaacggttacagatgatactatttctgaaatcggataccgcggaaccaaaaccaaagctatagcaagattgcccagtgccagcccccagaacatatagtgtatgcctttttcaccaaacaaatatgctgcggcaaatatattaagtatcattataaactgaaatactatttttgaacagcccctcatcatatatgacactgtttcaaaattaagtatccatattataaaggaatagacaagcacaacagtaagccatattccatacacaaccataaatccggatatattgccgagattattaaaatctgccgtaataaatattacagccgctgcaagaataactgtaaccagcgttattgcttttgcattactgcttccaaatcccgaatcaagaacaaccgccaaagcgaaacagacaatataaaacgccgcaagaattttagaattttgcctgttctgcaaattagacataaacattattctccttgtctgttgattcgagccggccaaactttctacaaagacaatattgcattaaagttacgttcacagttgttatcgtctctaatctcaaaaaatgtttcggctctcgctttatacatatcatcaactaaaaatccgtcgttcaccttttctgctaaataatttataacctcatcttcggtcttcaaaaccggaccaaaaccatcccggccatagtcaaaataaccatgtgcataatgaatatcatcaaattgataataaactattggttttcccatatatgcaaaatcaaaaaatacacttgaaaaatcagtaatcagcatttttgaattcataagcaattcctgtacatcatagtcgttaaacgaagcgattatgactctcggactcacagaatgaaaatcttttaaaaatctttgtatttcaaaatgaggataaaaaacaagttcaaggtcgtttttgtcaagataatcaattaaattctgattattaataaaactttggagttttctataatactcagattgagtaaacttatcacggttccccaccgcacacacgtcgatacgccaagtaggcattaataatattctattttttagaacacacggtttatttaaagcgtcatatctgcacaatccgagatatttcacgacaccgctgggatatccatatcttttaataaccgcttcatattcaggacgtgctccgcaaacaaataaatcaagtttagttttcggataaaacatccactcaatatcattaactattataccatgctgaagaaataccagctttcccttgatgagacccaatttctgaaaacggttgtaactcaacacatcaggtgaatatccaaaaatgtgactgcttattttatagtcagaaacggcaaagagaaaatgatgttttaaacttttatatttgacgatattaccaagtttagcaactttatggtagtccgccgattttttttcaattatataatatgctttaatttcaggatgattttctcttatatatttaaaaaaatggtacccattatctctggcgtctgagccgcgctcagaaactatccaaacaccacggtatttggggaataagacttttgctattctccctattggataaaatataaccaaacagaaaaggtaccatatatacttaggcgcgcgaataatcaatcttttaaaatgactcattaactaccacctgtcgtttctgcttccgccgtattatttattctttaaataccaaatcattgatatttattttaaatattataccactatttaggcgttattgcaagcgtcttaaacaatattctccgaatatataacaaaaaacgttcccttttcaaaagttttcagttttatattattcgttgaataactttccggttatgttgacaattggaaatttattttgtaaaataaaaagagtttgatatcataaggagaaataatatgaaaaagaatatagtgcttgccgattgtgtaactgacgaagtagcctccctgctcaacggtcttaacaaggaaactgacctcaattttgaatgtaaatccataattgcaaactgggggagcagaggaatttttaatgttatcaaacgttatttaatgtatttttatataacctttttgtattttcttaaacgtgaccaatatgattatattttaggctggcagcaattttacgctttggtattctgcttttggtgcagaatttttaggactaaaaagaaaaataaagttgttgttataaattttacatataaacaaaaatcaggattttcaggacgaatatataaatggtttatgaaaacctgtctcagcggagactatattaattttatacacgttccgtcacaaaactacgcaaatcaatgcagccgggattttaatataccgctcagcaagtttattgttactactttcggaataaacgatatgtacggtcaatggaaagattcggaaaaacctgaaaagataaaatcaacagattatgtgttggcaattggacggtcaaacagggattataactttcttttggattcctggcagggtattaacgaaactcttgttataatatcagacacgtttaaacctaaaattttgcccgataatgttttgttaatagatgatataaccggagacgggcaatatccatttataataaactctaaagccgtgattcttccaatagacgacggcagaatatgttcgggagatacagttttactgacatccatgtcatttaaaaaaataataattgttacaaagccaagcactttgagtgaaatgtatattaaagacggtgaaaacggtctgcttataacaaaagataaatcaagcgtacataaagttatctctgatattttttatactgacaaatataattatatcggagaaaatgcaaggaattcatttttaacaaacttttcaagagaaaaaatgggccgagttattggccaagctataataggataaattaaaagcgcggataattccgcgcttatttcagttattttacttttttataatttcggaatatatttcttctatctgcctgccatactcgtcaagagttgtcatttgagttcttttttcctcacaaaatttactcattttttcacataattctctgtcattataaagcgtgcttattgcttcagtcaaagctttggaactaacctcttcaagaattattcccgttcttccgttttctacaagttcaggcattcctccgagaggcgtgcagataaccggggttccaaaagattctgattccaaaatcgaaagcggacaattttcataccatattgaaggataaattgaaaacagcgcttccgctatcaatttatgcagttcttttccggttttgaaccccacaaattccacattaggaatccctttacaaacattctccataggtccaacccctgcaactttaaacataatattgggaagggacttgcaggcttcaataaatatatcaactcccttctcttcagataatctgccaaaaaataaaatgtaattcttttttgtgtgttcaaaatcaaattttggaagttctatgtagttatgtattgaaactgtttttcctttatatatatattcgccaagccttttcttttcaagaagtttgctttctaaaaacctgctaggacatatatatttatcaacttttttatacgtccccttaatagcgtaaagccacgcttcaactgcaccgattatgcttttaatccttgaatagtgtatacactttcctttaatacaatttatctttgagccgttaaggcatttttcacagggggtctttttatataggtcaaacataagatgattaggacaaagcatttgtaagtcatgtacggtttgaacaattggagttccatgcttttttatctcatcaataattgaaggggtaagctgataattgatattattcatatgaacaatatcaggctgaaaattttcaagcacttttctgagcttttttcttgcctgaaatgaatatattattctaaacggataaagaaacttttccgctccgctgtcatgaaagtccatattttgtgtgtattgctctgcggaattatgcaccacattattcttatcgtacataccaaaatactcaacttcatgaccggctccgctcaaatattcacccagctttaaagtatatgtctctgcaccgcctttcggatacagatacttatttattaataatattttcattcgccgcacctcgctataccaccaaattattttccttttttataaagcgctgtcgtttgatctacaattttttcccaatcatatttttttaagatagtttcaaaattttcttttttccatatatcagaatattcgccttttaaaattttatccagcttaaccgacaagtcctgaatatctccatgcttaaatgaaggcatatacccgcctacaacttccacattctcaggtatatcactgacaaggcacggaacgccatagctcaccgattccagcaagctcattgccaacccctctatatcgcttggaagaacataaatataacaattcgagaacaactcatcgagcaatcttccttgaacaaagccggtcaaaattattctctcatcctcagacgccatcttcttaattttttccacatactcattacccggagttaaatctccggcaattaccaacttcttatttgtctcaacagttttaaaagcctcaattaaataatgcaaacctttttcaggcacaattctagctaaaaacaaaatataaccgtctttttggagaccaaatctttcacttatttcccgagcagaataatccgcatttttcttgacaatgccattaggaatcaagtgtgtatcccgtccataagtttctttaaaatacttttggttattatttgacaatactattaattcgtcagcatattttgaagcacatttttctccaagcttcagatattttgttgagaagccgccccatttggcacgctgccagtcaagcccatgtatagtggcaaccgtatgtataccaaaaagcttaggaagccacatcatagcgcacggtccttcagcatggtaatgaatacagtcataacctccaaacagcgcacgaaaacttgccagcactgaataaacaaaggcgtttaaagcgctaaccttaaaagttgggatttgaattatcctgatacctttatattcccgaggctgtttatacgctttgccaaatctgtctttgcgattatatacgtcaacttttaaacccctttcaaccattcgtaccgacagctcttctaccacaacttcaataccgccttcacgcgatggaactcttttatgtccaatcatagcgactttaaatctttttttatctttccgcatcatagcaacacctttcaatattatgccttgccaaacggcctttttttatataaccggctaataacaggcgtcagtgcggtatacattttggtaacaaacttccacataagttcctttaaatacacgtattcctctgttctgcaaaagaagacataattcatacacaatggaacgaatatggataccgccgcctttaaaacaaaatctatgtataaactgccgacagcaatttctgcgcttataaacttcgctaaaagcataataacaatacctattccagagtaaaatataaatctaaaataatactttccggaattgattttaaagcgttcagtataaagcagacgtatttttaaaataatttgtattaccagagacgccaaagttcccaaaagaattcctaaagttccaaactttattccaagaataatagaaagaattagattgacaacactgcctgctatagaaatatttttatccttggcaaacaaaccggatacggacataaacctccaaagaggatttcttaacacggttaagaaaaagtttacacacaaacaaaatactaccatcagaccaatcatagaatctgcattatacgtatattccaatccgtacattatcctgacaagcgttgacgaaagacaataaagacagcttgcaaacaaagaaccaaaaaaataattaataaatgttaactttctaagcacctggtcacacttatcacggtcatcctcagccatcagattgcctacgcttccagccgtcgcggcgtcaacctggtcaataagttttctcagtcccatggccaatgtcgaatatcctgtataaataccgacctcataagtgcttaccaggatagaaatcaaaatgttatcagtcgaattagttattttacctgaaagacttccaataaaaatattctttacatttttaaataccattcgcttttcgacgttcagaagttcgtctttcctgattaaaaacggatacatcttatctacctgacctgaaataactatgttggtggcaagggtaagcaatatttccacaatcagatataaaatataattatgaaaaacaaataaaagaattatgttaataatctcagcaacaattttaacaatagtagtaacctttgaaactatatataccttttgatccgcattaagcaaggaactcttatatgagaataaataagaagacgctgtctgagttagaaataacacaaaaacaagccgaatatatccgtcagacacatcgacctttgtaacaatattctgaataaacggaaccaggcagagacctattccaaacacagccaaagctatattacggtaggctgttttatacatattcatcagctttacaatcttcttttcgtccctttcggcaagaggtttgtaaagactgtaaactatagccgaaccaacacccatttcggcaagtgacagtattgcaattacctctgtgaataaaccgtttaagctgactgacagaattccaatctgacgcaccagaacgattctcacaataaatgtaaatgcaacgctgacaaactgagaaatgacgccatataacaagtttttagcgcttttctcacttcttgtaatatccgtcctactcttcatatattcactctttctaccaatatgttaaaacgttagttaccgttcataaaactatttacaatatgagtataattaacttgaataaaacttatctctaagtatataatactcaactatttacaagtttaccgacaaatccatctgattcaccggaattttcattggaatagtgcatatatatactaatattccggcttaccggacttccgtttttatcccgaacttttatcctgcaatttaaaaccggattattaatattaagcttattcacactattcattaacttttctttctcctccggggtcattgaaggatcctcatagaaaaatttctgcgcattagtaatcaaccttgcttttccaaactctttagcataggtttccgagaattcaattatatcattctttttattgtatttaaaaatcacatcatcatctaaaactgtaaaactgtcttctttatcagcattatcatttttacatgttttatcaaaattttcagagttttcaagttcaagctttgaactcacttttttcctctcatattgtggaatttctaaatttactttgttttcaaaggccattttatctaaaatatcttttagctccatatgacaattttttaagcactcaataatatcaggattaaactttccgcattccccgtttaatatcatatcaaccgccttttcatgtgaatacggaggtttatataccctcttgctcgtaagtgcgtcataaacatcggcaacagaaactatctgagcggatataggtatcatgtctccaacaagtccgtccggatatccgcggccgtcccagcgttcatgatggctcctgcaaatatcataataatacttgtacataggactgcattttatcatatctatactgtccagtattttacagccgttgaccgtgtgttctttcattatttcaaactcttccgcagttagcttcccgggcttatttaatatatagtcaggcacggaaattttgccaacatcatgcattgtggatgccgccgaaatattttcaatctcctcatgagcataccacttatttcctacctgcttctccaactcaattaaaagagtttttgttatctgccttattctgcatacgtgttcacccgactctgagtcacggaactcaatcgccgtagataaagcgtcaataatagacgcatttgcttctttaagctcctgagattttctttctatttcttcagtctgctcttttacacgcttttccaagtttatacgataatcataaagttctattgagttttgtatacggcacttaataacataagggttaaacggcttttctattctgtcgactatgccattctcaaaccctctgactaaggtttcattactagtgtccgctgtaacaaaaaatataggaacagatggtatcagctcctctttttttatttgttccaacgtctcaagaccatccattacgggcatgacaatatcaagaagcacagcggataaatcaggattattcctaatcgtttccaacgcctcttccccattctcagcctccagcacattgtagctatcagcaaaaagttcactgagaataatcctattcatctctacgtcatcaacaaccaaaacttttaattttccaggcacagccgcacctcctcccagctatattaaacactacagctgttttgccaactcacaaacttttttctgttcaatcttaagtttttcaaaatcttcatccaaactatcataaatattggctctaacattatccaccattctctgtccgattttctgaatctcactaaagcctagatttccggcaactccctttaaagtatgagcggctatctcaattccgctgtaattctgttcagccatagcagtttggagctcattaaaagtgttatcgtctatatacttcatagtacattttgctgccaaatccatattaccgacaaatcttgccgacacctcatccttatcaattcccagctcgtcccaaaattcgattatagtcatttatatttctcctctctgtctaatctctcctatatatatctcttgtataaaccttttcacttacatcttcaatctcattggaaaatctattggcaacaataatatccgaaagttctttaaatctatctaaattatttataactttcgctcccataaacgttttgcagtctcttaagacaggctcgtaaattattaaacttactcctgaactttctaaccttcgaataacgccctgaattgatgattgcctgaaattatcagaatcagttttcatcgttaatctgtatattccaacaacttttggttctctttcaagtatccttgcggcaataaaatcttttctggtcacattagcgtccacaactgctttcataatgctgttaggaacctcaccgaaattgctcaaaagctgtctggtatctttaggcaaacagtatcccccgtaaccaaaagacggattattataatggttacctattctgtcgtcaaggcaaattccttctataatttctgatgttttgagtcctttaatttccgcatacgaatcaagttcattaaaaaaagctatcctcatagccaaatatgtattggcgaaaagttttattgcctccgcctctgtcgaacctgtaaacaataccggaacatccttgttctctgccccctgctttaacaattcggcaaatatctccgccctttttgatttttctccaactattatacgtgaaggatgaagattatcatatagcgctttgccttctcttaaaaactcaggtgaaaaaatcagcctgtctgttttatatttttccctcatcatctctgtaaatccaacaggcaccgtagactttataaccattacagcagtatcagaatattttaaaacctgttctataacagtttcaacagacgatgtatcaaaataatccttctttgtatcataatctgtcggagtcgaaattattacatattcagctccgctaaatgctgtctccggaagatttacagcacataaatccaaatttttatttgcaagatattcgctgacgtccttatcaactataggcgatatttttttgtttatcatatcaactctatcagtatttatatcaaacgcagtcaccttgttatgctgtgaaagcaacacagcatttgaaagacctacatatccaatacccgcaacggtaatacgcataattccacatcccatttatttttctgatcaataagcaccatcaccattaaacactgccgggatagtctttaaaattatttttaagtcacaccaaataccttggtcatttatatattccagatccatatctatccatttttcaaaacttattttgcttcttcccccgcattgccaataacacgtaagacccggtcttaccttaagtctctgcatatcgtattcactatccatgactacctcacttggaagcggagggcgcggaccaactatactcatatcaccgattaaaatgtttataagctgaggaagttcatcaatactatactttctaataaaacgcccgactttagtaaccctcgggtcgttctctattttaaacacaggtccgctggcttcatttttactctgaagctcttttaacatctcttcagcattaacgaccatgcttctaaatttatacatccgaaaagctttgccgtctttaccaattctttgctgcataaaaaaacaggaccgccgtcttttttgattgcaatagaaaccgccaaaaataaaggtgataaaaaaataagagcaagcagtgaacaaataatatcagcagttctttttacaaacaaataccacaaatttttgttgggctgaatatttttaaatatttcataatgctcttttttaacaatattatgtgcagggttatactctcccctgtaaatctttcttgccattacgtttccccctaaaagttcgtggcttaccaattttatacaaatcccgtcccatataggtttataataacacaattctagaataaatacaagatttttcgtgatatattaataaaataattttatttaattaaaaaaatcaaacaatttttaccaatttatccattaatatgaaacactcaacttataataccgcttaatattatatgcagtaaacatttttttgacatcatattactgtaattttagataacaaaaagagccaaattgatatgccccccaaaagttagaccaaaaatctaacgattaggaggtcggttcaaatatggctctttttattttatttttttaaaaataattccaaaaacagaggaagtagatataggtccgaattcccggctgtcacggctgttgttcctattatcccccatcacaaagacatgatctttttcaacaacaataggagttccggcgccatattttccgtcttctatcaaggaagttatatactttcctccggttttagtcttttcgctaacatatggctcgtcaatcatttcattatttacataaatatctccggaattaaaatctatataaaccgtatctccttcaacagcgataattcttgagacaacagcattttttctgtcttcattagaataaaatgttattatatcgtttttctgatagttttgatttgttttattaatcagccagctttccccttcccgaattgccggttccatactggttcctgaaaccgtaacaactgatataacaaaagttttaatgaaaaacatggctaacataaccacaacaacggcgccaattataataaacgcccatttaaatgccggattatttttcttatttatatctttatgaacaccattacttgcggcaacagtattagcatcattaagtttcatattttcgcactccaaaattcaatattggattattgccgcccgccggcggctcattattgtagatataattataaaacaataagctgttgttgtcaatattactttagaatacataacctatactataacaatattaaataagcaaactatataatatattttaaatcattaggcaaaactctatcttttgccatcatttccatttgtacaatacattcgctcacagtggcaaatctctttctggctgcaaattcatcgactatctccaagtccttgtccagcatcagcgcttttattccatatggaagatatttattattatctatcgtcattgaatattctacagtcaccggtctgccatgaaattttgtctcataatgacattttagaaaaccctcaaacaaacattttatacaatcagttgaattataaatattaactttcttttttataatattaaacaacttattttgatctttcattataggttcttcaaacgcttcactttccattgttctctcactcactctccaaactatttctcatttgattttatattttgccgcaaatcagaataatacacttattttgttttataagcaaactttaaaatataatattttaaaaaattgcataactaccataaaaacgaaaactattaattatttcaaatttttatcagcaataattttgtaacattttaagctgagataaattaaatttcaacgatattaaactagttattccgttccgaacttaacgacgtgcaaaaataacataactgataatataataaaaaaaccttgtaatctaacaattttaaaatttatatattattattctatgcacggctaactaaaattagacgtaaaaagaggcagctgcgctgcctcaaataacttgaacaattaatcactcttcacagaagttttttcaccaaacggaaaaccacattccggacagaatttcggcaaactgcttagttctgagaattcccatccacaattgccgcatttataaaacggtctctttgctccgcattctatacaaaatttaccatggtttttggttccgcatttacatacccagccatcatcagacattttagaatcaactacaggtatttcaggctgcttattatcagaatcagcggtttgtctgttaggcatcattgtattcatcatattcatccccatcattccaaccacagcgccggttatatcaccgccattaacgccgccggactgttttcccatattttcgaacatagctgactgtgccgcagtcatacgcccctgaatagcaccttgagtgtttccaagcatcacggcagtgtcaaactcctcaattctagcgcgtgatttgtcatccggagtgattttttcaatccccaccgagataatctccatgccgcgcccctgtttccatgaggaatctaatatattactcataaaatcagataattccatttggtgcgaaggaatctcactgaacttcacaccttgaccggacagcttattaactgacgtatccaacgctgtcagaaattcacttctgcattgttctaaaagctgttcgctgttataagtgtcactgacgtttccggcaatgctgttataaaacactaacgggtcagtaattttaaatgtaaacataccataatagcgaatatataacaccgttttataatatgggtcatcataggccattggctgtgcagttccgtatttatttcctaatatctcttttgtgttaatatagtagatgcgctggtcgtttcctgtatcgcctccaaaagtaaacctcttgccaacttttcgaaacgattctcttagaccttcagaaaaattaccattcagcattgatggctctgatttactatcaaaagtataagctccagcttcacaggtaaaatcaattattttcccttgctctgtcacaatcattgcctgaccttcatttactaccagcaggctgtcttgagttattatatgttcactgcctttagtattgctggattgatagttggttgtgttaatgcgttttcgtcctaactgcagcagcgtctcttgagccatactgtcacaaacaaaatattctttccattgatcagcaagctctgaacgaaaagctcctgaaaaagctttaataagtcccattactatatctcctttttatagattttcaccaataaatttacaaagtacccaattaaaggttcctgatgtgacaattgacttgcaataaggacattccccagcggaggtgatttctgtaggcgctccgcaattagggcaattggtaacactcaaagattcagggtgctcagatgtttttgttccaattgtccgcataaaagtcaaagtatgaatcatttcccacaaatgtgttgtattgccggcaataatttttccggttgccgtttctttaacatagtctatcatatttgtaagcatttttacctctacatattcataactttgatcacgataaactttattgataaagctgtcttttacagcaacacgttccaaataattaacagtgccgttgcgggtatattcatccaattgctgagaatgctctctaaagagctgctcagactcaaacggtcttatcattttccaatcctgtttagtccaagcgacattcaaagttataaatacttcgcgggcccatgcaagaaatgcctcctcagaaaaattaggatccgtccgctgaatctcaaccgatgggtttacagatggtttaacatacccgcctctaggcgccgacggggcggcagtattgccggtattagcatcattgctattattttttataatcgatataatacatataattaataatattacaattccaattgatataaacgaaatgttgccaaaattgccgccataacctccataacgcatgtaaccgccgtaacctccgtaacctccactgtatccgccgtaatccgaggagccgctgtatcctcctccataaccgccagagccgctcgaataatcgttttggttgccaactcccgttggaacaagacgataactatagcttgtatttccctcatcaatatatgttgagacagcatatgccacggtgcagacacacattaatacaacaataagaagtatacaaactttatacacctgagaaattcgttttttcattatatttctcctttaaaactcgaaatatctaaataataaagcataatctgtttctcttaatacaatataacacagtgaattcatcttgtcaataatgcgcaaaaatcatatatactttttataatcattgtaaacatttaacattatattcttacaattttaagtaataaatcaagttatgggataataaaaagtatataaaatgtagttttgtaagcatcggtaggtgtggccacactcttcttaaaaaagtgtgttatacatgttatcttgttttgtcattgcctacaatgtctatgcccccacctgaaggatggggtaatacaaagaagtgacttgtttagattagcctgcaatgtaaataatatgaatgcgcaaataataacttgaatacgcaatacagatgaaatctgccgcgtaagacgcgcagccgtggtaaagtttttaattaaattggattctaaaaaacttttttatgtatattcacgctccgcgtgatatggcagttcacctaacgaggtgtgcacaagcaccccctaccgatattcactttaaatgccgtacattaagaaaataattctttaattatttattacaaatgttgtatgttaagaagtgaaggcgtgactccgcttgtaaaacgggtgtgatccatagagatttgggcagtccgcctacaccttaaccttcttccgtttccgttattaagttattaagcaacacgaataaaaaaccgtcagaactataaaagttctgacggtttacttattataatagctaatatcatataaattattctattataaatattttttattaaaacaaacgacaaaaactacaattcctgactaacagtaaatgaatttatatataagtcagctgaaacagtaccggcagtataaccgtttccggtttgacaaatcatgatatttgaaatcgctccctgtgcagcaaggtcagtaaacgcagagaccgtgtcactgtcatgactcgccaaaacattatccccttcggaaagtgttatcgttacattatttgtattataatcaaatacagatactaacttatattttttatcttttgtcagttttagtttatcatctttgtttccggcatttaaataaaattttgattttgtgcttccaaatttggtttggaaataagcaaaattctttccatttaccctattgaaattaatatcagccgcagagctctcatttatagcagtaaattcagttgttattgtgataactcctgtagtaatattgctcggagcctcccaagttacactattctgtcctgctgctgcgtctttcacttcaataactttttcaccattaacctcagctacagatatatcgccttctgctgcagttcctagcccggcctttaaaccggcaactgtctctccgttagctatattacctacaggtatatcagttaaatcaagtgtgaaatttattggttcaaccggtggattggtcggagcttctgttggagcttctgttgggcttaaagattcaggatatgttactgtaattgatctccaataattcccgcttggattgcctgcaactatatcgcatgttcctgccgccgtcactgtttcactttggtttgaaccggtctttgttactccattaatagtgtatgttccctcttctgagtaaatattgttaactgttacaacactattctcagctacaggaaccgtaaacttagttcctgtattaacctgtgcccaatctgtccagcttgcattagcaaactttccgtttgttgtatcaacagcgaacttcacatcaattttagctgaaccatttacagcttgatataccaaaaacttattaacaccctgccactgaactgtaggtgctccattttgtctctggaaatcgtatacaaccgttcctgacagagcttctgtgttttcagcaaatacaggtgttaatgtcacatcgtcctgtaccgtatactttgaaccaatatcaaaagtatctgttccgtcagtccagcctgtcaatgttttgccctcaagataaactgttctgttaacaggaatttcaacctctgtaccaaccgcttcttcaatggcgtccggtgcatctccttccgctcctgtatctcccaaactaaaggtaacagtcttatttgaagccggagttgcgctcggctcaggagttatacttggctcaggggataccgttgcgtcagggtcatctgttgctccaggtgttgctgtaggatttgtagattcaagatatgttacagtaacagatttccagtagcttccgcttggacttcctgcaactatatcacacgttcctgccgccagcattgtttcactctggtttgaacctgtctttgttactccattaatcgtgtatgttccctcttctgagtaaatactattaacggttacaacactattctcaactacaggaaccgtaaatttagttcctgtattaacctgtgcccaatctgtccaatttccattagcaaactttccgcttgtagtatcaactacgaatttcacatctattttgtcggatccgcttactgcttgatatactaagaaattactaacaccctgccactgaactgtaggtgttccgttctgtctctggaaatcatacacaaccgttcctgacagagacgctgtattatcaacaaatacaggtgttaatgtcacatcatcctgaaccgtatactttgaaccaacatcaacagttgttgttccgtcagtccaacctgttaatgtcttgccttcaagataaacagttctgtttacaggaatttcaacctctgcacctgccgccatttcaacagccgccggagcatcaccctctgcacccgtctctcctaaactaaatgtaaccgtcttatttaagttaggtgttgcggtaggttctgacgcatcttttgttgtaacagataagccatgaacatatattgaaccgctgtcaatagtaaatactaatgttttagcctcaccgctatagttaaactcaattgaatccccatcgttagcggtctttaatgaagccgaagcaggagccactccctcagtagaagctgtaattgttgctgaagcataagcacagcctttaaatacgattgcagagctgccttcagcaacaggaatctctactgtcattgcgcctgcgctctgctgaacgccatgctgagtatcatggaacttaacgcttctgaaagtaagcagtccgtcaggagctactaaggtatcaaatccaattgcagttgactgcggaactatgctgccgtccccaaagttgtatgttctgcttcccgctgccggttcagcaacaactgcaaccgcgtttatagttggcgcagcattatcagatgttattttcgtgtcagcaggaattgtatatgcgctgcttccgcctaaaataccggtaacatcaatactcttgcccgcttgaagagttgtagtaaactttccgtctttaatatctaaagcaaccagctcgccgcccatttttccaatgagtttaattccttcggcagaactgtcagcagctgtcaatcctgtaatcataccatttatttccatcaatggcttagccgttggtatttctgttgacggatacttaggtgaaacaattgaaacagaacgataaaatcctccaactttcaaaacaatatcaattgttttctctaaaccataataagtatacgacttattaccgcctgtaaatgtttcaccgtttattgtgtactgctcagttccataatatgtgtcgcccatagttataacgcttccgttaacaaccggaacagttagagtaacctctgggtttaccgctatccaatcgccatggtctgaaccgccgaattttccggtgtcagcttttattgtcatggtcttgcctgcattctctgaatccttcactgtataatcatatgattctccagcgtttacaacctgcgtaaaaccattgtttttctggaaatcccaagtagctgtcaaatatacttctacagcgtcttcaccttcaaccgctgctgtaaatttagaaccgaggaagtttccttttgagccggcaactgttgcataatatgttttacccttttcaacggctatatcttgttttacagcaacattggttcccggaagactaacgcttgactcggcatttcccatatagaaagtctttccgcttcctggtaaagcatatactgtccatgttccgtctccgggagcaacaaacttcagtccgttctttccgtcaggaacaactccgtttgaccaagagccgttatttgagccgcttgacagacccattgggaagtttatgccgtcaactgttcctccgttgccttgcttatccggtgaatagagaatagtaagacctctcatgaggtatgtgccctgaggtgttcctacctctgacgggtcagctttccaaaatgttgaataagcctttgacttatcagtatttgccgctacagcaatattgtcatatgtgccttcagcaaatgaaatcgacgctattctgttactttcggttattgctgtctgcgcggtagtttcagttggggttccgctgtttactgttacactaacagtattatcagttgtattaataacggcttcaactgtattccactttccgctttcaagaccttcaggaacaattgctaaataatccgctcccgcctggtctttaagcgttacaacgccggatgtgtttccatagacatcgtatgaaaccttaactataccaccggctaaaggcataatattaaacgctgtctcaaacggatttgtaactgcatatccggagttatttcctcctccgatagctgtcaagtttccgccgattttcgtcgtcttgttctcaaaatcagcatacaatatatcagctttatccgtaggaattgatacatcatatgatacagtttctttgagcaatgtcgacccctttacgcattggatagtataagttacatttcctattccattactttctccgtatgggtttctgattattgttccgtcatcattaataaatcctgaatattcagcccaaactttaacggctacgtcacctgttgaatctatttcaggaataacaacagttctgtcaagtacagcgtcaccgttttcagctttttcctgataattagaatcaatagcgtcctttgcagcctgcatagccgcattaaacactgacgggtcaattgacgggtctctagtaatagttatgtttatagtcttggaagttccgataagcttattatcagaacgtctgatataagcagtaatctcagccggtattgtatcactaaccggtcttataactgaaacttcgccgttttcactgatattcaaatactcgctctcagactcaaagtgaacatcataaccatcaaatccttcaataaatgaaggaagtgtaaagtcacctgatacctcatatgaatctgaatccaatttcttgattgtgtcgctctcaggaagttctaatgtctttatcttctcttttaccggtccccacattgtctttgcagccattggatcccagtcatcgccctctctaattaaataatcataagggttgatagcgagaacttcccattcgttcggaacgagacaatttctcttatcaagatttattggattgccggaagcgtcaaccgtaccatattcatagtatccggattctttagcaattgtcgaccagttgccccatcctgaatccataacagcaggcttagatgctccgccaacagttatattatcaattttaacacctattgcggctgttggtgaatctttaccgccccacggtcttccgaaatcaccctgggcaaaattagcatttgctgtagaagcacctgatacttttccgccccacatcaaatatccatacttagtggaagcattcttgcaggcagtcacatgtcctccggctgtctcgccgctctttgaatatcctgcccaattaaagttacagttgtcaaacacaagtgtatttccgccgaatatatagtcggtctgtccctctattgtacagttcttgaaatatacacggcttcctttagaacctgaatacaatgtatcctgactgctcttgaatgaacagttataaaattcaaccttatcgttatcttctatcgctatagcagcggctctttcagtaaacgatctgctatatacatcgctttctaaagttctttcaggcttaccgccggtgtcgctgtaaactcctccaaccggtgccggtttaacaccgtcatcaatttcttcttctgtcacatatctgttaaatgaattttcaaaaatcaaatctttaccaatgaagttgcccgcattcaaatgcgttgaacatccccatcttgctactgcctgattaagagcgtctctgccaagcgccttatttctctcataagcttccttgctgtaatatccgtctgtatctgcgctgtagtacatgtatccgataccgtaataccatgtcagcagaacatcgccttctgtgccatccatcttctgcatcgtaagataaggaacagttatatcaagctgttcacgataagtgcccggaacaatattgatttcgattctgtccgcctcgctggcatgattgtttagctttccggcatataccaaagcttctgaaacagtcttaaaagttttttgagcttcatctgtatcctttgaaccgtcaacagttaaaacattttccggattcgctgaaggaccgggagtttgggttggctcaaatgtagccggaggaatggtcggcggtcctggagttggtgtctcgggagccactgtcggtgtaggctgatcatgatcagctgtaggcgtaggacttgccggaggctctgttgggtcaggagtatcaccgaacgtaacatttacatcaacattctgtccaggcataatgaactttccgcctgccgttgcaatatctgttttatcctcagccactacttttacatttggatattttgccgcatcatccgatactgcgtcaacaacaacttctgcgccctgctgtactaaatattttgttgtgtctatcggcaattcagtaaagctgaagccataaatattcggctttgaaccatcaaggaacaaataatatgtagcaccgctcgtcacatcaaatgttactgttgtctgaagagtaccctctccttgaggatttaaatggttatattcttttccgttcacagcgtcagtcaagtattcacctgatacaccattttccgtaattcttactacactgagaggcttagtctgtccccagcctatagctacttcaacacgtccgtccgcagcaggcttaaagatatagaatgcaccgccgtttggaggactgtccggggttccgtttgatcctttatctgcacttgaataattcttagcattctgagttcctgtagatgtcgcgtcataaattacgcctccaatcattacaggctcaacaacagccgtgttaaacacattatcttttatatcatcagctgttccaaaggtaaccttaagcttttcacccactgaaacttcttcgcccggctgatatgtttttgtcccatcaattttataattaacacctttagctaatggatacggctctccgtttggctgtttcaaaactgccgttccgccagttacgctaactgttgacatataaacaggattaggagtcggagccattgtcggtgaagcagtaggctcatccggtccaattgttgctgtcggtgtcggtgttggctcttccggcttttctgttgctgtcggtgttggtgtcggctcttccggttttgctgttgctgttggaattggtgttggttcttccggttttgccgttgctgttggaattggcgttggttcttccggttttgccgttgctgttggctctgctgtcggttcatccggctttaccgttgatgtcggttccggaacagctgttggcacaacactattctcaataactaccctaaatacaggattatcactatccgtgtttgttgtgttaataacaaaatcataaacaccattttgtaatcctgacaaataatccttatttattgtcaatgtatttgtatcagaattatagacataatcattgctgctcaatggcttatcggacaaactcacaccatcaaaactgtctttttcagcaaattttataacagttgatgcttctgtatcgtttgaatcaatggttacaatttgcggttctattgaagctgtaccgttaattttaaccggatatgctaattctgcaaacttttcaccggtgtacggcgctgcagcagtagctactaccatcaaaatatgtccttgatccgcttcctgaacactataagtttcagaatctgcaccctctataggttcaaaagcttcggtgcttatatccctataccactgataaactacatattctttggctgcttccggaagcacatttgctgtcaatgtatcgccaacatatacgttaggttgatcgtctatctcaacagactcaagttcataacttggagttgctgttggttcaggattagcagttggacttccgttgctgacaaatccggcataaaacttcatagattttgttattctcttgctgtcaaaatcataagcttcattattttctgcgtcatttgcaagattctgcgacaaataccatccaacaaagtcaaacccctgttttgacggctcctcaggtctgtttgatttctgcaaataagtattctttgttatagtctttgttgcataaagttttgaatccacataaaacgtaagcttaacatcagatgacggagaaacattgccgcctgagcttccgcccgaattgggtctgaaatatgtattatcaggttttgctgtagcgtttggcgttacaacattacttatatttgaagacacattagcgtttctggacatatttacaacactgccggaaacctgtgaacctgtaatagtaacatctccgctcacctgaggagaaataactatactctgagcgactattccattcaaagttacgccgcccgtctttatcataactattccgccggcatactgagggccgtatgaacctggctccgtaatgtaaagcttaatcatattatcaataatcttaacaaattctgctcttgatatataatctttaggacgtatggttccatcctcataaccgccgatatatcctgcggctgtcattgcaccgacatatcctgttgcataatcagagatattttggtagtccgcgtattgtgtaataccggcctgagaattttcaaccgtcaaaccatatgcacgggcaagcattgtcattgcttcttcacgagtcatataattattcggagtcattgtgccgtctccgttaccggtgagagtaccggccgcaacaagtctcagcactgcatcagcaaaccagtctgaaactgacacatctgtaaatttgttgttagccttgtctatatagcctattacattttgagtcacctgcgctacctctgcgcgggttattgcgtcgtccggtctgaaatagccgccgtcgccctgaataactccataccctgaccaggtatcaatatagcttgcagcccaatgtccctctgtatcattgtactgtgccgctgaaacaacagtcataccgaaagtggtcaaaaccattgcaacagctaataccaaagccagtgttcttctaaaggatttcatatctaaaacccctccttattatattttattattatttttcaataaatgtggtaataaatctgtaaaaaactttagtcactttcatatatattaaacattttactataatttgcactcgttgtcaattatataattgtaatattttgtttaaaataacggtatttttgccatcgaggttaaaccatgcaaaaaaatttgaattcattataaaatatctgtagttttttgtctacgatgttaaataattaacgcaattattctgtctattattttatttttaataaaaattttatgtatttaattatagttcatcaaataaaaaaacgattggattgctccaaccgtttttttgttactttatataatataaaaattcaaatcttattaaacgtttagtttgctgcaacataatgaacaggagtccatccataaaaataatcttcaggacttggaatttctgttgctttatcatttggattatccctatcagcagtcaaatctgtagtgctgttaatattatgtacatagttaacataaagtttcgatgtactcagctctccgcccatttttgtccagccgttcggttttgagactccgtctaaagtaacgtcattaaagaaaactgcgcatcttgcaccgccccagtttcttccgaaaccgccgggagcaaatttcataccgcttatattactgttcttaactgtacagcctgtgaagaagtatcctgggtcagtttcagaacttgttttacaagctgaaatataaccgccatttgccttatccgagtaaccataccatgttaaattacaattttcaaacactacgctgttaccgccaaaaatgtaatctgtattacccaaaatatcacattcctttaaataagctgtgccgccggtatacaaagtatcctgacttgacaccatcttgcagcggtagaactccacgttatctgcatcaattgctacagcagcagctctttcagtagagtcttttatagtaacttttgtgcctttctttcttgtaaaattctttttatccggtccgcccggttcaacgccgtcagctatttcagcatccgttacatattgattaaatgtattttcaaaatcaatattctcagccaggaaattatccgctgtaatacgaatagtagcgccccatcttgttgcagtattcttcgtatcctttgcagctgcacaatcagcatcataataattattgctgcccattgagtaataaacatatcctataccataataatttgatacgactgccggattcgattcatcagcactcttaattgtgatattaggaacatcaactattacctgaccataatatgttccagggtcaagaactatagttacaggatttgaagttaaatcctcattaactctgcctgtcatagtacggattgaagccattgcctgatttatatccttatactctttgtcagatccaacatatacagtatcagcatatggcaccgcttctctgtttttcataaacaaaacatttttgcttggctcatcaactacaaccggaagactatacgatgttgacttcggagaaaaagtatatccatctccgccgctaataacagatacatcgtaggtttctcctgtaaacagtgaaacgttatagttaccatctgcgtcaggaacagctgtagcgtacggttcagactcaccggactttgtgaaagccaaaacagcatttatggaattgtcatatggttcaaggctgtttttcaaatcatttgagaatatagtgtaggctttgcctgttacattaatatcctgaggaatatatgtttttgttttgaatgcgatattatcaacgcccaaaactgcgcttcctccgccgggagtatatgcgccaactttatttattgcaagctgaggcactgtatccacttttttagttccgcctgtatttccaagctcaattgagcttctaagcgtataatctgcctcaccatcattctttgtatagatagaaactatattgtcagcttttgtatactctacttttactccataccacttatccggactataagtaaatccgcttattgggacgcttacagccttgttgtcagaaccaactgaaaaatagtcaacaatggcaagagctcctttatcggctgttttaagttcaaacacacgtccgtcgctggaatatgtgttgtttgcatcagcgttgttagtatcaaaaaatctcattaatatagtatcttttaaagtatcgccttttttgaaatctaattcagctgtaaatctatctccatccataggtgattctgcagcataagaccaaccatcctgctttgctgttcctgctgtagttgtatcattaaactcaaggtaattatccccgtcagctcttacttttacagttggcataatggtatcagcttctgcaacgtttactatgatatttttgccgtttgcattacttattgtatcaccggtattataagatgttccgccggcaatgtcattaaagttccaaacctcactggttacaggaccagaggtaggaccttccgaaggaataggacttgctgtagctgttgctacaggttcatctgtcgggccttctgttggttcagggcttgccgttaccacaggttcttctgtcggaccttctgttggttcaggacttgccgttaccacaggttcttctgtcggaccttctgttggttcaggacttgccgttaccactggctcttctgtcgggccttctgttggttcaggacttgccgttaccacaggttcttctgtcggtccctctgttggttcaggatttgctgttactacaggctcttccgtcggaccttctgttggttcaggacttgctgttgctaccggctcttctgtcggtccctctgtaggttctgaaggattaacagtagcagtcggttccggttcctctgtcggcactggacctgctgtaggacctccggtaatagaaaccataaacattgggttgtatacagcgtcttcagatacaataattgtgaacgcacttaatccatctgttaatccggcaaaataatctttcgaaattgtcagctttccagtttcttgattatatgtgtactgttcagcgttcagcatctttccgctctcatctgcaactccggttacattcataccttcgctgagggtaagggtggttgacgcgtcgtttccataagatactgtaactctttcaggatataccgaaggagcatcctttgccaaaactaatgaagaaacatcataaatggttccattatatttatttccgtcacctgtaactactaccttcaagtacttgcccttatcagcttcagtggctgtatatgagctctttgtcgcgccggaaattttttcacctgttccatggctttctgaagctctgtaccactgataagaaacataatttttagcagctgccggagcaagatttgctgccgttaatgtatcgcctacatatacgttaacgtaatcagttttattacctaccgcaatttcaacgtctgtcaaatcagaactgcttatatgacctgcatacaaattataatttttgttaacagctgaaaccgatgggtcaaatgttgtaccgctgcacttttcagctgcagcttttgaagtataccaaagaccatcccagttactctctttaggagtaggaatagcactctgagacaatttctttccttttgttacactctttgttttaactgtaccataattatcgccgtaataaaattttacagtaacagtgtttgcgcttgttcctccgcctgaattgcttccgccattgtttccgttaataattacattaggattgcttgaagcgttagggcttacaacatttcctgaattagatgtaacgttcgctgttgaagacaagtttataatatttcctgaaacctgagaacccataatagtaacatctccgtttacctgaggtgatactaccattcccttagcgataataccgcttaaggtaactccgcctgtcttaatcataaccaaaccgccgacgtactggcttccgtatgaaccgggctcggtaatataaagctttatcatattgtcaagaatcttaacaaactccgctctggagatataatccttaggacgaatggttccgtcttcataaccgccgacataactttcagctgtcatggctccaacatatcctgttgcataatcagaaatattctgataatcagcatactgggtaataccggcctgtgaattctcaactgtgagtccatatgcacgggcaagcattgtcattgcctcttcacgcgtcatatagttgtttggagacatagttccatcaccatttcccgtgagagctccggcagctgccagtttcaatatagcgtcagcataccaatctgatgcagatacatcagtaaatgtattggcagccttattaacataacttatcacgttttgagttacttgagctacttcagcacgcgtgatagcgtcgtcaggtctgaaataacctccgtcgccctgtataactccattgtctgaccatgtgtttatgtagctttctgcccaatgcccctgcgtatcactgtatgacgccgctgaaacgacagtcacacccatagctgtcagaaccattgccaaagctaacaccattgctaatgttctctttaaggttttcatttaaaccctccttgttgtagtcaaagcaagaatatacaatccctctaacttaaaaacaatctgtttactcctgctatgcttatataaattaattattttaacttttaaggcagcattgtctttttacactcaaaagacaaaaactgcatgtgttattttacagcatttactcaaatttgtcaagtgaaaccactctatataataccgaaaaactgtaggattacaatagatgtgttacaaatagaaaaaaagaatacggaaaactcataaattgtgttatagttatatcaccataatatcacatacgtatgtgatattatggtgatataactataacacaatttatgagttttccgtattctttttttctatttgtaacacatctattgtaatcctacaaagaacgaaaaagctaaaatataagtaagttgacaaacatttttagtaatgctatacttaaatttatagagtttgtattattttactaaataatattattatctattatttttataaaatttgtattttaaggagttatcagtatggacaatgttttggacggaagaataaaagaggttgctgaacgtataaaaaccttacgtgaaattgatggattaacgatggaagaagttgctgaaaagacttcagttgacatcgaaaaatataagcaaatcgaaaacggtgaaagtgattttagtttttcatttatatgtctttgcgctagagttttgggcgtagatgttacagatcttttagaaggacaaagcgcaactttgtcaggatatgagcttactcgtgccggtgaaggtatgaaaatagtaagacgtaaagaatttgaatataataatttggcgtctctttttaaaaatagaattgcagaaccatttcttgtaaccgcaccattttctgaagcggaacagcataaggatataaagctttcaaagcatgagggacaagagttagatattgttttaagcggtaagcttaaagtgcaaataggtgataatattgaaatattgaatcccggagatagtatttattacgacagcaagactcctcacggtatgattgctgttgattgtgacgcatgtaaattttatgcaatagtgctgactcccaacggcagagggacaagctatatagaaaatgttgaaataactcctgaaaagcctgttcctatccgtgaagattcagatgatatgatatataaaaactatcttaaaactgaaacggacaaaaacggtattgttaaatctatagattttattaatgaagataattttaattttgcatttgatattgttgataggcttgctgaaaaagctcctgataagctggctatgctgcatttgtccagagagaaagaagaacgcaggtttacttttgaagatatgaaaaagtattccgctaagactgcaaattattttaagtcacttggaataggaaaaggcgataaagtaatgcttgttttaaaacgccactatcaattctggttttctattcttgcattacataagataggtgctgttgtaatacccgcaacaaacctgcttgttgagcacgactttgattataggtttaaggcggctgaagtaaaggctatagtttgtacttcagatggtgatacggcacatcaggcagagcttggcgaaaaaaattgtgattttgatgtcttaaaaattatggttggaggcaagcgtgaaggctggcatgactttgacaatgaaattgaaaacttcagtgatgaattccctcgtcctcagaatctggatgaaactgcatgcggagacgaaactatgctgatgttctttacgtcaggcactaccggatatcctaagatagcaatgcatagccataaatatcctttggggcattttattactgcaaaatattggcagaatgtaaatcctgacggtattcattttactatatcagatactggctggggaaaagcgctgtggggaaaactctatggtcagtggatgtgtgaaggcgcagtattcacatatgattttgataaatttgaggcagaggatattttaccgctgtttaagaaatataatattacttctttctgcgcacctcctacgatgtttagattttttataaaagaagacttgggaaaatatgatttgtcttcactcgagtatgctactgttgcaggagaagcgcttaatcccgaagtatatcagcaattttataaacataccggtataaagcttatggagggatttggtcaaacagaaactactcttgtagtcggcaattttgttggtatgacgccaaaaccaggttctatgggcaaacccagtccgctgtatgatgttgatattgttttgccaaacggtaaatctgctgcagccggcgaagtcggtgaaatcgtgattaatactaagaacagtattccatgcggattatttaaaggatactataattctgaggaattaacgcgtgaagcatggcatgacggcgtatatcatatgggagatacggcttggcgtgacgaggacggttacttttggtatgttggaagaacagatgatgtcataaaatcatcaggttatcgtataggaccttttgaaattgaaagtgttatcatggaacttccttatgtattggaatgcgctattactcctgcaccggatccgatccgtggccaggtggttaaagctacaatagttttggtaaaaggtgttgaaggcagcgaagaaagaaaaaaagaagttcagaattatgtaaagaaacatacagctccttataagtatcctagaatagttgaatttgttgatgaactcccaaagacaataagcggcaagataaggcgcgttgagattagagataatgataataagcaataggtgagcaaaatgttcgtagataatcttatagaggaaataagcattacagaacttccaaatgtaaagataggaagttcagaggactttgaaggcggcaccggttgtactgttattttgtgtgtagacggagcccctgccggcgtagatgtaagaggaggggggccggcttcacgtgaaacacagcttttgaatcccactatggctatggataaaattaatgctgtggttctgagcggcggcagtgcttttggccttgatgcgtccggcggggttatgagttatttggaatccaaaggtattggatttgatgttggtgttactaaagttcctattgtttgtcaatcatctatttttgatttgacagttggttcaatgaaaaaaaggcctaattttgatatggcagtaaaagcttgtgaaaatgctgaaataaatatgcctgagcaaggctgttatggagccggcgttggagccactgtaggcaaagtgttgggaatggatcgttgtactaaaagcggaattggtatatatgcagcaaaattaggcggtcttatggttggcgctatagtagttgtaaatgctttcggagatatttttgattttgaaacaggaaagaaagttgcaggggtgctgaataaggataaaacaaaactatctgagaaagattgtcaagagttaatgtttgaattctattcaaattttgaaaatcaaataattacaaatacaacaattggtgctgttttaacaaatgctaactttgataaaacacatatgacaaaagttgctcaaatggctcaggacggttattcacgaagtatatgccctgttcacaccactcttgacggagatactatatatgcgttatcgctgggtgatttaaaagctgacattaatttggttggaactttatcggcatatgtgacgtctaaagcaatagttaatgctataaaattttccaaatcaatgtatggttttaaagctgtctgcgacttactctaaaaggtttgacattattttctgttgcatattcggttgatttatagtataatataaaataaatttagatttgaaaaaatcatgtattaaatatatagttaaggaaggttattatgaaaaaactgatttgtttgtttataagtttatcgataaccatcggtataatttgcagtttttctatatcaagctacgctgcatcacctattgaaaacatttatattaacggtcagcctattgattttagtgaggctgaacgtccgtacattcaaaatgatagaacaatgataccgcttagagccattgcagaagctttaggagctactgtatattggtttaatactgataaaaaaattcagattgtgagatatgatactacattacgtttggttattggcttgccaagacttgatatttataaaattgacggtgaagagcaagctttgaaagaaacagttgaactggacgctccggctttccagggagatataaccagagattttcgtacatttgtgcctgctagagcaatttcagaggcttttggagctgatgtaaacgctaaatttgttaatgatgatgaaggtaagaccgacagagcaatgaacgtatatattttagatgattatgatgaaactaaagaaaatgtagtttcgatagctgacttatatgataaaaaagatattcaagataaaactcttatttcaactgttggtataatatcaaaattggattctaaatattatttacaagatgaaaacgagccatataaaatgattcctattactgatattcctgaagtagaaaatttttggactgaacagcttggtgtagaaaataataaccctattggaacaaaagtgaaaattactactatggtatctttaaataatgagagtggatattctatacctattaaaagggctattaccggtataagaacaatagaaaaaagtaatagctcgtcacctgttgtaagcaatgaagataaaacaacagcaactccaaagccatcatatgaaaatttatttgctgattaacaagtttatacttaaaataataatgacctgtgattaatccgcaggtcatattttatatttgtttggttaaatcattaagacaatatttgcaaatcatttttcccctgtattcaactaaattatcttctctatcacagaaagcacagcaaggcgtaactctttgaataaatattttattgtctaatgtatatatttcaactcttattttttcatcgtctgattgacctagtacccgtctcatttcgctcggaataacgagacgtccatagtgatctaattcacgaatgacactagtaggtttcataattgctacctccttaacaatatgataataataccacatatatctaaatttgtcaattacaaaaggcaggtgtcattttttgaaattttttattttactatataactatatcaatataataaattaatattaacggtcggtatatttatgatattttctttttcttggattacatttttccattcgtattcatataagaatttagattttgcaaattttccgattgataatatatcacattgattttgatatattttttcaattaaatttttactatcattcattaaatcttcatagagcaattcataattatcttcagaaccattttgatttttcttggcaaatattttggtttcaatttcagcactgatttttttattctctatatttgtttttatattaggtgatgaactttttatcttgtagacttgattggtggattcggaagtaaaaaatatagaatctctttctatccctaaaagtatgtttataatttgacattcatgattacttagttctattttgggtatttccccggaaaacaagattgcccccgtaaatccatccggtgaaataattggaagatacccgtctcctgaactaccggtaagttttattaaaaatgttcttaaatttgtttgcaaagtttcggttgtagaagaatctgaaaataataattcataatatctagccgtactttcttcgagtgatgggttgactccatatagatactctttagcggtatctgtgcttgctatacatattttagtttccggacgcacatcattaatgttaataaaatcttcacagatattttttaaatacccatcactgttagttattgattttgaaaagacaataagttttaaatgtgaaagtgatggcgttttgcctataaatcttttaacgctctctaaaccgtcaaatatattatcagcatcaattgaaatattgtttactgacttattttctgtttcactttcttctgaacctgaattttgcgggtctgtattttctccggttgtcagcggatttgtaaattgaaatgagaatatcaatgaacctgtattttcgtctttatctacgccaacagctattgcatatgcggtatcttcaatatccctgttgtcgtaacagccgcaaagaggaactattccaattaacaataccaatattgacgcggttgttttcatgaagctgttttttggtaaaccaatttttttcataagaattcttatgaccgcaagtgatgttgataaatataatataccggatgtgattgaaataattatatttaacacatcaagccgggtgttaagccggtttatacctgaaaatcttgatatatggaacaatggattattttctgctacaaaaacagagtcggtcgggattgccagcagagatattatagtaaatatactgtaaatcccagcgccaataattgctgagtataatataatttttgaacggtttatatttttagacttttcttcaggcattattgttaaaaatacaattggaactattatttctgaaaatgcaaacagatgtttgaatccgctgcttatcgtggaagcgattccatttcctaatacaggaagagcattatatatatcatcatattttatactgcttattgaaattataatcaatccaattattattaacggaacgcatatactatgcagttttaagatagacgaaaagtctctgattccaacaatcagcactgtaacagcaattaatgtcaagacaatccaaagaggagtattgggataagcgctgttgtttattgtattaatcagctggtaaataaaatatatattatgtgatattaaataaccaattaatatcacaaatatagtgtttcttaaataagtgtttttaaggctcaatataaaatatcttttgaaaaagtaaactataaacaaaatcgccgtaaatacagcaaaactaaagattaatgccaaacatgatgaagaacctgtctcgtgaagcagaatgttcgaaaatcctataaatatttttatcagcagacagttaaatgttaaacaccatatacctaaattgatattttttttattcatagatatcactctgtttccttttattttttccactttctgcttatgtgcggctgttttatattatcttttgttttgagttcagccggacgtctttcttttttccatattggttttacaagcaatgattcagatgaacgaacgttaattccgaaatcggatagaaatggaaacccaaacgttttagtcgctgccaatcctgacaaagttatcattatagcagccaccagaccaactattccaaacaaatatgccgctgctatatatacaaattttaatacgctgagagatcttgaaagtgataaggttggtgtcgaaaatgctccaattccgcctattgatactattattattaatattggactgactatgcttgcttcaactgcagcctggcctaaaatcagtccaccgattataccaagagtgctgccaattgggtttggtactctgacggatgcctcttttataagttcaaatgatatttccattaagattaattctactataagtggaaatggaactttttcacggctggctgaaatagctattagtaagtcagtggggagaattgcctggtggtataacattacggcaataaacagtgcaggaagaagaattgacagagacatgccaaatattcgtactaatctcatcaaatttgcctcgggaacacgtacataattgtcttctgtggcttctatcaaatctaatgaagtagttggaactatcaatgcaaatgggctgccctgaactattattgcaacctttccctcgacaagcattgaggcaactctgtcgggtctctctgtttttaaggttctagtcataggaaaataagtggtgtcttctatcagcatttcaacatcacttgaagaaaatatatactcggtatctatatcttttaatcttctagttacctctttgataagcttgctgtttgttattccttcaatgtacattaaagcgcagggaattttatttgttttgcctaccggaatattagtggcggttaatttaggattttttaatatctttctaacaagtgctaaatttgtcattattgattcagcaaatgcttcctgaggtccggcaaggctgacttcttgagtaggcgaatcaactcctcttgagtcccagccttttatatcggctataaaacagcagtcgcagccgtctataaagataccgcattcaccaaaggagattttttctccgattaaatcaaaatcttcggcaatgcttagaggcgccactgatactatttgtttaaaaacaatatctttttttggtgttacgcttgtgtcatacgctttgcatgtgagcaaagaccgcataatatcacggtttaaaaatgtttgatttgacattccgtcatagtatattaaaaaagcgtcagccgtttcgtttttaaactcaactttaaattcgcgaaagttaaaatcaatattcttatctgagttaaacagctgttttacggtattctcattattttttaaatttgtatctatcaattttatcacctggattattttacccttatagccaaattgctattcagtttttatatagagattttgttcatataaactttacaattttatttttagttttaaggtttatttaagaaaactaatttataattttcgtatagtcaagtggaaatatttttaaggaggaataaaatgaaaaaagtattatgttcaatattctctgtatttatactattattcttaatgtcctttccgataacgtcgctggctgaggaaaacataaatgtttattatgaaggagaattattagtttttgatgtcgaacctcagattataaataattttactatggtaccggcaagaactatatttgaagctatgggcgcaaaggtaaaatgggacgaagaaactcagactgtaactgtgaaaaagaagaaaaaatcaatctctatgacaataggcggtcaaatcactaatcaagacggagaggtgataaatactgagacagttccagtcgtactaaatgacagaacattggttccggtgaaattaatatctgaatttttaggagctcaggtagaatggaatgaaaatacaaatactgtttatataaccgaaaaagaaaagattgaagatgattcatggaaagaaaattttggaacaattgatatgacttctatggaagtgagcggaagcggagttagagcagatgataaaattgtatatataaccgaaggcggagattttgaagtcagcggcaaaacagaagacggaatgattctcgtaaataccgatgaaaaagttaagcttagattaagtggtgtagacataacaaatagtgacggtccggcaatatattttgaaaataccgacaaaggatatataaccttaacagacgaaactgataatacgcttactgatagtgagcaatataattatgaagacgcaagcgctcccttattcagtgatgatgatttggagataaaaggcaatggttccttaataattaatgcgaattataaacatggtattgccggtgatgatgatataaagatagaaaatgggaatataacaataaattcaaaaataggtgacgggatacatgccaaatgtggtgttaagataataggaggaactttgaatattacttcagacggtgacggtatccagtcggttgaatggaatgttacagttgatggcggtgaaataaatataactactaccggggaaataatcggttcacgcaaaaacaataccggttttccaaaagattttgaaagaaatgatcagcaggacgacggagcgaaatttgattctaacactttaccggaaaatcgcagaaataacgtaaatgaaaaaggcgatatttcacaaatattaaataacattgatacttcagtctttgataatatgaccgttgaggaagtaactgaaaagcttaaatcaatggttgaaaacggagaattatcaataagtggaaatattgaagacacacagcaaactcaggaggaaggcgttactaccaatgaaaaaagttcaaaaggattaaaagcagcagaagatatttatataaactcaggaaaaataaatatacattcaattgaccatagtattcattcggaagatattactgagataaacggcggtgaattaaatatttattctgaagagggcaaaggtatgagcgctcacggaaatttgaatgttaatgcaggtgatataaatatagaatattccacagaaggaatagaaagtaaagcagaaatgacaatcaacagcggaaacattcatataatatccacagacgatgggttaaatggcggaggaacaggcagtgatagtatggaacatggtgtaatggattcgagtataattttagaacgtcttgctgagagaattgttaatggaaatattgataatcagcaaaataatatgccgcctgattttttccctggtaatacagaacaaataatgcagcagcccgattccctccctccaaatggtgaaagaccgactgataatggacaaaatatatctagttttaatgatccggctaattttggagggcagcgtacggacgttgataataacggtcattctatcactataaacggaggttatatctatattgacgcaatggcagacgcaattgactccaatggttttttggaagttaatggcggaacgatcatcctggacggtccaacgtgcggcggagacagtccgcttgatacagacggttccatgtggataaacggtggttatattgttgctgtcggaagcaatggtatgcttgaaataccaagtgatgattcaaaacaaaatgttttagtggtatcgttgtctgaagctgtacaaaaagagactataattaatatcaaaaattcaagcggtgaaaatataatgacatttaagccgtcaaaagaataccaggctttgattttcagctcacctgatttagattcagatgatacttatactatctcttatggtggaacagctgatagtgaaagtattgacggactgtatagtcagccttcaaattgcattggaggagctgaagttggaagtataacagcttctgaaaccatttcaaaactaggaacatttggaggaaggttcggcggcggtcgaggcggattttaatttatcaatagaagaggtgatgattaatacgctgaatctattgtttttcataacccctttttatattacccctttttatatttttatgactctccttattggagagtcttttttcttgacttaaaatgtaaaaaaatatataattatatcaaatagttataataccattaaaataataataagttaaattatgaggaggttaaattatgaaagtattattagtaaacggaagcccaaaacataaaggctgtacatacactgctttaagaatagtagcagatgaacttgaaaaaaacgggattgatacagaaatttttcaggttggtatgctccctataagagggtgtattggctgcggcatgtgcgctaaaaatggaaatggactatgtcagttcgatgacgatgtggtaaataaagctattctcagctgtagaactgccgatgcaataattataggctcacctgttcattatgcttctgcgtcaggcgcaataacttcatttttagacagattattctatgctggcggttctaacttggcatataaacccggagcagttgttgcaagctgcagaagagggggcgcatcagcaacgcttgatcaaatttcaaaatattttggcataacaaatatgcctattgtttgttcaaattattggaacatggttcatgggaatactcctgaggaagttttgaaagacgaagaaggcgttcagactatgagaatacttggaagaaatatggcatggattttgaaatctttaaatgcagcaaaagaggccggaatagaaccgcctgaacgtgaagcaaagataaaaacaaattatataagataacaaaaaggtcataatgtgaaataccacattatgaccttttatatatcattacatttaattttattacaaattttctattgcttcaatagagtttggtattggattttcggatattgattctattataccattgtcacatgcggacgcaatgtttggatcaatcggcagcttatccaatacttttatgttgtgtttttttgctatttcatctatatgactttctccgaaaatgtttatttttttgccgcagtcaggacaggttacataactcatattttcgacaagtccaataatcggaatattcattaactctgccattttcactgctttgccaacaatcattgagacaagctcctgcggtgaagtgacaataattataccgtcaactgggagtgactgaaaaactgtcagtggtacgtctccggttcccggcggcatatcaacaaacatataatcctcatcttcccaaactacttcactccaaaattgtttaactgttccggcaataataggacctctccaaactacaggttcagtatcgttttcaagcagcaaatttatagacataatgtcgataccaagctttgatttttcaggaagaataccaaagtcgctgccaacggccttattggttataccaaaagcttttggtattgacggtcctgttatatcagcgtccaaaattgcaacattgtgtccctttttcttcatgtttacagctaagagtgaagtgacgagagatttacctacgccgccttttccgctgacaatacctattaccttttttacagaactatgcgctcccaaatctaccttaaaactattttgttcctgttctctttcagagcaagtttcaccgcagcttgaacaatcatgtgtgcaattttcgctcattttcatatctccaatctaaataaattttaaaatattgaaaaacaacaagtttaaatataactttcttttccattcttgtcaagtatatagagtgtatataatttatttttgtataatttacaaatttatttatttgcatataaacaattgttatgatataatattttaaaattttgcggtttttgttattaatctgcgtatgaaaatttaaatatatttgatactaggagatagaatatgaagatttctcaactgtttaaaaataaaaatgacaaacctataatatcttttgaaatttttcctcccaaaaaggaagaggcttttgaaaatgtgggaattatgctaaaagaattgtcttatcttgaaccgaactttattagtgtaacctgcggagcaggaggaagttcaaacagaaataaaactatagagcttgcatcaaagataaaaaatgaatttaatattgagtctatggctcatatgacctgtatttcttctacacctgatagtgttcttgaagaggtgaaggtaatacaggacgaagggatagaaaatattttagccctgagaggagatattccaaaagaaggttttgaacctgaaaaagcaagttatagtcatgcctttgaactaataaaagaaattaagtcgaatagtgaactatgtgtggctgcaggagcttatcctgagggtcatattgaatgcgatgattttaataaaagtatagaacatatgaaaataaaagaagaagcgggtgcagatttttttgtctcacagctgttttttgataacagatacttttatagattttttgaagctgctgaaaaagccggtattaccgttccaataactcccggtataatgccaatgatgtctaagagtcagatttctaatatgatatttatgtgcggtgcgtctttgccttcggaaatggttagaattctatataaatatgaatccagccctgacgatcttctaaaagccggaatagagtatgccggaagacaaataagcgatttggtaaaaaataatacgtgtggtatacatctgtattctatgaacaaacctgagatagctaagcagcttcttgaatatgtataatataatttgagagagtggtttaatgtttaatattgagcttgataaaaatgaaatactaagatatttaggacatagaggtcaggaaattgatactaataccgaaactatgattgataactgtatagaggaaataaaaaaaatctcgcggtatagatatgtgtataagatttttgatataaaagtcggatatcatgatgcagtttcttgtatagatgttgttggtaccagtttaagacttgaaggcaatgatatatatgagcatttgcgcgaatgccgaaaatgtgccgttatggctgtgacgctcggtatagaagttgataacagcatacgtattgcacaagggaatgatatgctgaaggcggtagtaatggatagctgcgccactgaatttatcgaaaaggtttgcgatgaagttgaaaagaaaataaaagctgaggcggaagttttagggaaaggaacaaatttgcgcttttctcccggttatggagatttaccaattgacattcagaaaaatttactcgatgttcttgacgccaacagaaaaattggattgacagtgacgaacagctctttaatgatacccggaaagtcggttaccgcaataattggatttactgaaaatataagttttaaaaagaaaaaatcaaaatgcgatatttgttcaatgagagaaaattgtatgttcagaaaaggaggaactacttgtgagcgtggcagagtatataaagcataatagattattttttgacggagccatgggaaccatgcttcaaaaatccggtcttgagcctggaggtcttcctgaagtatataatattgagaaacctgaaacagtgcttgaaatacacaaagaatatgtaaaagcaggtgcagatgtaataacagcaaacacttttcaagctaatgagttgaaactgtctgactgcggatactcggtagaagagataataacagcaggagtgcagcttgctaaaaaaagcggcgcaaagttttcagctcttgatattggtcctttagggcagcttatggagcccatgggaacattatcttttgatgatgcgtatgaaatgtttaaacggcaattagttgcaggtgaaaaagccggtgctgatatagtcctgtttgagacgatgtctgatttgttggaggttaaggccggcattcttgctgcaagagaaaacacaaaactgccggtatttgtcacaatgacatttcaggaagacggaagaacatttgtcggctgtgaccctaagtcggttgctgtcacactttctggattaggagtagatgctttaggcgtaaactgttctctaggacccaaagaattattgccaactatagatgagctcataaaatactcacgggtaccggttatggttcagcctaatgcgggacttccgcatattgagaatgataagacagtttacaatattacggctgaggatttttctaactttatgaaaaaaattgcagaaaaaggcgtttctgttttaggcggatgctgcggcacaaccccggagtttattaaggaaacaagaaaattggttgaggatgttgagtttttcagtccggaatatgagcatgtaacagcagtgtcgtcaggaactaaaactgttatttttgataatgccgttacagttattggagagagaattaacccgaccggaaagaaaaaactgaaggaaaaattaagacaacaggattttaggtatttagtcagtgaagctatctcgcaaatgcataacagcgctgatgtccttgacgttaattgcggcttgccggagataaatgaagcggagactcttgcaaaagccgtcagtgagatacaggcggcagtaaacctgcctcttcagcttgacagcagtgacaaaaacgccgttgaagctggaatacgaaaatataatggtaagcctattattaattctgttaacggcaaacaagaaagtatggacgccatttttccaatagctaaaaaatatggtgcggttgttgtaggtttatgtcttgatgaaaccggaatacctgaaacggcagagggaagatataaaattgctgagaaaatagtacgtacagcggaaacatacggaataccaaaagaagatattattattgattgtttagtacttacagcttcagcccaacagaagttagttatagaaacaataaacgctatcaagctggtaaaagagagacttggggttaaaactgtgctcggagtaagcaacgtgtcattcgggcttcctgcgcgcccaattttaaacagtgtatttttggccgcaggttttggcgcaggactggattcggcaatagttaatccaatgagttttgatattatgaaaacagtccgagggtttaaagtgctgaacaatcaggatgttgacgctgtagattatatttcaaactatgcagattatgtgtctgaaaccggttccggcaaagatagtgccggaaaaattagtgataatacgaatgcggaaaaaggtacaaatgaagatattacttcttatatcattgatggaagacgtgaagaaacaggtatagcaacaaaagaaatgctcaaagatttagaccctataaaaataattgacaattattttattccggcacttgatattgtgggagatagatacgaaaagggaacggcgtttctgccgcagcttatccaatctgcagaggctgtaaaatgtggttttgaaattatacgtgacagttcaaaaaaagaaggagaaaataaaaaaggcaaaattgttttggctacagttaagggtgatattcacgatattggaaaaaatattgtaaaaatgctgctcgaaaattatggttatgatgtaattgacttaggtaaagacgttcctatagaaagtgttgtagacgctgtaattcagaatgatattaagctggtcggtctcagcgcattgatgacaacaacggtaaaaagtatgaaagatacaatttctgccttaagagaagcaggtagcaacgctaaggtagtagtcggcggagctgtattaaatgaggagtatgttaattttgtcggcgccgattattatggaaaagacgcaagagcaactgttaagattgctaatgaaatttttggatatgacaattaatattaggaggatttacagtgattattgattttcatacgcatgtttttccggacaagatatctaagagagcgattcattcgcttgagaataatattgtaaaaattcagggtgaaaactttccctccagaacagacggcagccttggtgagctgctgaaaacaatgaaagaggataatgttgactattctgtggttttaccaattgcaaccaccgttacccaatcaacatcaataaacaaatttgcagcggaaataaatggacataacggaatcatatcttttggaagcgttcacccattacaaaatgattgtgagaaagttctagaagaaatcaaagaggccggattattgggtataaagttacatccggaatatcagggggtttttgtgagttccccggaaataaaaagaattttaaaaaagacaaatgaacttggtctttatgttgtgtttcatgccggacaggatattggtatgccaaagcctgttcactgcatgccggaatgtttgaatcatgttttggattatataagcggagataagattattgcagctcatatgggcggctggaaagaatgggatgccgtagaaaaatacatagttggaacgccaataatgattgacacttcatatacggccggatttatggataaggaacaatttaaacgtattgttagaaatcatggaagtgataaggttttatttggaaccgataatccatggcaccgggtaaaagaagaaaaagagtttatagacagtatcggtcttgaaaaaattgaactagaaaatatatattataaaaacgcaaaaagaattttaaatatataattattaaaaacggacctgcattttttatgcggtccgttttttattaaattcatttaaatactcatttgacttcttatatctgttttttctaaaaatagcatataataaagctgcaaatgctattacagcaaagaaagtgtaaatattaaatgtcccataagctataaacgagccaagttggtagatacataaagaaattatatacgcaaatcccgtttgatataaaatagcaaatgcagtccattttttattattcatttctcttgctatcgctgccattgctgcacagcatggagcacataaaagattaaatgctaaaaatgaataggccgataatggtgtaaacgctgaagtcaatataccccaggaaccttcaattgaaccggattgcgaaaagtcaaacaggactgcaagagtgcttactatattttctttagcaataagccctgcaagtgtagcaacagtttctctccagctgccaaacccaagaggtataaaaatccatgatatccatcttccaatgtaagacagcagtccattagaaaagtcatttacaaatccaaaatttccgttttcaaagccgagatttgacaaaaaccatattattattgttgaaattaatatcactgttcctgctttttttataaatgaccatgagcggtcccacatacttctcaaaacatttgttgcggttggcatgtggtatggaggcaattccataacaaacggagtatcgtctccgctaaacgctgaggttttcttaagtataatcccagaaacaacaattgctgatattccaagcaaatatgcgcttggagccacccaccaggctccaccgaataaagctcctgaaaataaagcgataacaggaagttttgctccgcatgggataaaagttgttgttattattgtcatttttctgtcagccgggttttctatagttctggaagccataattcccggaacgccgcaccctgttccaattagaataggaataaatgattttcctgacagaccaaattttctgaaaacttcgtccataataaaagcaacgcgagacatatatccacagccttccaagaaggctagaaatataaaaagcaccattaattgaggtacaaaaccaagcacagcaccaacaccgccaattattccgtcaataatcaaactattgagccagtccgcagttccaataaagcttaagaaactttcaacaattaccgggatacccggtatccagtttccaaataaactccatccctctccaaatattccatcattcatccagtcggttacataagaaccaactattgtaactgaaacaaagtacataacaaacattactattataaaaattggtatagctgcaaacctatttgttagaactagatcaattttttctgataatgtctgttcattatcagacttccttatataacaatttttaataatagaggtaatataagcatatcgttcgttagtaattatactttcactgtcatcgttaaaagtcttttcggtctttttaattatatcttcaacgtttggaatataatttgaatttattaactcgttaatttttttatctctttcaaaaatttttatagcaaagaagcgtttttgagtatcagggatttccctgctaagcttatgagatataaatgcaagagtctcctcaagttttgggctaaaaagaagtggtcttaaaattttcttatttttatcagtttgagctaactctatagctttatctacagcctgagaaataccgtcatttttaagcgcagatgcctcaaaaaccggacagccgcttaaggcgtccgaaaatctttgaagatttaaaacatcgccttgtttttttaaaatatctgccatatttatgagaattacaacaggtattccaagttcaagcagctgagttgtaagatatagattgcgttctatgtttgtcccgtcgattacattcaaaatcacgtcaggacgttctagaattaaatattttcgagaaataacttcttctaatgtgtatggagataatgaatatatgccgggcaagtccataataataacatcgctgttatattttaaagtaccttcttttttttctacggtaacaccgggccaatttccgacatattgattcgatcctgttaaagcgttaaatatagtagtttttccgcaatttggatttccagcaagtgcgatttttacagtcatagatttctccttaaatatgtatgttaatcaatctctataagttcagcgtcacattttctaagagacagttcataacctcttactcttaattccattgggtctcccaaaggcgcaaatttacgaacacttatagcagtacctttcgttattcccatatccattattcttcgttttaatgcgccgctgccattaagtttgacaactttgacagtagtgccgcattctgcatctttaagcgttttcattaataaacactccttatcaaaagcatgatcaagctatttcctcacatataggttagcacactctaacttgtatgtcaattagtatttgtatagtaaaaaatatttatatattttattcaataggtataaatttaataactagatatttgtagaacattataaaaaataattaaaaagatatgaggcgctttaaaattaatataatatgttaattgatataaattgataataaaataagaatttagaatatggtataaatttgagtaaaattaacgcagaacttaaaattatttttaaaatatattatattaattaatagaatatcataaatttctattaaaaatctagttattatataatagctagatttaatttatttattatcttaattattataattatttattaaaatataacttattcattaaaacaaaagaaaatatacataaaagtgttgacatttttacaataatttggtaatatatactataataatattgtaaaaataatccaataaaatatgcggttattaaaaattatttttattttacacttgtattaacacataaatattcataataacacttattataaattactaaaatataatatatataatatagtgaaatataaactataaatagaaagttaaatttattaattttatctttacacatattattttagctatttatagttaaatggtttaattattgttaatcaattaatattttcattcagacattttaaatatttctttgaactataaaaaatagtatattacaatatatttagtatttcaaaaaaatttatttatgatatttgaattaattttaaagaaaggaagtgaaaaaatgaaaataagttcgtgttagagattgcagtattatatgaattttaattatacttttatcatccgaaaatattgtaatatattaattgttttaagtaatacatactttgaagaaaatatttttaaatttgttttatatgaaaatattaaatttgcattttaattaagtaaaaaaacaaaaaagaaaaaagagaaattaggagggagaaaaattgaagcgaaggttaataagtctaatattggcaatgtcaatgttaatatgtatgagtaattttggtatagtaaattctcagggggaagagaataacgacgttgatgtttctgaaaatgtaacgctgccggaattccagagtaaagcaacggagcaaccggttgatacaaccccggaacccacagaattaatatttactcaggagtcggttgaaacgcctgaaagttccaaaccgcaggaaactattcctacacctgcgttgctggataataatacagttgaaaatttttcacgtcagattgaaattatggttactacacaagacggaataattgtgtcgaatgcagatgtatcagttgatgaagatcatgctgtttctgattcgaatggtattgcacattttgacagtataccggtgggaaagcatatcctgaaagtgtatgctgccggatatagatacaaagaaacagtatttgttatccctggtaatagtaaagagacgtatgaacataatacatatttgatacaaaatgaaagtgagttaatgcttctctcagatgaaaatgatgaggagactgcctacagcgagaaagttaaaaaatattcggaaaatttagactatgcagatggcggtggatttaatatttcttacagccgttctgtcgacggaagcgtaggcacgggagttcctgttactcagtgtaatggatacatttattgttttgattcagacgccacatttgcatataatatatcaaacgatagttggtcaatttatccggtgattccaacgtacagagcatatgccggagttgcagcaataggtgatataatatatgtaattggaggggctggtccaaatgcggcaggcaacgaggttcaggcttttaacacaaatacaaaaacatggtctcaaaagtcaaacatgccgcagacaggctcatattttaacgctcatgctgtgaacggaaatatttacatcggcggaggtattgtgtcaggaaatccagcaggaatgtatccgagtgactccagcggagaggttagtctatataaatattcacctgaaaatgaccagtggacaattcctgtgcagaaaggagaagttcactctttaaagggaagagtttcaacagccgctaacggcaggatttattttactgccggacatgattggtatgctgatcagcattcaaatgatgtatatatttatgatactatagatgaaacatggaaaagaggcgaaataagaccctctaattcagataatattggtatattcggcggaatatttacaaacttaggtagttgcctgtattatcagggcggaacatcatggtttggcggtgacgatgaaggacataaatataccgtggaggacagaccgtgtctgtatgatccgtattatgattcatggatggagtttaatttatatgatgacaactataaactggagttggttgactatcagtcagtaacatcatacgggagcacaatatttatacctgaaaatgacaatgattcatttcgtttaaaaaaggtttcagtatttaattcgtatgtaaactcaccggaaatgtatagagaccataacatagcaataggcagcagtcatatacttaaagttgaagacggaaaagtgatggcaaaaggaaaaaatgactgcggacagctaggcaacggcacaaatattgattctgaggattttacagaagttaaagcagtgtggggaaataaaagaatagcaaaaacagaaacccgtgccaaaacatcatatgctctgacggaagatggagttttgtatggatggggagataattcaagcgcacagctaggagacggaacttatgttaataaaaatatacctgtagaaattctaacaggtatatctgatattacagcaggagtagaacacgcttctgcattgagacaggaaagttcagttccaaattatagaatatattcctggggttctaacaaagaaaagcaaatagatgatgacagtaaggttgaatattatgatttgccacgcggagtagacagtggagaaattatagaagccggaagctatcagtcatataggtataattctcttgatagtagcaaactttatgcttggggaaagaatgataaaggtcagctgggcggaagtatgccgaatccctttaattacttaaatgattatgacaacatcaaaaagattgcaaccggagctaatcatacggcaatgatatgcaatgataaccagctttatgtttttggtgataatacatattgccagctgggcagaaatttaggagaaaatgaaacgtatttatcggccccaatacgaacaggaatatatcctgaaaatgtttttgccggaggaaactctactgcatatgttttgcagggggaagtataccaggcaggacaggtatttgacggaaataacgcatcgttcaaaaaggttgaaaacactaaaaatataaatgaggttgcagtcggagacaagttttctataggtgttgatgtgaataaaacattatggcgctggggaagcctgacggacgacagcagttttgaattgaaatcttcaaaaaaataccaaaagccgcttaaatcagaatatatctatgattttattgatatagactcacagcgagcacagacaataggaataaacagcgaaggaaaagtagttgcttggggcacaggatactatggagacggaacagataaggaagttaaacacaacgctcctcatgaaatagttttaggagacggcgttatcccaaaagcaattgagcgcggaaagaattttaatttggtgcttgatacagagggcaatgtatggggatttggaagtaatactaataagcctatgggcggcatggccggtaaatataaagtaccgactaaaatatcagatatatcagatgtaaagcagatcacagcaggagacggtttcagtattttcctgaaaaacgacggaacgctttggggtatgggagccaatactttaggacagttatgtcagggtaataacacagattcaaaagtcccggttcaaataacggataaaaataactttacaaaagtatcagccggagacagctttgttgctgcaattgccggaaatgaagtatatacttggggtgaagggacagacggacagcttggaaacggaacggatagttctgcaaacactcctcaaaaacttcaggtaagctttgatgagccatacgaaaaatttgtcgatataaaaaccagcgttaattattgtatagctttaaccaacaaaggcaacgtatacagctggggcagaaacgcatcaggtcagttgggtcatggggataaagtgagcagaaatatacctgcaaaagtaccggggcttagcgatataaaatcagtatttgctgaaaacttgcagagctttgcaataaaaaatgacggaacagtgtacgcatggggaaatggctctaactatcagctcggattaaataagacaggaacacagcagtctccggcagttgttacaagtctggcaggaaaagaaataacagaaatagtatgcggaaacggatacagcatagcgctgagccgatatggatatatgtattcatttggttccaatatagacggctgtatgccggtatattcagaagaggcacagaagtatagctcaatcgagatagaggatatgcgctggctgagaaaatatatgagtgataatataggaaacaatataaccgaaaatatatcactgccggcggagggacccaaaggaagcaaaataacatggacaagcagccacgagggatacataagcaacacgggagaagtacaccgcccggacgcatacggaaaagatacagatgtaacactaacggcagaaataggacaatacgataacggcgagaaggcaagatttgatttaactgtgctgcaagacgcatcaataaaaccgtcaaccgatgtgccgatacgttctataggtatggaatatgaccagatgtatccggaaacagccccggatgtatatcccgaaataacagcagcgtcaatgacagttatagatgaaagcaaaggaatatatcaactgaccatacgagacgaccagtatagatgttctgaaaaagcggtgccattctttttctggagtgcgagacaaggaacatttctgcctgttgatggctgtgacgattatagaagcgtacagtttacagttgatccggacgcattgagaaaacagataaaagttattgtaggtataggagatggtttgggttacattgacagaaaatcaattcttattcaaacaagcggtactgcggaagcaagcgtgcagacggcagattcagaaaatataatgatattggcaatggaaaatgagcttacccaggaagacataagcaaggatatagaagagacaggctcggcagtgacattggcaataggaattgataattcagctgatatgcagaagtttgaccagggttcaacaaaaagatgggcaagttcagttgaggggctgatagattcggcaaataaaggaacagaaatagttttagtggacgatacaaactatggatatgcaaaagacgcagaaagcgcaaagaattcactggaactaatgatgtccaaggaatattcgggaacaacagatgcggaaactatgcttgcacgatgcgaggaagcgttaaatgaggaggaaagtatatctataaatgggaacaaagtgataactttattcgtccaaaaaataacagataaaaccgcattggaagaaaagatagaagaacttgcaaataagggtatcacagtatatgtaatgttactcggcggaggatatgaaggaagcaacgaagaagtaataaactgtgaaacagagctgaatctgaggctaaatgtatcagagctgtacggagcctttaataacatatcacaggttatgagcctttcggagaatgaaacgtccgctttttcgaacggtaatatatataatagcgacttcagagcaggaaaacatgattttgctaatgttactgccaaccaatttggtgcgtcaattgcttacgcaggttgccgcgttaggtgaaccatcatctgaacacgcagtgttcaatatacaaatatcacaacttatatgacacaaatgttatacaaatatgcatatatattgtacttaataaaaatatcataactatatcgtatatatattatacttaataaaaatatcataactatatcgtatatatattgtacttaataaaaatatcataactatatcgtatatatattgtacttaataaaaatatatgtgatattatggtgatataactataacacaatttatgagttttccgtattctttttttctctttgtaacacatctattgtaatcctacaatataataaacaaaatttaaaattcagtcttgacatataaaaaaaatcatgttataatgtcaaagttgaatttaggggtatagctcagttggtagagcagcggtctccaaaaccgcgtgccgtgagttcaaatcttactacccctgccaataaatagcctgaaatgaaaatttcgggctttttttgtaaataaaaggagtttttatatgagttttacatttaaaaaagaaatgccttcagcggaacacttgaaagaacttttaccggtaccgtctaacagcgcagaaatccgtattaaacgcataagagaaatagaagccgttttgtccggcaaagacaacagaatacttcttataataggtccgtgctcggctgacaacgaagattctgtctgcgactacatatcacggctcgcctctgttcagaatgaagtgaatgataaaattcttttggtgccgagagtatacaccaataaacccagaaccaccggagagggttataaaggcatgatgcaccagcccgaccctaatgaagcgcccaacgcttttgaaggtataaaagcgatacgtcaaatgcaccttagagttcttagagagacaggttttgtatctgctgatgaaatgctctatccgggcaaccacccatatctagacgatcttttaggatatgttgctgtaggcgcccgctcagttgaaaaccaacagcataggcttgttgccagcggacttgatatgcccatcggtatgaaaaacggtaccggcggcgataccggagttatgtttaacgcaatttatgctgcgcagcatggtcatgacttcatataccaaaaccatgaggtgactacaaatgggaatccatacgctcacgctatcctcagaggcggaatagacgaacgcggcagaaacataccaaactatcattatgaagacctgcttagaatagccagcgagtatgatgagaaaggttttgaaaaccctgctgtaattattgataccaatcataataattctgcaaaacagtttaatcagcagcctcggatagcctcagaagttatgcacagtatggcgtacgaaccgcttcttaggaaaatgataaaaggctttatggttgaaagttacatcgaagagggtaatcaaaagattggagaaaacagcatttatggaaaatctattacagacccttgtttgggctggaaagataccgaaatgatgatttataaactggctgaccagcttatataataattttccaatcttatagatgtttatacaaattataaaatagtataagagcactcaacttattaataattaataacattatcagcaattcaaacaaaaaaagtaaaaattaacaatgacacaaaagaccgcttatgatataataaattataggcggttctttttatactgtcaaatcgttggcagcccattttctcacgaaaaatataccgcttttataaaccattttatattacgcttcaaattttctttacaagaaaaataacagagagtgataatcacatcttttatctgccttataaattcaacctttgaacggaaaactgattaatattatcctgataccagaaaataatatatgaacttatataaaatattacctctctttttcgtgcagataaagagaggacaaccattgcagcaaatattataattatcattgaaaaggagagaaaaggactgaatagaaagattaaacaattgaagtatatttgaaccatgccccgagaaaaacgcccaatataaagtatagatacttataactaaaaaataaggagttaaactatggataatcaatttatgttatttcttgaaacggttgatgagcgctttcaagattttgtaacccaaataaacaactatttaacagaacaaggatgtaagtgtgacataaaagaagctaaaagcggatatgttgtttcctatattttaaacaaaccaaaaaggactttagctaactttgtaacccgcaaaaccggtatgaagattagaatttatcctgaacacctaaataattaccaagactttttaaacacacttcctgagaaaatgaaaaaggatatacggaaggcgtctgtctgtaaacgactgctcaatcctgatgattgcaatccgaaatgtgtaaccggttattcttttgaactggacggcgagcaatatcaaaaatgccgttatatggcttttatgcccgttttaagcgaagaaaacaatccatatattaagcagttcttggaaagagaattatcatattgcggatgagcatcaaaggtttatttatttcaatgcaggttgatatagttttcggagaatgccaaaaatcattgtttctataagatacattatataaaattcttttaaaaaattatacagtaagttgatatataaaaataaaaaccgcttattccagttaataaggaacgtgcggtttttattaagcttttatatttaagcaacatttatatcgttttatatttggataaaaaatggcaaacaccttttgtgttcgccatctttttattatatcattttaaaatcgtcttttttaatacttactgtcaccggacgttttgttaaattaattcttatttctagctttggcacgaagctgattattcaatatcttttttctgattcttaaactttcaggtgtaacttcaagaagttcatcctccgccaaaaactctaagcaagcctcaaggctcatctgaacgggcggaaccagtttaagagcgtcatcgcttccggaagcacgggtatttgtcagctgttttttcttacaaacattaacgttcatatcctccgctttagggtttattccaacaaccataccttcgtatactttagttcccggagtaataaacagcgagcctctgtcctgaaccttaaacaaaccgtatcctacggcttcaccggtctcaaacgccaccaaagaaccagtgtgcctgctgcttatctcacccttatatggctgatactcataaaagactgagttcagtataccctcgccctttgtatcagttaaaaactcatttctgtatcccagcaacccgcgggcaggtattaaatattcaagtttcattcttccgccctgaggagccatcgaaaccatttcgcctttacgctgtccgattttatccattaccgcgcctacgctctcttcaggaacatcaataataagtctttctattggttcacattttactccgtcgacttccttatacagaactcttggagttccgactgaaaactcatatccctcgcggcgcatagtttcaatcaaaatagaaatgtgcatttcacctctaccagcaacattaaaactgtctgttgactctccttctgttaccctcaatgaaacatcctttaaaagttctctcatcaaacggtcgcgcagctggcgtgaagttacaaacttaccctccctgcccgcaaacggactgtcatttacagaaaacgtcatctcaatagtaggctcgcttatctttacaaacggaagaggagccggatcctcaggtgaagctattgtatctccgatagttatttcaggaatacccgaaaaacatataatatccccaacttttgcctcatcaacagcagttctgttaagaccgtctatctgataaagattaaccatttttgccttatatggttcatggttattatgatattcagataccataacttcctgattctgttttacacagcctctctcaattctgccgattccgattctgcccacataatcattataatctattgaagacaccagcatttgcatagggccatcagcatctccctctggcgccgggatataatcttttattgtttcaaacagcaccttaaggtcttttccctcttcatactgggaaagcgaagcggttcctgccctgcctgaacagaacagtatgggactttccaactgttcgtcattggcgtcaagctctataagaagatcaagaatttcatcagggatttcatcaagtctggcgtcggctctatctattttattaaccacaacaataacacgatggttcatttcaagagccttttgaagcacaaatctcgtttgaggcataggaccttcagcagcgtcaacaagcaaaataacaccgtttaccatcttcagaatacgctcaacctctccgctgaaatcagcgtgacccggcgtatcaattatattcatctttataccgtcgtaatatacagacgtgtttttagcaagtatagtgataccgcgttcacgttccaaatcgttgttatccataacgcgttcctcaacgacctggttctctctataaactccgccctgtttcagcatttcatcaactagcgtcgtcttaccatggtcaacgtgtgctattatcgcaatatttctcaaatcttctcttaccataaattttactccttctaacaagaaaatagacacggcactccgtgtctcttacattttaatattataccacagaaaaacatgttctgtaaacgtaaaatatattcaaaatttgcaaataatatgcaataaatcttgatatatttttactttttatataaaaagtttgttctcttttctgtcggcgcaaaccttatgaagttttaaagacaccatctttaaagcaagcttggaaacagctctggctccgttagggcaaacaggaacgcatctcatacaggcaatacactttttcgaatctgctttataatcttttcctatagctccaaccggacatttttcagcacatataccgcaagatacgcattgtttagttggctgaggtgaaaatggaaccccgccaaaatcacggaacttctcatttccgggtatattttttatcccaattatattatgtgaatttaaaagtttgtttttaaactctttcgcataatcttttatttctttaatatctttactatcaggtctgtcagccgctatatcagtaactatagaatgccttgaaactatggaagccgctcctgcaacaacaaatccgttgttttcagcaatgcttctcagctcagttaaagtatcatcataagacctgtttccatatgtagttaaaataaatgcaggagtattatttcccctaatatttttaattctttcggcggcaatagccggaacccttcctccaaatgacggaactccaataactgctaatgtatttttgtcaatctcacaaccatattcctcgttgtcggttacatccaaatattcagccggctcaccaaaagccttgcagaacaactcaataaccctttttgtattacccgtagcgctaaaataaattgctttcactccattaattttcatttcttctcctcttttctaagctagaatccaaattccatcaacgtcactatgtcttaatttaaactcattatatgcctttactgccaattccctatcatcaaacattccaaaaacagcacttccgcttccgctcatcatggcaatatcagctcccaaattcagcatttcagctttatatacattaacctgcggacaaatctgtaccgccgaattctcaagtatatttcccataaatggctgaatctttttcaaatctccagactttataccggaaataattttgtcaatatccaaatttacaggcttattattataatcaagatgctcatagacccactttgttgaaatactctgtatcggtttggctatcaaataacaaacttcaggaagttcgggcaaaaccgtcaatctttcaccaatgccctcagccaaagcacagcctcccataacacagaacggaacgtcagcgccaagcttttcacccattttcattctttcttccaaagataacggagaatccaaaagcttatttaacccgtttataactcctgcggcatcggaactgcctcctgccattccggctcccattggtatatgcttttctatatatatatcacagccgccatcaaattttatggctttaaaaaactcattggcagctttccatgctaaattgctctcatcaacgggcatatttatatcacttccggcaatttctatcccctcctcatcttttaaagatatggttatcacatcaaaaataccaacctgagtcattatcattctaacttcatgataaccattcggatattttccaagaacatctattgcaatatttattttggcgctgcatttttcagttatcgattttaccattacttacctccgcatttataccagccaactcttttcctgaattatactccttcaatgaataaatgtcaattatacaaaaaatacgtctccataaaagagacgtatttacaatattataatataaaataattaacttcaaaatttattttactgaacagaaagcaccaactgatctcttcttatatatccctgatttccatcataatctaccctggcataggtatcagaaacaatctccacaagaccaacaggcgtctcagccgcaagagttagaataatgcctgctccgcttcttggctggtcaagcatctctacagcgccggaacgccaaacatacctgacagcggaatattgtttcggcggagaataattcgataagtaaaacttagctacatatccatacatattgtcatattttacacgagcgtattcgctgtttgcatcctcaacatatcctatccgtgttccataaggaatggtagttataattgttgatgatgcgcttggtttctgtctaaaatttactgcattcgccacatttgtaacatatctatatccgacaacctcctgagaacgctcatacgctgcaatctcatcctcaatttctcccctaagtatttcagcggtattgcgcacgtcatcgcttagattcccttgctcaaggaaagcgttcactctggcataagctccataatagtcaccgttttctaccatttttctaatatcatttagagtacggtaaggcaaataattaatttgttccttaatatctgaaacaagttggttatattcgtcaaccaacgccggagtagttctgtacaaataaaaatcactcaaagcgtcagccgcctcataatacagtccctgattatacaaatttatagcattatcaagatatgctcttgtatcagccagctgctgttcaatctcgttaggcagtccattagccattagttggatatttcgctcagttgtttctttttgagtataaaactcagcaagaccaataggatttataattcttgcggattctatttcactatctgtcaccaaaccaattatagcttgtgcctgataaaaatcaccgttaaaattataattaataatattagttagcttatcctcaaacgatgctttatagtaaaccggtaagtttgttatattactataagatgaatcactgttaataaaaactgtggtggaagtctcgtcccatttcacactcattcccagcttctcagatacaaatctaaccgggaccattgtcacgctgtcatttaaaacaaaaggagcttcaggaagctggtatactgcatcttttccatccgtaacattgacgcttccaatagtcatatttaaaattatattttctttagtaatagtaacgcattgttctgcctcgttccattcaacattgcaccccaatgtctcagagacaattcttaccggaacaaaagtagtatcatttataactacgcccggttgcgaagactgaacaactttatcatttacataaatagttacattgttataatcagcaaacactgttccgcaaataagacaaaccattgctgcaaaccccaaaaagctaaaaaatacctttttcataacactgccccctttaatatattaccttccttttatactattattatacaataaaacttttgttccgtcaatcatatttacgcatttgttaagaacaaatattttattataaacatttatatatcaaacgaaataattcgacatttttcttaaaaattgttatatcgttgtaatttttatttttataaactatattgacataaatattttatcgtgttatactgtgctcgtacaaaattaaaggaggcaattatatgaaatttgtaaaaagattattagtcataacggcagcgtgtgcaatgatactaagcttagcgtcatgcggaaacggcgactcaaacaaagcgactgataccatgaagcaaactgaaccgacctcagcatcagattcggctgtaacaaatgaaccttcggcaagcgatgaaatcggaaataatgtcgatgatgtaaaaaaacaggccgaagctatcgaagagagccgcgaatccctcagagctcttattggaaaagcgtctactctcagttctgaagaggacatagccgcatggggcaaagaattttctgatattaaaaatgatttagaggaaaaaacaaaaactctctcagacactatagcaaacgcccccgaggaatatcaggaatcttacggaaaaatatcagatgctgccacagctgcttatgacgcaatggccggttttgaatctgctgttacttccgctgtcagcggagatgtatcagagtttaaatcaaaagtttcagactttttgggcaaaatgggagatgcagacaaactctgggataacgcagaagttagataacatcgtgttataatataaatattaagtaaaagttaaactattgatatgcaatagtttacgcggttacaattatttaaaattaatatatttttaaaagtagtataaaaataagcatagtcaaaagttttattaagctctgactatgcttatgttatattaaacgtgtgttatacaatattaacatattatactttaaatcatgtaaactaagacttggaataaaaagattacatttaaatcggactgaaatattaaatttaagtattataaacataaaaatatgatttagcaagtatcggagggctgtgaccacacttttttaaagtgtgtgttatacaaatcaattgttttgataaagttgtaatgtctgtgaccccatctgcaaggtgggcgtgatacaaagtgacctgttttaattagccttcaatgtcaattgtggctacacttttatttgaaagtgtatgttatacaaaccatataatgttatatatactttaaacgccaataattaacttagttgtcatatataaataacttggttgtgatatgcagatgaaatctgcctcgttaggcgcgcagttccggttacttttactataaaagaattatgataaactattctatttttattcacgcttcgcgtgagatgaatgttcacctaacgaggtgtgcaagcacacaatacatcacaactaagcaatttattgacattgaaggctaattaaaacaggtcactttgtatcacaccaacctttacaggtcgggtcacaccctgccgatgttcactataacacactatttatagaataatatttctaaaccaaatttattataaattgtggttttgcaagcatcggcagggcaaacgcagtttgccgcgttaggcgcgcagcttcagttatttttactataaaagatttatgacaaatttctctacttatattcacgcttcgcgtgagatgacagctcacctaacgaggtgtgcaagcacacaatacatcacaactaagcaatttattgacgttgaaggctataataaaacaagttactttgtatcacaccaacctttacaggtcgggtcacaccctgccgatgttcactataacacactatttatagaataatatttctaaaacaaatttattataaaatgtggttttgcaagcatcggcagagcaaacgcagtttgcctcgttaggcgcgcagttccggttacttttattatataagaattatgacaaactactccatgtgtgtttacgcatgcgcggtgtaaaataaaaattattgccgcaactgatcgcagagaacaaatacaaaccttaaacacacaaaatttagtatctgctcttaacaaaacgaacgccttttaatttgggcgtccgtttcgatctaattaatattatccgttctgcacaatcactttaaaaactttctaattatatttttggctataggaaccgcagactttcctcccgaagttgccgcattttcaagaaccaccgcaacacatatagtcggattttctacaggagcataacctacaaaccaagcatggtctttatcagtttcattctcagctgttcccgtcttgccggccactgttataccgctgatttgagcccctgtacctgttccatcctcaacaacgcctatcatcatatcttcgatatagtcagcacatgcagttccaatgctgtcatataaaactgaaggctttgtctgtcctataacagtcccgttctcggttgttacagtctccacgagatacggtttcatcatctttccattattagcaacagcgctcgccatcattgccacatgcagaggagtcataaccagcccaccctgtcctatagacaccaaggcgccgtctaaatctgtcatctttttatattgaatctgactttgtgaaaccggaatatcaaagtcaaatgatttgtttaccccaaacttttcagcttcagcttttaccgcgtccgcacccatctcataccctaaagtacaaaacacataattactggacacttcaaatgcggtctttatatctaattttccaaaagattctttattataattatatactgttacgtcgtcttttttaaataatccttcatcgtcaaaagtttcagtggtcattccgttgtcatacactcctgcagctgtaacaattttatatgtcgaacccggcggatataacccctgtgttgcccttgctaaaaacggtgaattctcatcctccatcattgacggccaatccttttcaattgtttccggattaaagtcgggcagactcaccattgccaagatttgtccggtagtaggttccatagccacaatagctccatcccttccgtcgagctgttcatatgcgtactcctgaagttcatcgtttatagtaagattgagattattaccgtgctttatctcattcaaagtcaagcttattgtgccttttccaataaggtcatcatcatggctcatttcaagctgagtttttccatacacctgagaacaatatccgattatgtgagaatataatcttccctttggatacttcctgattctagcgtcaccgtctatctccgtttcggcaagcagcaccccgtcctgagaatatatctctccgcgctgaacctgctgttcactctcccactggcgtttattatatgagtttgtatacacatccttggcacgaaacatattaaaccacaataaataagttaccagcgccaaaaaaagcagcgagatggcaatcaggacgcgtatgattcttttattcgtcctcattttcggtcatctccccctttctttctgtcttcgcggatattgcctgaactattcccaacgaagcaaaacttataactatagacgtacctccatagctgacaaacggcagtgtaattcccgtcagaggtatcatttttgtaactccgcctataatgataaatgtttgaatagcaaacataaccgtaacgccaaagctaacagctttatcataagggtcgctggccataattgaaatcttaaaacatctgtacgcaattaagaaaaacaataggattactgcaactcctccgaaaactcccatttcttcacagatagcagcaaatataaaatctgagtgaacttcgggtatataatacggcgaaccgtttcctaatccgcgtccaaaataaccgcctgacgcaatagcaaaaagcgactgtgtaatttgatagcccttactggctatatcagaccatgggtcaagccatgttgatattctgacctgtatatgatacaaaaacttatatcccaaaataccgataattccaagcgcacctatatttaaaaatagtaattttttgtctttctcatatacatacaccataaacaaatagatagagaaaagaaccaatatagttccccaatctctttgaagcaccaaaaatcccacaaaaatataagtaatagccaaagttatccacttcggagaaagttttcccagcacaggcttagaccatgctcccgagtaatagcacgctaagcacattatatacataattttagttatctctgagggctgaaaagtaataggtccaaatgatacccaattctttgagccgtttatagtagttcccaaaaccagggtgaacaaaaacaatcctacaccgattgcaaaataaatataccaaaatctgtcccatattttaatattataataaataaaataagctacaaaaaaagctgcgccgcctactagtatccaaatgatttgcctgaaaccgtaatcgaggtttatgcggcagagcaataataccccaatagacataagcataaacgccataagcattataaacttgtcccccatacggcatatcactaaaactgtatacatgacaagaaaaagaacaagaacggctatcccggtatataccacgttcatattataactttttgatatatacagcagtccgaatccgagtatatccaataaaatcaaaagataagccggctttctgtaattagccgatttaatacgttctgttcccattttctcaccgccaattcttaaaaatataatttatgtctcaaatataaaattcaagccgccgaccgtaatctgatcctcggtatcaagtataacctcctgccggattctctgcccgttaacatatgtgccgttccggctccctaaatcctcaagataccattcgccgtcttcataccaaataattaaatgcttctgagaaataaatttctcatttataattatatcacactcacggcttcggcctaaaattgcttctccataaatattatacctatgtttaagaggcgctgaaagttcaacctttgattttatcggtctcaggcttgaacacgccgcatcatttatactattgtcctcaaaccggctcatttttttgacatccagatagatcagcctgatgacaaaaataataaacacatatattataactgtaaaaacatagcttaatatcgtggaaataaaactatatatagtcatgttgcaatctcccttcagtcaaacctagtattcattccaataatcatcgtcgccgccggcgtcggccgcgttttcattaacaatcttatgctttttctccataaaccaaagaagaagcgcaaaaattaatccgacagcaaaacaccccaagtataaataaacaattggcggaggatcaaatctcattgttgcaagcggattataaaaagcggcgcttgatttatacccggattcccctgcgtcaaattttgccggcgcaacctcgcacatacgttcaaaaagtctatataaaaactcagcggcagaactccggtcaaatctattttcagtttttgtaagcgacattccgtcattaataataccttctcttgcaccaagagcaagttttcccaatgatgcttttttcatatactgaatatcaggataattcaaatatatacttgcatacggtctgtctgtatcattccctaaatcaggaagataatatcccttatagtcaacaagcaatgccaagctcattgtaaacgtgtcttcgagacccacagcggaattaccgttaaatctaaggccaccctggtcggaataaagctttatccccgcctcttctatagacgccacatacatagactgtgggtccgactcgtcaacgtcattatattgcgccctcgcttcagtatccaccgtaaacaatattccggaaaccgctctggcggcatcataattggtatattggtcatagggtctaaaacgcccgcctaccgtagcaaagtaatcttttgagaccaacagttttatatgcttctgctcatcttcacttaaatcaccaatgtcagaaatctcaggaacacttgctttcactttaaatagaccggaagtgtttgtcttaaactcaagagctttattactggagtcaaatattcctcctatattaaagtccctgccgtcgctggttgtaaacacgctgtcataagcgttttcagcggggatagaaaagttgactttagccggcagtttttctatcctctcattattttgatcaaaaaagtttattatatatccgccgccgattgcggaacccatttcaacagtaaattcaccattatcatcaattatcctattacaagttgctttgtccatgataacactgtgactgttatcgcctataagtatacgcatgttagatattcccaaatcatcatcttttaaatcactgtcaaaaataatttttggaggcaaagcgtcatttaattcttttataactatctgtataggaacaacaatatttttgttaggtttgatatccttttctcctgcaattttccataattcctgactggttgcagcagctgcaacagccgagtctctgatattagtcaaattaatatttacggtattattctcagctttaagctcaattttagaatttctcagacaagccgctgatatatacgccgcaatatcgtttacacccggaccattcggagaattttctccaagtcctgcgagaatttctgttaaataatcgccatactcttttatggttgtaaacccgccggtacgctcatagtcaatatttatattagacaaagcctccgaacccttatcggcagcgtctaaaaatcccattttaatgtatttatcatcaattgccgaaacagtaccgagctccgttgcaacatatcctgagctagtatcagcagttttcagttttgcataatataatgaaccattgtgcataccttcagctgattccaaatattccggaatataatgtactaaaaacgttccgtctttcaacttaacaaagtactgtattttacagctttccggagatcttgtccacatagttccgctcgggtcctgctgcggcggatgatagtttccgtctgtatggtctatgtaataatcatcagccacactgcgcaccgcgtcaggagtatctgacaccgcaaaagtattcttaacgcagagccgaagagttgatggagtaaccgttttagtatttccgtctataggagcgttagggttttgcctgtcgcgcttgctgtaagccaaaaactgccaccaaattatctcagacatctttttagtccatttaccaggatccaatacaattttgccgccgttctctccctcaaaatctgttgtataacacgcgccgaacctacaaagataatcactaagagaatttctctgctcattgcttaatgaatgcgttatatcagtataatcttctgtcgcctcatcagcaaatgccggtacctgaaccgtcacacaagagaagacaactgcagtcagtatcagataatatataaattttctaatcatgtttttattccctcatcctagaatactttattacaaaacataaaaaactaattacaccaaatatttataacgcatagttttttaatcaactgttataaattaaaatcttcttacacaaaacaaaaataattattgtgcaattataaaaacactattgcttttactgcattaaaaaatatatttttacaagagtatatccctatatttaaaaaattaatatggtacattaatcttaaaaacaaaaagagtatacagcactaggataattataccacattttttataaaattcaacaacagtttaattttttgtataagttttcagaaacaatatttttctaaattcgaacttatacgtttttataaacttttaaggcccctcaatatccaccgtggtattctcaaagttaaaaatttaagctttcattaattagaatcatgagcggcttaaaattatttacaaaaaccgtttaaagtcaataccagaattcatacagaccctaaaatgagaaactgaccttcctaaataatttactaagtataactttttatgactttaagcaaccggtcacgtataattaccttttttatctacttatttctgttgtcagttaacggatctaagaatatctaatctgtccagccagtttatattctcctaactggtttttgatgtagtcaaatattaacttctatcacttcatactgtatctacataatattctatacatctaacatgtctactaacatatttgtaatttaaattttcatgttcatataatatcactaatgagctctttttcctttagatattacataaactatatcatagtcaaatttgtgaatgttcatcagcatataaaaatgattggaatatgtctatgcttctatgtttctatgtttctatgtttctatgcttctatgtttctatgcttgctaaaccttcttcaacgttccgcctgtaaccttctttaacttaccatagatttatttggagctattttttagcacaatgctattaaatatttgcatctattttttaaaatgaactatggttttaacttctatcaattttttcttttttattttgaactttcttaatactctttcattgtgtttttttatatctttactgattatgctattgtgaatttctagtttttgccaaaacttttatccacatataactaacggaattccaacgctttaaagcgctaaacaaaaatatccggcggaataccgccggatataagtttaaacaaattttataaatacatcaatattcaataatcttattcagctgtatttgatgtacgaactcttgaaagcaacgctgctgattccgcccttgtagcagtcgcctgtggtctgaacattccactgtcgtcacctgtaagataacctgcctctgtcaaacctgttacatatcctaaagcataatccgcaatggtatctgcatcagtatattcagaagcagtttcagatataagattgagctttcttcctatgattgttgccatttgttcacgtgtaactgtttcatccggtgagaatgttgtttcgcttgtacctgttactatacctgcctcagcagccgcagcaacatattcagcataccattcatctgccggaacatctgtaaacgctgattcagtactcgaagactctatttcaaataacgaaactgccattttagtaaattcagcacgtgtaacattattctcaggataaaaattgccgtctttatccccatttactatattattagcatacaaatccataatatagctgtaagcccagtagccttcggttacatccccaaatatctgacctgaaggtgacgctgtaggagcaacagttacttcaggtgttgaagtaggcacaggactttctgatactgccggagttgctgttggagtcgatgttggatcagtactattatttgtatttcctgatggtttagatgttggcttagcagttggagcctctgttggctctgccgttggattaggcgttggcacaatatcgcttactacgctaatttgaattgttggaagagacgcttcaagattgttcagttcactatctacaccattaaatttttcaatctttattgtttgtgttccatattcatccttgtcttttactctaaaaaagatttttgcaacagtattagaggtgttttctccttctgcataaacagtggttcctaatgttccaaaaacaaaatgtcttgtagtttcattatagcccgataattcttcccaatcgcttgaattgttaccaagttcgtctatgcttgtataaaaatttacatcactatattcaaatatatttgaattaaatgataagtcaaatccaattattcccgaatgaaacgactcatttgatgataaattaacgtccacctcaaacgtatctccgggctgtacagtatctgtcgatgatatcatatttatagttatagatttatcagaattgtcagcaaatacgggaataacaactaaattaaaaatcataactatagaaacaaatatagataattttttcatgcttctcataagtggttctcctctcgcagttaaattaattgtatatagcaaaatagcaaaattttaaaaaggagacccgaggttcgggtctcccttatagctaacttaacctcaaattacttagaaggtgttgcagtagcttccggtgctgctgttgctgtagccactggctcagcactggcagtagcttccggctctgcgctagcagttgcttccggagcagctgttttctctggtgctgctgtctcttcaggagttgacattgttgcctttactcttgaaagaagtgcagcggcttcagaacgtgctgctgaagcagccggtctaaatgtaccgtcttcttcaccggttaacagacccttttctgttaaaccagatacatacggaactgcataatctgaaatagctgcagaatctgtatacttcatagctgctttagatgttatatcaagataacgtccgattattgctgccatctgctcacgtgttacatcatcattcggagcaaactctgtttcagatatacctgtaacgattccagcttctgttgctgctactacatacttagcgtaccattcatttgcaggaacatcagtgaactgagattcagttgatttagaatcaagtccgaagagtacaactgccatcttagtaaattcagcacgtgttacattgttctcaggatagaacattgtagcagaagcaccgtttacgatacctgcatcatagagatccatgatgtagctgtaagcccagtatgttgacggaacatcttcaaatacctgcttacctggctctgttgtaggtgttggagcctttgtcggagccggtgttgctgtagctttacctgtattgcctgtgtctggaccgctaggaccgctgcttgagcccttcttagatgtcttagcaaactcatatgttacaactgctgtcttaccatcagcgctaactgtgatactgtcagcatcataagaatttactgttgcaactgcatctgcgctaattgtgcagttttcatcagctgtagcggtaaatgtaattgtataaactgtattataagcatatcttgactctacagccggattccaagaaacgtcgctaagtttataacgtgcgccttcaggtgcagtgatatcataagataccgctctatttgaagccggggcagttatagaaccagcaattgttgttatagtagccggatcagcagaaggtgtcggcactgaacctccgaatactacatcaactgaagcattctgctcaggcattacaaacttactgtctgatactggaatatctgtaccgtctgcagctttaacagttactactgctgttgcaccagcgatattagatactgcattaattgttactgtatcaccggcaggaatgatgtactgagcgcctgctgtatcagcagcaacacttgcagcttttactgctggtgtgtaaactaatttagctaaagcgacattgccgtcacaagaaatcttaacttcgctgtttgcaactacaggtacagtctgaacaacaaacttcttatctgtaccaatagtttccacgatagtcttctcgctaccttgttcaactattaagttacgaatatcagtattaggtttatcaggactaccatgttttacatatactgttatagcaccatctgctgacggtgtgtaagttaagtatctagccgcagcagtagtcttaccgccaaacttaagagcgccagttacagtctcagttgtgccattctctaaagtaaattctgtgtcagtttttctatcaacttcaaatgcatccttatactctatcttattctcatcaattgttccatttgaataggacattagactattgcctaaatccacattacctacataccactctttttcagcgccacctttattaacaagctttgttcctgcaggagcatcagcgaatgtccattctactgatttaccaggaacaggtgcttctgtaacaattggtttttctgtcggaacaggtgcatctgtaactactggtttgtcagtaacaaccggtgcgtctgtaacgataggtgcatctgttggaacaggagcttctgttgccggggcaactgtcggataaacctctccgcttgcatttgtaagagtacctgtaccatttgttacattcaaagtagcaatatagttttcaaccggtgcagttgtagctgttggaacaggaacagctgtagctgttggaactactgctccgccaatagtaacacttgtagaattcattgttgccccaaccttatccaagttagcgtcaacaccattgaatgttgtcaaattaatagcctgagcgccgtcaggtgcattatctttaaccttcaaagtaacaacagctatcggctgatgttttgcatggtcagctgtatatacagttgttccaagcgttccaaatacaaaatgatttgttgaagcattaaagcctgagtttgcttcccaatctgatgtttggttacccaaatcatcttcataataagcaaatttaacaccttgatattcaaatacatttgtatcaaatactaaatcaaatccgattatacctgatttaaatgcctttgcagaagtcatatcaactgtcatatcaactgttccaccttgtgcaacattttctgcagatggtgtaacatcaatcttaacagtctgtgccggtgctttacctatctcaacttttgcagaatttaaagtgcttgaaaccaaatccaagttactgtcagctccgttaaaagtctcaatagatatattctgaactccgtctttagcagtatcttttacttttaaagtaactttagccagtgactgacgttttgcattgtcagctgtgtatactgttgtgccgagagttccaaacacaaatttatttgttgaagtattaaaacctgagtttgcttcccaatctgatgccttattaccaagatcatcatcatagtatgtaaactcaacattttgatattcaaatacatctgtatcgaataccaaattaaatccgattatacctgatttaaatgcctttgcagttgtcaaatcaacagtgacatctacagttccgccttgttctacaaactctgcagatggtgttgcgcttacaactactgaattatcatattctgcagcgaaaactgaaccaaatgacataaggctgagaaccatggctaccacaacagtaattgctgtgatctttcgtaaatttctcattaattaaaactccttccatgaaaataacatatttcaagtagtattgtataactgactctcgacagattgccgggagtcagttattaaataaatttctcttattgttctacggggaaatttgtgatttttccagcagcgtattgcattataaggattgcatcccctgcattgataccatcggtaccactaacatcagcagcagtcttctgatcatcgctgagctctgttttaccagctgcatactgcataacaagtattgcgtcacctgcattaatatcagtatccatatttacatcaccatacacaactccaggagctgtttttaatgaatatgacttagcgtcaggtgttgaaacaccggttcctccgatttttacaataataattgaatcatcattgtagtcagtctgtgacagcttaaatgaatatgtaccagaagcctgaccgtcatactggttgatataacctacaggtgttgtagatgtaaaaccaactgtattgttctgatcgcctgtgatacttgtgatatcatatacaaagaatgtcatctgacttggtacctctgtaccggaagcaattgtaaacggaacgtttacattatagtatccgttagcatcgtcttttgaagctgaaattttacctatctcaactactgaaccagtgtcaacgtcatcaatcttagattcaagattaacatcgccttctgtaaccggcgctgtgtcaagcggtatgtttacttcttctgaatctacaggagcttctgtaggaacaggagcatctgtatcctcagcaggagccttaacgtcttcttcaggtgcttccacatcttcaggcatagctgtaggctttggagcttcaactgtatctgtaacagatgcgtctgcattattgtcaacaacatctccctcagcgaaagctaaactagctgttgctgaaaacatcattaatgcagctgtaagagctgcgccaaacttaaaaattctcttcttcatttaattttcctcctaattttgtttgtttataaaatcgtcgatttcttcccaattaaatctgcaattttaaactacaatctcaaaattcgaggttatcctcctttccccaaaaatgtgtaagaaatgcggatcacagaacataacctttaagtcttaggcaaacacccaaaacaaccggaaatgtgcatccggctaataggttcaaactgataaataacgcattttatttatttttcactattatgatacgttagtattatacaacgaatgttcaaaaaaatcaacccctttttaaaaaataataaaagtttttctgaaaatacaaaagtaattgactttttatgtaaatcgtatataattgtgcttatgaagaatacaaagaaacataaaataataaaatacatgacatatatattgttaatagttatcataataactatgttttcaggctgctcggcccagtatcaaaccatatctgacacccaatttatattagataccgtatgtaccataaccgccggcggtgtgaaaaatacaaaagaattgatttcaggcgcctttgatgtcgtatataaaattcaaagcaatataagctattatgattccggctctaccgtctccatatttaacagttcgcctgctggtgttcctgcagcgcttgatccggacacatatactattgtagaaaaggctcttgaagtttccaaagcttcgaacggagcctttgatataacaattgctccggttgaggaactatgggatttcaaatcagaaagtccggttcctcctgaacagaatttgataaatgaaaatttaaaatatgtcgggtataacaacttgatacttgattctgaaaacaaaactcttactaaaaccattgacggtgtaaaaattgatttgggcggatgcggcaaaggttacgcttgtcaaaaagctttggaatatatagaagaaaactatcccgattcatacgctatactggattttggcggtaacgtaagcgtttacggtcaaaatcccaaaaaaataaacggaagttttacggttggaatccaggaaccttttgcggcaaacggaacttattctgaaatggttgatataacttccggggagagtatagttacaagcggcacatatcaaaggcacttttattataacaacaaaaactatcatcatattctcgacccatcgaccggaacgccttctgacagcggttttgacagtgtcagtgttatttcttcatcatcacttgaagcggactgtttgtctaccgcctgtctggttctcggagaaactgacggcacgaagcttgcaaataaatttaacgcaaaaacgtattggataaaacaaaggagcaattaatattaatgaaaataattaaaaatgccaacctaataaccatgagtgaaaaatatggcaatatagaaaacggatatgttaaaattcaagaccataaaattatagaagttggaaaaatgtctgacttttcagatagcaatattgatgccgagataattgaagccgaggggagaattacaactcccggtttggttgacgcacactcacacctgggaatgtgggaggacggtttggattttgagggtgatgacgggaacgaagataccgatccctgtactcctcagctccgggcgatagacgctataaatccaatggaggcgtcttttagagaagcttttgcttccggtataacgactgttataaccggcccgggaagcgctaatcctatcggcggacagctggcggcaatcaaaacatacgggaagcgtatagatgatatgataataaaagctcctgttgggataaaaattgcttttggtgaaaacccaaaggctacctataacgacaagagccagtcgcccagtaccagaatggcaacagcagcattgataagggagacgtttaaaaaagctcaggaataccaaaggcaggttgagcagtaccaaaataactctgatgaggaagaccctcccgaatatgacataaagtcagaatcgctgttaccgcttttaaatggtgatatacccctgcatgcgcatgtgcacagagcggatgatatattcacggccgttcgaattgccagagaatttaatcttaatttgatattggtacactgcacagaagggcatttaatagctgagcagctggcagatgatggttacccggttctgctgggcccaatactcactgaccgaagtaagccggaactgaaaaatcaaagtgaaataactcctgccgtattatcagaggctggactgaaaatctcaataataactgatcaccccgaaacgcctgaaaagtatttaaccctatgcgcggctatggctgtcaagcatgggcttagaagggatgaagcattaagggcaataactataaatccagctgtttcctgcgggattggagacagagttggttctatagatgacggaaaggattcggatattgttatatgggacggtgatccgctcgacataatgggcagtccgtatgggatagttatataaaacatgccgttttatcgcaataatataggttttgctccgcatataatttttgcggagcttttttattttgtttataataacacatattatgatgataaatttttatctatatttaatattttattttaagaactaagtgttatttttttatttatgcctaaacgattttaaatactctgtaatatatttgatttatagaaaataatattacaaaatctaaggctgcggacaatattatccgcagcctttaagcataattttatcatttatcagttcttaaatagtcgtttatttcattgacaaaaagttccccatacctttgaagcttcgcgcttcctacacctgatactgtctcgaactcatccaaagtctttggaagtatcctgcacatatcacggagcgatgcatctgaaaatataacataagccggaacgctgcctcgctcagccagctcttttctgagatccctcagctttgagaacagaccctcgttaactgtttcagcctgcaccggcttcttcttagcctttttctccttcggtgctttcatcgaaagccgatctccgccaaataatatgctttttgacttctcagtcggtactaaaatattaaaattatcctcgtcttttattatataaccgctctgaaccaaaaattcaattatattcataactctggtcttggtcataccggacattattccatacgtagttaactcgtctaaatgcctggaaataacattatcgttttttgaaccgcacaaaacatcagccaccatgtttttgccgaaagcgcgtccttgacgttttatcctatatatacagcttagaatcttctgcgcttcctcggttatatccactgtttcaaacctagtgttgcagtttgagcagctgtcacagcatatcggcgctgtctcaccgaaatactttaaaataaaacctctgagacaatcatatgtagtgcaataaaacgtcatatgcttcagcagttctaaatccttttttataacctgccggcgcatttcctctgtcatttctaaattttcgtttccgttttctatcagaaacttattgattctgacgtctttcggggcgtaaagcaatacgcactcagccggttcgccgtctcttcctgcccttccggcttcctggtaataactttcaatattcttcggcatattatagtgaacaacatatgaaacgttggacttgtctattcccataccgaacgcattagtggcaaccataactgtttttctgtcatatataaagtcgtcctgatttatgcgcctttcctcatcatccaaacctgcgtgatacctggtagccgcaaaacctctggagatcagttcgtcacatacttcctcaacgccttttctgcttatgcaataaactattccgcttttttccttattctgcggacggttgagtatatccaccaaagcattaagcttatactttggattctgaacctcaaaatataaattttttctgtcaaatccggtaaccatcctaaacgggttatcgagttttagaatattgcagatatccacgcttacccttttagtagccgtcgccgtaaaagcggaaaccacaggcctatacgacaaagtatcgataaactctgaaatttttaaataacttggtctgaaatcctgaccccactgggacacgcaatgagcctcgtcgacggttaccatagatatttttgagttttctgcaaaatccaaaaaatcatcagtcacaagccgctcgggggcaacataaattattttatactgcatctccgccgctctcttaaacacctcacacagctggcggtaacttaaagagctattaatatatgcagaaggtatacccgattccgtaagagaccttacctggtctttcataagggatataagcggagaaataacaatggttattccgtccatcaacatagccggaacctgataacaaaccgattttcccgctcctgtcggcattattcccagcacatcttttccggacagtatattgtcaataatatcttcctgtccgctcctgaacttctcatgtccaaaatattgttttaaaacttcaagttttgtcatatctttctccgccgttattttatactttcgataaactcagccaaaattccctcttttaatccggcagaggatactatcacttcctcagagcctattttgtttataagctccacaatcggcagcactccggcaattatagtgtctgttctagaagcttctatcccggcgtcgcctctttcagtttcattcatttcaaggatattgccgaacgcatcagcgacgcagtcgcctgccattacacagccgtgaagctggcttctgtctgctcccggaacattattttcaactatcgcaagattatatatgctgccgcccattccaactatcggaagctgataagcgtcctccagccagtgtattttgtcaagctggctgtcaatataatcagtcagcgcactaagcgcctcctcagtttctcctctaaacaaaaactgttcagtcatgtttacggctccgacaggtatacttgttcttgccagcggctctccgtcatttaccaatattatctcggtgcttccgccgcctgtgtctactattacacagtcctctatatcaagcgaactggtcacgccaagaaaatcatattcggcctcctgctcgccttttatcactctcacgattattccggtctcatcctcaacctgttttatgaactcctggctgttgcccgctttcctgactgctgctgtcgccacagtgataacgtcatcagtattattttctttcataatttttttgaactcactaagcgccgcgatagtcctgtctatagcttcgggctggagattcccgtccatgttcataccctcgctcagccgcgccatatcacggcacctctctatatatctatgagatccggttttttcatcaatttcaactatatccattctgatagaattggagcccaaatctattatcgctaaaaccatttttatccgccttcctatgccaatatcaaattcaatagctatcttgtccatcacaaaaatttcagcggcggcttatgccgcagctgaaatattaaacattcgccgccggctagacacccggcagacattatatcattattctaacacaagtgtaaggaataatacttcttcctctcctctatactcaacagttccctgtccgcaaatattgttaacatatgcttcctccgcattctcggctgttttaacagaatgcggaccgcttgttaaagttaattttattattccatcttcattggatgtaaactctccaaaagcttctccgtctacataaaccgtaacggtcttatcagtcaaaaggtttccgtttatatctttaagatataggctggcggtataatccttagccgtatatccgctcatttcaactatacgcccttctgtgttgtctacctcaagcggttttactccattatcagtaagcttcaatatataatcgcagactatctgctcaacatcggttccctgcattatctcaggcaggccaggcaccatatcataatcgtttccgcccattgccacaaaatcatttgttgcaagcagaatcttcgtttcgaaatcagtcctgtcaagcggttctgtttgaccgcctaatgttacagaaataaccttttcgccctctttgcctgacgggtcatactttacgctcattccgcctatctgcaaaaaacctccgtctggataaaggtcaagcagtcccgtctcctcgtcctgggcggttgcatttttaacgcttctctccataactgaatataaaatgtttggcgttatttccttaacaaacagcgtgtttccgaaaggcagaacattaaatatactgccaaccgttatatcgccgttcttaacagaagcgcgaacccctccgccattttgaacgctgacaatcggcaggccgctgtattcggcgcttatattatttttaacctcgtctatcattgcgtcgcatataagatttcccaaatttgtctcaaccgcacgcggcacagcaaaattatttacataaccgccccagagagtggtctttgtctcggcaattttattgtcaagcagtttcgactgctcagccgttaccttttctaaatattcagtaacctcagggtcaggagtgacttttgctttaacctcagcactgctgagcatattttctttaactcctattacctctccgtcctttaccgaaactgacataatacctatgttctctgaatatgagcctgtctgagcaattaatacgccgttttcagtattattatacacagtatggctgtgaccgtctatgaccgcgtcaagacctgacgtatccaaaagcccgtctacaatagccggagtagtgacggatgacgcttgagaaacaccgacatggaacaagcctataaccacatctgctccctggttttgaagctcctcaacctgtctttttgcggtctctgtctcatcttcaaaagaaatgcccaagatgcccgatggttttgttgaagacgctgtatctgacgttaatatgccaaaaaatccgactttcactccgtctatttctataattgtattttctccattattctcttttgttccatcggcataactgcctttaaaaaacggatgaccgtcttttagggtgttcgccgatataatcgggaaatcagcggctgccgcatttttctttgctgtctcctgtccgtagtcaaactcatggtttccgcacgccatcacatcataaccggctaaattcatagcctcaatggcgctcgcccccttatccagcgagacaaaagctattccctgagtagcgtcccctgcgtctgccaaaacagcattatccgtctgcttcttcagagcagatatttcatccattccaatcacagatttatcgcccacgtcatagccgtgaatatcatttgtatgaataatatttatggtcaaagaatccgcattcaggtattccgccaaacgcatagccacagcggcaagctcagagcgggtcatatatcccgacgggtcaaaggtttggttctccttgcccgacataatattgttcaccgagcaccaagctactgctgtataacactcagaagaaatattctccgcgtcagaataggctactgcaatatcctcagtattagcagaacctccggccgcatacacaagaaccgccatatcctccctttcaaccggctcagaccatatataactgtcaaagtcaacagagggcactaacctctgcagcacagtttttgccataacatcactgacaattccgtccggctggaattctgattcattcacaccattcatcaagccgttttgtatacaatactcaatgtacggataagcccagctgtccccgctcaaatcttcaaattgtgtatccgctgcaaaaacagaaactcctgccgccgcaaataccattataacggctgtcaaagcacacaacacacgctttaaacttctaaattgattattgttcatgaaaactcctccaatatatttatttaaaatcaaactctttatttaatctcccaaaaccgcgtcttttagaatctgcagacggtttggcacaccaaactcaggctgtatagtcatcgttacaaatctttcaagagttctggagcctgatgacaaaatcgccttcgcctgaatcgtctttgcatcctcaaagaatgccggagggtttatttgaccggaatttgttattacactctttctgaatcccagtatatttcccaatgaataattatcattaaaatcccactttattgttactctctctccgttttcagctatatagctgctcggcaaatcgctcgtgacattatcaaatgaactgttgtttccctttaactccataatagcctcacgaattgcagtcatatttttatcgtctgttacagatactgaaaggcttggggcaaactcatgagagtatgacgaatagagttccagactgtctgttgaagccgggtcggtttgtgttccgtctatcaaaaagctggcagtatatttgcctgatttgaccagcttataaactaaatccgttacatccacgctgaaaccccctgaaacttcaagtccgttataggacttaatcagggacagttcaccttccggacggttattgtaagataattctccactgttccagccgtcattttccaaataatatatatcgatttttgtattcacagatttaccgataggcctgagaaaaatccgcgcgtcctcaacagcgccgagaatatttttaggttcgatattaaattttaagtatacggccgaaccattgtcaaccgcaagccttccgttatttttataaagcagctcgtttgagtttgtatttggttccgcctttgatacataaccgttggtatccaaataacttttgtttaacgtcttggtatcagtatccacagcgtcacccaccaatatttttaaatacggccggtatgacgggtcagagtatcttgttgaggctatttgaaccggcgcagtattgctcacgctcggactaagctttaacgtaaaaactttttcatcattgccaacagcctttcttataaactctgacaaatcaatttcaagtatgctgtccgaaccattgcccgcagctgtgcaaagatattgttcctcaccgcccggtttggttgaccaggtcatgttatctccccagttattattatcaaggtagctgacgttaaacgaacagtctgtttcatccggttcatttctcccgtcccaggttaccgcaagtctcagttttgcttgacttatatcgctcttttttgcgtttccgattgccgacaagtcgaaccggaaataagtgttccagtaattaccgaccagcaggttatcctcatccagtctggatttgttcttatttttggcgtcactgtatacaaaggtctcagcgcccggcgaaattttaaccactcgtccctcagcaactaccggcgttgtaaagtagagaaggccgacaggaactatacccaaaaccaataaaacagccagggcacagccgataatctttctgatgattccaacctgcaacagttccaccgtcctttcagacagatatttactaaattatagcataaataagttcattgggcaagtacaatacaggctttgattttaaaaatataatataatctgcagcatgtataaaaaggtcggtttgtgatatttttgtaggtttgtcaatgatgtgttacaaaaaagattaaaagagttcaccgaaattgataaaagagttgatgtagtcaattggagctttccaattaatgcgccgccgtaatcccaatgctggacttgttgtgttttgggttaagcttcgtcaaagaggctatactcgttctattacaggtctttaccgcatattccgcaaacagggacaaatgcctgttaaaccacccaatcccaaatacataccaaagccttacgagcaaatgctctatcccggtcagagagtacagacgtttgcacatcacaactaagtttgattgttgacattgtaggtttattaatacaaagtgatttgtatcacacacactttaaaaaagtgtggtcatagccctccgaagcttgctaaatcacattttttataagaaatttttaggaattaatatcttcaaaacagtattttttggttaacatcggtagggtgtgcgtaagcacaccgcgttaggtgagcaaccatctcacacgaagcgtgtgcgagtttcttaccttgtgcaattgtcgtaataagtacatctaaatgtatctttattaccgctttttcactatttatttttcaaacatctgcttagctctcaaacaaatctctttgtcagaaaacttcatcgctgcaccgcagcaactttattagtataccatgtttgtttttacttgtcaagaccctgtcaccttgctcgtcagaacgcttccatacgcattatacgtatttactgtttcatttccatttttgtccgtttgtttggtcggcagtcccatcaggttatattcacttattatatcttgttacgcataaaaaactgaaacagagttatatgtatttcttaactacttaaaaaggaagtatttaatggatttttattttaaatagttaattatttttatatattcaaaaactttccggtgttttttactccgtttcaattttttatgcgtactcttgtccaacttttttgttttaccggagggcgtaaatgatttacgccctcaaaatttactatatgggaaacaagctgaacaccaaaacaccgaaagccaaaagcgaaggaaaaggttatacatacagaacagagtacggaaccaaagacggcggaacgtatgtgacaacaacggatatagacaataattctaccagagtggaaaagaacatgctgggtcaggaagtaaagacaatagatccaaagaaaaatgagagttcggcaaagtatgacgacttattgacaagaagggtaagaatatgataagataataaagctttcggctgaggcaagaaaagctgaaagatagaatactgtgagagtaaaaaaggaaccggagaagacaaaaaggccggttaaaacttagagagataaaagaacagaaaaaaataaaaaagttcaaaaaaagtcttgacaagtaaaaacaaacatggtatactaataaagttgctgcggtgcagcgatgaagttttctgacaaagagatttgtttgagagctaagctgtatgtgatattatggtgatataactataacacaatttatgagttttccgtattctttttttctctttgtaacacatctattgtaatcctacaagctcaaaaataaaaagaaaattttttcttgacatagcctatttattttgttataataaataagctatgcgggtatggcggaattggcagacgcgctagatttaggttctagtgtcagcagacgtgaaggttcaagtccttttacccgcaccaaaaaaacggcaagacttaatgagtcttgccgtttttattttctttatgatattacttcaaaatgtatctgcgggacttcaccatgaacatcgataaacacttccagcactttatccatatagttctgcaaatctttaggcattgtttcaatccctgttatctttacagctatcggtgggcactctgcgtaatctcttaaaagatcacacaatgcatccaattcctttcaaaccagtcaggaaagccaaagctttcctgaattatatcatataattttataatatacttacccctgtaaaatcaaatattatttcctgcatatctagctctgttggcattcccgcctttattgcatataagtaatgataataagatatgtcacccataatgtgttaatggaattttatgctgtatcatttgtatgcaatactatttttataatatccgcactgtaattaaaggcaatctccatgtataacattgtcaacctgaatcaagtctattcttgtgaaatgataatacatatatttggttagagtaaaattttttgtgtctgacataagaatgtagtaaatatctgaatcaatagaaaccttaagatattttgtatttcttattagaacatctgattcaagaatagtaactattacattagaatcactttttgtgtgctcaaaattacccaatagttccattttacaatcatataccttcccttcctcaataaaatcgaaattattataacttacaacagcagaatcatcaaaacataaatttattgtatttgtattaaggttttgtagttcaatatctcgagtagctgcataattgcgaattttaattattttatacacatatttttcctcctattttttaattggttaaaatgaggcgattgtttaaaggataaaatattatgaacaaatcttatagttaataggttttttataaaaagaaattatgaataatagtaagtaaaattaatttatgcatatttttaacagaactcagaactccaatatttaattggagttctgtcccagtttttaatatcttttaaatgtaattttaatatttccattatcagactttgtccactttgcgaaaacgtaagagtttgcaaagtcaatatctaatgttccttttttgcgtgctgatatgaatttctcactttcgtatggattaataagccatccgctcaaatcttctacatcccaaccagtgtccgaatctataaaactattaccttcacccgaatctattaaaaatagctttcctattttttcagcctcttgcataacaaaatctaaaaatgggtcgttatttaacataatttaagtatctcctttcttaattaaggccatattttttctgcatctattattcttgggatatttataccttattttattatggttataaagtttccgtttaaatctgttacaacaacatctttatcttgtatataaaaatatacttgtcctgaggcatttgccccatttggcaatgttttaccttgaccacgccataaaccttgtcgaatttcagttttatgtataaagatttcatttattctgtttctaattaaatatctgctttcaggattacttggatttaaaccaaagtcttcagcatgttctccaactttttttccaaattgagaatctgaaatttttatgttcttaccaggaatgttgaattgggatacgtaaggttcatgagcaaaagcattttgtggttcagcaacagctatgtctcccatcattgaacttgtgtatggcagattcataaatgcgttgtatgacgcatttaatcctttcattaggctgtcctcaaactcagcttctgtttttgcaaacaccgtatttaagtaatgatacagaggtatattttcaaataattcgtcaatggaatcttctgctgtatcatttgtgtccgggttattttctgcctcataataatcaatgagcttgttgttcatttcttctgccaaagtgtaccttgaacttacttgcggcagtgtttcttccgcttatgcatttcttcaataaaatgcgatacggcagattttcttgctttgtctcccaactcatcatagttggaaaacattgcgtaagcaagagctatacccttttcaacatagtcattttctgccttcatagaatatggcgctgacgatagtgtcagcattttctcgaatatctcagaagtatcaaacaagtcattctgtgattcaaaagaaaaatcagtgtatttctcaagcatagagaaaattgcagataaatcaatggtcagacttcctcctgcagctataatttccgcacaccgccagccatattttgcgttagggtctttgattggacgcccgcagcagtcacagcgattattactcaatctttttcactttctttcattataacattttttattatattttcaattcaaacaataactgttgaactgataataatatgttaaaatatgttaaacaaaagaagtgtcttaaagtgccattattttaacggacgtgtagttttgatgtaagaatgggggttaaatggaattttgaattacagaatatattaacctgtttttattgtatttgtttgttgtatgagtgtttccaaataatacttgaatgtggttagaatttaccagataaatatgtattttataaaatgttaataatatacggtttgtcattgtttctatttagtaattttaattaattattcgtcttaattccaaccaacttcataacccaagttttcagatataaaccggattggcagcattgttcggtcatttattgtagcgggcgcggtatcaagagtttttgcttcctcatttacaaatgcagttgtgctgtctattgtaagtattattatatctttgccgagagcgattaaaacattctgcgtatcttattcccaggctatagctctgcccatttcttctattaacgcacgtatcggtaccaatattctttcgttgattataaccggcgtagtgctgcgtccgggatcaatttctttttttacatcgtttactgtcattacaggttcaccaattttcattgtaagagtaaaaccggaagcggaaacattttgaggctctgccgcgctgcatgatgtcatacatagtgttgaaattataaatgttaaaattattaatgttatctttttcatttctatacctcttaactatattataatagatttttatatatcgtatgctgaaatcgtgattatcccggacaacttttcaatgtcatcctgtcctgaaacagattcaccgagctcaaacaaactgctgttttcgctgaagctgtcataaaacatcactacatcgccccatggttcaaaatatgccagcttgcctttgccgccgattgccattggcgtatctgtgatacttagtttctgaggcggatagaacactttatcgttgatgctgaaatcttcaacctcaattgtaagcggaagctgggcataaagttcttttgcggcttgactttcattgattttataaataatttcataatcgcccgaagatattttaatctgcatctcttaattttattattttctatctgcttagctgaatacagcagatttatttctttcatatcccataaaaacgcttttattaaatctgcgtcagatgatttatctgaaatatttttcgttattgtgccgttgccttcagtaaaatcaacattaatcaatacgttatctttatagaatgctaaaatcaatgttgaattgtcaggagtgttttttaccgttacaatatcattttctatggttacttccggaactgccgcaggagctgaagaaggcgccggtgtctgaactgtttcagtttttggccaatctattgtatccagccagttcttaatgcttgcttctgaatcactgccggataaacgcctgccttcaatccacgacgtattttcagcaagcgtgtgtaattcgctttcactttcgcttatgctgcttccgcccgatgtgcagaatggattaattgttttgtctgaaaaattgtagctttctagaaacgtgtatattatttttggcgcttttacatgccatatcggataaccgagaaatatagcgtcatatttatccaagtttttaatgtttcccgaaatagatggtcttgcattgctgtcgctctgctctatatttgctcttgaagaaatattgttgtagtttaggtcttccgatgaatatggctctgacggttcaatctcataaatatcagcgcccagtaaagaatcttccgcttatttttgccaatcagactttttgggtcaccaggatcttgagtggtttggagctgattattcatcaatgaatattgttgcaacatataattttatttataacgcaacatttatggttgaaaaaggtatatgctatgcgctttgcctcgcaaatcttgtaaacacggaaggaagcaggaatctgacatttcgtccgattattcctgaaatgtcaattgatttgtatattgtaacaaagaaatatgagacgttttctccggcggtaaaactttttattaataaggtaaaagagtataagttttaaaaataatattcagcaggctttagaggttgttttaattttataataattttgaataaaaatggtgcacaaatttttgtgcaccatagctttatacggtttttaaatataaatatttgagcggataaaaacaattctgtattttttaaaattttaaattatcatcttagacttttctcaaatatccaaatgtttaactcaatatttttttatttcctgtaatataaaatatatttaatgaaaaatgtaaaaaagttaggtaaaacacgtttttttattattccagcaattaatagaatgcttactttggattcagcagtaaggctcattgaatgttgggtttagattaataaatgcactcaaataatttataacttatctgagtagaaatctgcatatttgtgtaagtcatatgccgtatgaatatgttttgaacaattatggagtttcatttgtatatcaacagggagcgacaaaaaatatgacctgctgctggaacttaaattaataagctgatttagattttcatacatagcattcacctcaaagatagtttttacatatataaaaatcaatattcttatagagtcgattgacagattataaaaattaaatcagctaaaaactatattatatgttgtgatataagtcagaacgactgaacaattaaatataatgctggacatgttctgtttgttgagatgtaatgtataactgcactgtaaattaaacaggtaaatattataaataggtctatagatttttatgcttggaacaataatcaatatcttctcataaaatgtaaatagttaaaatttaattttttggaggtttaaatatgacggaccgaaaattaagcaatgttgctaaagcgtatttgtgtcgtttttacgagatattagaacaaatgactgagaatatgacagaggcggagttgacggatagcctttctcataattttattgttcaaatgattcctcatcatatggcggcaatagaaatgtctgaaaatctcttgcagtataccacctgcgttccgcttcagaatatagcgttaaatattatagatgaacaaacaaagagtattgataacatgaaaaacatactttgccaatgcggagaacaagataatacgcccttagatttgtgtttgtatcaagaaggctttagtcagataacctgtactatgtttactcagatgaaaaatgcttgctcaacaaataatatcaatgctgactttattcgtgagatgattccgcaccatgagggagcaatccgcatgtctcagaacgcgttgctttatgatatttgttcagaactcgttccgatacttgaagcaattattaaatctcagaaaaaaggtatttgtgaaatgaaaaaattgcttcggtcagtttgagtttgaaatatgcagaaagttttactgatattaatttaaaatctttgttattttcaagttgtccgctcaaatataataggaagtaaaaagaaatttaaaaatttatggcgataaaaatttataacatttacataaacaggagattttagcagataaatatttttttgaaaaaatttgtcctttttgttgacttgttgatgaattttgtatattatataagttaagaaatttttgttctctatagttttgaaattaactaataagcaaatctataaagagcaaaaagcgctttgatttatcgcgctccataacgaactgaaaaatcttctatttgctaaagtaaaagtaactgtttccagcgtatttttgctgtacagagtttttgcggcagccggtttttcggaaaatataataaaagaggagagaaataagatgaaaaaaagagacgatattcataaggtactgataataggttccgggcctattattatcggacaagcctgcgaatttgactattcgggaactcaggcgtgcaaggctttgaaaaatttgggttatgaaatagttttggtaaactcaaacccggcgacaataatgaccgatccgaccacggccgatgtcacttatatagaacctcttaatttggagcgtattacacagataatagaaaaggagcgtccggatgctttgctgcctaaccttggcggtcagtcaggactgaatttgtgttctgaacttgcggaagccggagtgcttgaaaagtataatgttgaggttatcggcgttcaggttgacgcgatagagcgcggtgaagacagaatagagtttaaaaagacaatggactcgctgggtatagaaatggctaaaagcgctgttgcttatacagttgacgaagcgttagctatagctgaggagttaggatatcctgttgttatacgtccggcttatactatgggaggagccggaggcggtcttgtttataatgttgacgagttaaagactgttgtgtcaagaggtcttcaggcctcattggtaggacaggttttggttgaggagtctattctcggctgggaagagcttgaacttgaggtagtccgcgattctgaaaacaatatgataaccgtatgtttcatagaaaatattgaccctctgggcgtgcatacaggggattcgttctgttcggctccaatgcttactatatccgaagaggttcaaaagcggcttcaggagcaggcgtataaaattgtagaaactatcgaagttataggcggaacaaacgtgcagtttgctcatgaccctgtgagcgatagaattgttgttattgagattaatcccagaacgtcgcgttcttcagcattggcgtcaaaggctaccggtttcccgatagcgcttgtgtctgctatgcttgccacagggcttactcttaaagatataccgtgcggaaagtatggaactcttgataaatatgttcctgacggtgattatattgtaattaaatttgcacgctgggcttttgagaagtttaaggatgttgaggataagctcgggactcaaatgagagccgtaggcgaggttatgtctatcggaaagacatataaggaagctttccaaaaagctatcagaagtcttgagacaggccgttacggcttaggatttgccaatgattttcatgataagaccaaagaagagctgctccaaatgctcgcatatccaacaagcgagcgccagtttattatgtatgaagcgcttagaaagggagcaactgttgaagaactttggagtttaactaaaataaaacattactttattgaacagatgaaagagcttgttgatgaagaagaagcgctcttaaaggaaaagggacatttaccgtcctccgaaatgctgacaaaggctaaaaaggacggtttttcagataagtatttaagcaaaattttggaagtaccggaagatgaaataagaaatgaaagaataaaaatcggggttgaagaggcttgggataaaatacatgtgagcggaacgccggacagcgcatattattattcgacttataacagtgaaaataacaatgaagtaactgagaacaaaaaaataatgatactcggcggaggacctaacagaataggtcagggtatagaattcgattactgctgtgtacatgcggcgctcgcccttaaagagctgggctttgagactataatagtaaactgtaatcctgaaactgtttctacagactatgatacgtcggataagctatattttgagcctttaacattggaagacgttctcagcatatacaagaaagagaagccaataggagttatcgcgcagtttggaggacagaccccgcttaacttggcggcagagcttgagaaaaacggcgtaaaaatattaggaacatcacctgaagttattgatttagcggaagacagggacaggttcagaaatataatggacaagctggaaattcctatgccggaagcaggtatggctgtaaatgtggatgaagctttagaggtcgctgaaaaaatcgggtacccggtaatggtgagaccgtcttatgtgcttggcggacgcggtatggaggttgtgcatgattctgacagtttggttggttatatgaatgccgctgttggagttacgcctgacagacctatacttatcgacagattcttaaatcacgctatggagtgtgaagctgacgcaatttctgacggaaaacacgcctttgttccggctgttatggaacatattgagcttgcgggagtgcattcaggagattcagcctgcatacttccatctctaaatataccggaagaaaacgtgaagacgataaatgaatatacaaagaagatagccgaggaaatgggcgtagtcggactgatgaatatgcagtacgctattgaggacggaaaagtttatgtgctggaggcgaacccgagagcgtccagaactgttccgctggtatcaaaagtgtgcaatataaatatggtcaaaatagctactcagataatgacggcagaacttaccggaaagccgtatccgctggacgagcttaaacatggaaagttttcgcattatggtgttaaagaagcagtgttcccgtggaatatgttccaggagtgtgatcctttgttaggtcctgaaatgaggtctacaggagaggttttaggtcttgccggaacgtttggagaagctttctataagtctcaggaagcaactcaaacgagactgccgcttgaaggaagagtgtttataagcgttaacgataaggataaaaaagaggtagtttctgttgcccaggatttccatgacgcagggtttgaaattatcgcaaccggcggaacttataatctaataaaagaagccgggattcctgctgagcgcattaataaactccatgaaggaagaccgaacgtgctggatgaaataactaacggtaaaatacaaatgataattaatactccggcaggtcagacaagtatccatgatgacagttatatcagaaaggccgcaatcaaaggaaagatttcatatatgacaacaatggcagcggcaaaagcggcttcaagcggtataaaagaagtaaagaataaaaaagttatagaggttaaatcgcttcagcagcttcattcggaaataaaataagaagctaatcgctttatttgagttttctgtcaaattatagtgttgtattgagagaaaatcaaaatttaactttaaacgccttgccgcttattaaacggcaaggcgctttttatataaattgcaaagctgtgactcttaactgttcggtttatatgagtatattacgtcggataagcattaatacggactttattgacggtttagtctgtattaagcggattaaactaaataaattttatctaattcccgccgatattataaagctttgtgttgaaaacttctgaaataaaaataagtgataagcgaaaactatgattttctccgtgattaaaacttattacacaatagttgagagtcattataagatgaaatttcactattatataaataaaatattatataactggcttttatatttaatgtaaaacagaaatattcggctgattcataagctgcagttttttgtttttgatttttatatagctaaactaagtttaaaagtaatcaaataacaaattttgttgaattttataatttatgtatgtttatagatgttttataagtgatttgctataaaatattgactttgccaccaaaagatgttacaataactacaagttgtatatcttatttttctaaaataaaaaatatttatgggaggtatgagagaacatgagaaagttaagaagcggaatatcagcaatactagttattgctatgattatgaccacgcttggaatggccactgtcgtatcggctgctgagtaccaggatacacagggacactgggcggagagttatattaataagtggtcagataacggcgtaatacaaggcgacggcggatatttcagaccggacgatgcgattacccgtggtgaagttgcacaggtaacccagaatttaataggatacgtaaataaggcaacaaacacatttacggatgttgcggcaagcgactggtattcagatgcaatactcagattggttgaggcaggcgttctgacaggaaacggtgacggaacaatgtctccgaataattatatgacgcgtgaagaagctatgactatgctggctcgtgcgtttggacttcaggtgcagaactcaaatgccggaataactcaatatgcagactatcaaaatatttctgattttgcaaccggttatgttggcgttatgacatcatcaggttatataggcggttatgaagacggtacaatccgtcctaaagactatatatcaagagccgagtttgtaaagataatagacaatatgataaagctgtatataacagaggcaggaacatatggccctgagtatgtaggcggattgataattataaagaccggcggagtcactttgagcggtattgttgctaaaggtgttgtagtgtccggtcaggcaagcggagacgttacaattacaggttcacagatttcgggaaatgtagttaatttatccgcaaatgcaaatgttaaatcaaatactgataatgttgttaatcctaacgatgaaacaaagccgaataacacaattataggcggcaacggcggaagcggaagcggcagtaacggctcgccgacaagcacagtaactgtaaagttctataacggatcttcattatataagtcagtttcagtaacaaaaaatacatatctgtcgtcagccaagagaccggctgacccgacaatggacggcaaagaattcgtaggctggtatttgtcaaaggaacaggcagataaggcggatactatttctccgtttaattttgacactacaaagataacaaaagcaatgagcttctatgccggatatattgagtcgactaagccgacttcaactccggcagcaacaggttcgccggctccgacagccgatccgtcaaaaccaacggcaacagctgcacctgtaccatcggcaacggctgcacctgtaccgacagctacagctttgcctgtaccaacagctacaactgcacctgtaccgacggcaacaagcgaagctgtacctacagcaacgccaactcagaatccggatgttacatattcagtaaaagtagctgagggtattacaggcggtactttgaagatagttaaacaggcagagccttcaaaaccaacagcagaaccttctaaacctacagtggaaccaacagagccaacagacgcgccggctacagcaacgcctgaaacccctgtgacaggagcaacagattttgcagttaaaggtgatacgccgtctgcggcaggttcggtatataccaatgatgataatatcagcgttaccggaacttttggaacaacaatagttgaatatactgaaaataacgagcctgctactaaaatgataggcggaaagccgtttactcataatatgcaagtccgtttggcggcaaatccttcagagcctttacaggagcaaagcggaagcactgcgctgataatagcgcctaaaaaagacggaaagtttacaatctattatagaagacaggtaacaaacggcgatcctgacgttatgagcgcaggtgatggcaaggatatcaagctttcacagaacgataacggttcatatagccaggtaagcggcgttatggaaatgcctgaaataaatgatgaaaagacctacgcatttggaacgcagacctttgatttaagtgcaggcagtgaatatttgctgtgggcaagaggaacaacaggcacactgtatggatattcatatgaaccgtcagcatcagcagcggcagcagaagtttcagctgcagaaacagaagaattggttgacagtcttgatggattaaaggcaggagataaagtaactgttaaagcggttgcagaatctgcagcagaaagtataaaggtgtttacatctcctgagacgacagttacagaagtatcaggaaatccgggttattacacctttgaaatgcctgcgtcagacacaatagtaaatgcacaattcggtgaagctgctgctacagcaacgccaaaacctgaacctgtaagccataaagcagttttgaatgtagaaggcggaacaggaacattagaaacttcaaaagctgttacagcagacagtgaagctgtgctggcagaagattctgaatattctgctaatataataaagaatgttatagatggtgttcatgaatggacatttgaaaataatacaggaagtgaaataacagtaggcgaaatattcagcaacgaaggtttaacggtatttgcagattcatcgaatacaataaagattggtttaaacaatgatatagtaatgcgcggaagcggatttgctgacggcgacgcatcgtacagagcaatcagaattgtaatgcctgttacaggaaaagttacagttgaagcgtttacaatgagagctgacggaaacggaggcgtatatgtaaaagccggagcagacggtgaagatgaagaagtattaaccagcacagaagaggatggaaaaaatacaatatcaggcacaacggcaggagctattgcggcaggtacagacgtatatatttattcgcctattccgttcaactatgttagagttgcggtaacacctgatggtgacattccggcagagccgacagctacagcaggaactgttccgacagcagaaccgagcgcgacagctgcaccaacagaagcaccgacagcagagccaagcgcaacagctgcgccaacagaggctccaacagcagatcctacagcagctccgacattacagccgaacgagtatgaatttttaaccggtgcaacagtaattgttaacacaaaaccaaataatgcaggcgatgtggctaatataacagttacaggaaaagacggaagcaatatcacagtttctaacgcatcgtttgttatgcctgatcaggatgtaacagtaagcgttgtatattcaactccgtcagagccgacagcgacccctgcggagccatctgcaagcccttcagtttcaactgctacacctaatcctaaccttcctaatgatattatttggagagttgacgaccctgaagtaagtcaggcgttagaagcttattctgcaaataacggtgcggaagccgttgctgcaggagtagcagaggttggtcctaatcaggtgtttgaaagaaacaagaatgttaagtatacacacactaacggagtggaatataactttactaaatctttaaaagccggctcgggaaaccaaacaaacagatatgttaaaattactcctgaaacatcttgtacggtaacagtcgtatttgacggaaacggcggtgaaggaagaacacagtatatttcgcagagcggtaatgttataggctcggcagtatgtgataagggagtttcaaccgttacagctgatgttagcaaagacgatttgtcaccggtttacacttacggcggcggctcaaataaaaacgtatatgctgtctttatagaatattacgacgagacgcctgataaaacaattaccggtaatgtaacaaacagcacaggtcttgacctgagcgctgctaaaatagttttcacaaatgttaatgacaacactgatgttgtgacagttgattatgcggaagcatatgaggcaacattaacaaagggcgaaacctatagtatatctgttcagggagtagacagcgtttgtccaacaacgttaacaaacacagttaccgtgaacaaaaacagatatgaacagtctcacgatattaaatttgttaagatagaagacgttgaggttacaggtacactttatacaacattttctgatgatatgagaaatcagaatgaagtatacacaggttctgacgctgttaagattgcgttcacaaaacagggtgaagcagcgccttatgacgaagtaactgtaaacagcgatggtacatttgccgcaaaattattaacaaacgaagtgtatgatgtaacagtagtggaaggtccgtcaggatatacattatcaaatctgtcatcaacatatagtcttccgggcggagatgaaaatccgtttaaaaatgttcttcttataaagaacgacgtggatgttccgtatacagatacattatacgtaggtgcagataaggaatataaaaccgttaatgaagcggtttctgcagttcgcatgatggctgataaaggcgacaaaccagttacaatagtaattgacccgggaacatataagggtcaggttattatcgaccagagcaatattactttgaagagcgctgatgaatcaaacagaccggttatcacaagttattacggtataggatatgtttattattcattaaacggcggattctataatgctgactatgcggcagccaagacaacgaaagcagttgcttcaaagtggggacctaccctttatgtaacagataaaggttcaggattcctggctgagaacattgattttgagaatacgttcaaccagtatgtaacagaagaagaattggctgacggtgttgaaatgaatgaaaagatgtttgagagaaaagccggcgttgacgttaccaccaagaattcaaccgaaagagctgcggcagtagcttttgagggcatgaactcggaattctaccgttgtaagatggtatcaagccaggatacattgtatacaggttccacaggatatttcaaagaatgtgaaatctatggaaacacagattatatattcggcggaaacagtgtggcgtttgataactgtgaccttgtttggtatggatattcagacgtaaagagcggcggttacattgcagcatgcaagacttcatcagtaacagatccgggatacttctttaataactgtactattaaaaacagcaacatacaaggtatgaagtttgataaaggcggttttggaagaaactggggcggagcaaattcagcaatgttcttcaacaacataactcttgacggagttgaaaagccgggcggctggacagcgatgggcggagagttaagtttatctagagttttcgtaaacaacgttcataacgttggagagacaattgatttgacagcaggaagtgataatccgaacggagcggcacaaacgattccaaccgttgaggattatgtaggtgaatggacacctgttcactatacgaaatagttagttataataaaaatgacccgatatatcgggtcattttttatgttttgattttttataataaataaattttttgttagagaagtttaatatttttttatactccttaaaattgtacagttttatttggtttacagatgataattccgaatgtatagacttataggttatctaatgtaatagtctacatattgattgtttttttgtgttatgattatctaagacaaaaatataaattagttttgaggtattgtcatgtatgaggaaaataaggattatgaaaaatttttaagagatagaataaccaagttgcgaatagagaaaaatttatctgagcggcaattaagttttgaattagggcattgtgagggatatataaataaaataacttccggttataccttaccgtctataaaagaatttgtatatatttgcgaatattttggattaacaccaaaagagttttttgatgaagaaattgattatccaattttaatgcagaaagcaataaaagaattaaaaggacttgatgagagcagtgtattgttaattataggttttattaacaagttaaaaaataaatagccaatgattcagcaagcatcggtagggcagatgaaatctgccacgtaaggcgcgcagtcgcagtatatattaaaaataaaaaattatatgaaatagtaaattagtgtatgcacgtatagcgtgcgatgataactcacctaacgagcttgctaacatacatcacaactaagtgatttattgacctcgtaggttaataaatacaaattaatttggctcacacgcaccctataggtgcggtcacagcaagcctaccgaagttcgttaaaacaaccatttttattgcataggaaagttgatttatttctttgaacctaaatagtttaaaatttacaaattgcggacatacaaaatattggttgtataagcaattaggcatgagttatcaaaactttagtaagatggtaaataacgagacaaaatccataaaatatagcaacatagatgcaatgtgtcaaatattaaagtgtaaaccaagcgacttatttgaatacaatcctaatatacctatgaacaaaaattagatataaatatttggggtttattgcaagcatcggtagagctgtgaccacacttttttaaagtgtgtgtaatacaaattgacttgtattgatatacctacaatgtctgtgaccccaccagtatggtgggtgtgatacaaagtgacttgtttttgttagccttcaatgtcaataatatgaatacgcaaatattaatatgtatactcaatgcagatgaaatctgctgcgtaaggcgcgcagtcgcggtatatattgaaaataaaagttaatataaaacagtaagatagtaaaatagtaaaatagtatatgcacgcaagcgtgcgatgataactcacctaacgcggcggctgtgccgccctaccgaagttcgttgaaacgttgtgttttaagtatgaaataaacttgttttaatgaataaaagaatttgtatatatttgcgaatattttggattaacaccgaaggagttttttgatgaggaagcggaatatccaattttaatgcaaaaagcaataaaagaattaaaaggacttgatgagagcagtatattgttgattataggttttattaacaagttaaaaaataaatagccaatgatgaggcaagcatcggtagagcgtacgaagtacgctgcgtaaggcgcgcagtcgcggtatatattgaaaataaaaaaatatataaaaaagtaaaatagtatatgcacgcaagcgtgcgatgataactcacctaacgcggcggctctgccgccctgccgatgttcgttaaaacattgtatttttatctgatgattaaaactgttgactaaaaattaaccgttagcactttaattcttgtatttttaaaccctttgtgctaaaatgttttaaagattattttaaaatataaaaacagaaaggtttgatatatatgaaactaatgatagccagcgatattcatggttctgaatattattgcagtaagctcctgaaagcctttgacagagaggaagccgataggcttttgctcctgggagatattctataccatggccccagaaatgaccttcctaaaggttatgacccaaaactcgttatcgctatgcttaacggcgtgtcagaaaatttgctgtgcgttcggggaaattgtgacaccgaagttgaccaaatggttttaaatttcccaataatggcggagtatgctttgctttctgtggatgggacaacaatttatgccacccatggtcaccattttggagaggataatccgccgtctttgaaaaagggcgagtttttgctctgcggtcatacacatgttccaaaatgtgtggataaaggcggatatttttatatgaatcccggttccgtgtcgattccgaaagaaaacagtaagacttcttatatgattttggaggacggagtgtttcgctggaagacattggacggagagcaatatatgcaatatgatgtaagttctgttcaatagattaaattgataatcaggaaatattattattaaaaaatgtgaattaagaaagacagagtgtagatttgtttaatagaaatttgtttctgattaggagtaaatcgttacagatattaaatgacatatttgaatataatggataggaaacaaaaaagttaaggtcatgtaaaatagaaagtataaaagaagaaagctccgatcctatacggatgaattcaaacaatagttagttcagctataccataatggaaaacgaaaatgtgatatttgccgtgaatatgatatagccacctcattgctggataaatggctgaaacagtcagcagttagcggctcttttcacgaaaaagataaccattctgcagaagagcaggaaataatagaactgcgcaaacgtaaccggcaattcaagattacttaggtaggtcacacaaagaccgcgttaggcgcgcagtcctgggtaaacttttcaatgtagtttgtaccataaaaaacggctgccagtttggcagccattttttatttcagaattatttgtttaagtctgctgcagatgaaaactgcggttttaatgacttataaatgttttggtagacagggaagtagtttttgtaggtctcaacattttcctgaatcggtttcattgtatctttaacgctgattgcggcttcgcatgcttccggaacgctgtcgtaaattccggctcctactgccgctaaaagagcaactcccaaagccggaccttctgacacatttattgtgttgatatcacagccgaacatgtcagcctgcatttgtctccataatttgctttttccgccgccgcctgaggcacgtacttcagacgcgtctatgcccatttcttttattacagacatgcagtcattcaggctgtacgatacgccttccatgacagctctgagcatatcatattttgtgtgctttgctgaaagcccaaaaaatacgccttttgcatttgggtcattgtgagggcttctttcacccatcaaatacggaaggtatataagtccttcacagcccggcgcgattttttctgcctgcttatccatcagatagtatgggtcaacccccatgccgtccgctgcgtccatttcagcatggcagaaattatccctgtaccattttagcgataaaccggcgccctgggttactcccataacgtgccactttccgggcactgcatggcatagagtgtgtactctgccttctttatcaatttgaatattgtccatatgtgcaaaaacaactccggatgttccgatagtggaggaaacaatacctgttttaacaattccgtttcctacagctccggcagcctggtctccggcgccgccgacaacgatagttccctcgttaagtccggtgagttttgccgcttcctgatgaactttgcctgttacctcgcatgattcatacatttttccaagcagatttttgtctatattgagtttttccaaaacctcgtcggaccaacagcggtttttgatatccataagctgcataccgctggcgtctgatacttcagtagcgtattcgccggtgagcttatagcgtatatagtccttaggaagtaaaatttttgcagttttggcatagagttcaggctcattcttttgcacccaaagtatcttagcagcagtgaatcctgtcagtgctggattgccggtgatttctacgagacgttcctttccgactttctctgttagctcgtctgcttctgctgtggttctttggtcgcaccaaataattgattttctcagaacgtttccgtctttgtcaagcataacaagtccgtgcatctgtccggaaagacctattccttttatatctgcagggttaacgcccgattgttttataacactgtttatacttgtatatgtagcgttccaccagtcctcggggtcttgttccgcccagccgattttgggctgataaagaggatactccaccaaaaagctggatacagcgtttcctttttcatcaaataaaacggttttagttccgcttgtgccgatgtctacaccgattacatatctcattgataacactccttatataaatttggttatatttcctataaacttctatttaatataacatacggaagacaataaatcaataatgatttaaaattttgctgcaattatttgtaggattacaatagatgtgttacaaagagaaaaaaagaatacggaaaactcataaattgtgttatagttatatcaccataatatcacatactacgacggtacgctcgcctccttagccgataaatcacataaacctcaccatcatcccaatcagcataccgctgatgagttgaaattgattactgatatgcgccgccgtaatccaaaatctattggtttatatgcgttagatatggatgatacttttgaaataatggttgacagcagtcctaaagatacttcgctgccaatgaacctttcagaaagcgagtttaaaaataatagggtgaatttgaaagatccggataccggcgtaatttcaaaatcagtacaattttcttcacccgggtacaaggttttagatttagctgcccctattgatgttaatggaagcttttatatatatgttagacagtctaatgattcgaagacatccactgatgaatatagaatagccggatgtactaaaggcgttaatgcttcgtactatcagcctgagaaaaatgtatgtttttattcctcttcgaagaggggcgatacaattaatggctggggtgatatatatttgagcggatataattggtgtattaaagcttataccggctcaaacagcttaaagccgtccgcttcgccattgccaaccacatctccgactcaagagccaatagcgtctgaatcaccgagtccaacgtccgccccaacgcaagagccggtagtttcggaatctccaagtccaacgtccgccccaacgctggagccgatagtttcagagcccccgaatccaacttctgctccgacgcaggaacctatagtaacagattcgccaactatgaccccaacttttgctccggttgtttcaccaacggcagaaccaattgtgtctccttatcccgaaaagtttggagaaccggaaatcgtagtaaataaagctgaacagaccgtagatgtgactgtgacgcgagttgacgcaagctgtgaagacagcgctgtattagttgggatctataacagtaacggaattctggtaggatttagaaagataactcctgtgtttgatgaaaacggaacttttatgataagcggagttgaatacggcggattaaatgccaatacattaaaagtgtttatttggagcgatatgggagacataccatatcttgattctccacagagtgttgatttaaattaatataaagttttagataatagaaaggcctccattttttagtatggaggctttttgctgtatgtgttaaaaatattaagagttttatttaagtaaagagcgtatataaggatataataacatttataagagatattttttaaacttttattatttagttgttttcgggttcatcgttcatacatatatcatacatttcgcctgtttttataagtgaaaactgaagtcttgcatcggcttcactgatttggccgttacgtatctgctcaatcgctttttcaatatctttgcgcataacaaagtatgctcttttatagttaatcaaaatatcacctcaaactgttttaatgttacatattatgttattaagtataacatatattctgtgcttttgtcaacatataatttattatgaggtgataactagtgaaagaggataaattaaaaatatccaagagaaggctgaagggggacgatggatttaaagtcttttcggtaagactggaacaggagctcgttgacagaatagataatattgccgaatatacaaataggtcgagaaatgaattaattggtattttgcttagatatgctgtagaaaattgcgagataacagactaaacatctgcatttaagttattatattaagtacgcgtcttatttttaaacagtctaaattgtgcttgttgtacaatttgaagctgcttatttataagacgtgttttaatgtctgaattaaactttttaatttaatgtactttgcttttgatttggggaatttttggaaattttttatttattgatttgtgtatctgtcaaattgacaaagtgtaaaagttgtgctataatttacactcgtttcatataatattttagagtgagacaagatataaaatgtacataggaggaaacgtaatgaaaagatttgatttcagtatgaaactgatagttttagcggtttgtgccgccattgcggttaacctgttctatacaccgaaaactgatatagtttctgctgaggacacagagatgaggggaatttgggtggcgtcggtcggaaatttggactatccgcagtcgcctactgctgatgcatggcagcttagagttcaaatggacgaggttctggacaactgtcaggatatggggtttaatacagtatttttacaggtaaggccgtcaggagatgctctttataagtcggatatatttccgtggtcgcgttatcttacaggaatacagggtacggctccgagcgacgggtttgatcctcttgaatatgctgttaacgaggcgcataagaggggaatgcagctgcatgcatggataaatccatatcgagttaccaactcgtctaatgataatggcaaattggctgcaaataatccggctgtattaagacctgacttggtgcttaccgacagttcgggcaagatgtatttgaacccgggcgaagctgattctatcgacattatacttgaaggaatcagagagattgtaagaaattatgatgtcgatggaattcacatggacgactatttttatccaagcagcggatttgacgattctgcggcctattttaagtatcaggacgcatatccaaacaaagcggactggcgcagaagtatggttactactttaatctcttgtgcccgtgacgcagtaaaggaaattaaaccaaactgtatgttcggagtaagtccgagcggtatttgggcgaatgccggcgacacaccgggaggcagcaatacaaatggaagcagttcatatcatagcttgtatgcggataccaaactgtgggttgaacgggaatatcttgattatataatgccgcagatatattggtataatggccagccaaacgctgattataatactttaataaattggtgggcgggtgtttgcgccccgacaaatgttaagctttatattggcgaagcggcttataaggcggcttccggttctgaagctgcttggaaagggcagaatggtataaatgagttgtccaaccaggtttcaatgtgcaggcagagccagtatataggtggttacagcatgtttgagtattcttcgtttatgggaaattcaaatctgtataacctcataaaacagcttcattctacacctgccgctgctccgacgctgggagaaattaatcagcctaatcctcagcctgaggcaactcaggcacctgaggacaagccttccgagccaactcaggagccggcttccgctgacccgacaaacgctccgattgctgctgaccccacgagcgcaccaacaaacgtcggagacgcctcaaagtttactgatatgggtgaatatggctgggcaatgccgtatattgaagatcttgtaaaccagggaatagttaaaggcataagtgatacagagttcggacccgatatatttatttcccgcgccgacgctacggttttgttatatagaatattaaaggaagcagatataactttcacagaaaactttgatgatgtatatcctgataaatactattatgatgaaataggacaagccaaagcaacaggggttgcatggggaattggaaataatctgtttgatcctgacggaactatgcagaggcaggatatggctacacttgcttatagagttttgaaagcccgtcaaattttgacggcaattccgaacacggcaaaggcgcttaataattattgggattggcgtgatattgacttttacgccagagacgctatagcggcgtgtgtagaaaacaaccttatgggaggatacggcgacggaactatccgtccaaaagatgacgctacaaggattgaggttgctctctttgtgcagagaataaaaactcttatagacagcaaataataacaataaggtatatagccgcggaaacatgtttcggtttccgcggcttaaaatttgttaaaaaccacaataaagactataagagacgagccaattaagattgatgtaataggcaatttttacaaaaaaacataaagatgtcagatacaaccttatttttgtgcgatttgacttgataaaattggaataataaggtacaataaataatggagctgtattagaatgatgaataatattataataatacagcgattatatgcacaggagggattttatttatggcaaacaatacttctaaggcagagacgcaagataaaacggcaaaaaatgttgctgagtatcatagacaattaaaacccggaacgcccgagtttgatatgaaaaaggactttataaaggatgagattaccggtaaggtgaaacgctattttggaaaaacaatagcaaaagcaggcgacatggaagtctaccgtgctgcagcgctcactatacgcgacgagataatggaaaagtgggtaagctatcaggaaaaatgtgagagaaagccgcagaaagagctttactatttatcttttgagtttctaatgggcagagctatgggaaacaatttaatgaatatcatggagacggaagtttataagagcgcattaaaagagctgggattttcgctggaaaatattgaagaggtagagactgacgcaggcttgggtaacggaggactgggtcgtttggcggcttgtttccttgattctctcaccaatttggatttgccggcctttggctgcggtataagatatgagtatggactgtttaagcaaaagatagttgacggatatcagatcgagatgcctgacccgtggctgcagagcgggaatgtttgggatatagcaagacctgaggacactaaagaagttcattttaacggccgtattattgaaaagtgggaagacggccatatgaagtttgagcatgttgattataatactgtcatagcggaaccgtatgatatgcctatcacaggatttgatacagacacggttaacactttaagactttggaaagcctgctcgcctgagattatgaatatgacagagtttaacagaggagattatgctaaagccaatgaaaataaagatttggctgaagttatttcaaaagtgctttatcctgaggacaatcattatgaaggcaagcttttgagattgaagcagcagtatttctttgtatcagccacaatccagtggataatatccaaacataaacagaagaatttgtctatgtttgatattccggaatatgtgcagattcatataaacgatacacatcctaccatagctatacctgagcttatgagacttctgatggatgaagaaggcatgtcgtgggacgacgcgtggagtatagtcggcagaactttcgcttatacaaatcatactattctgtgtgaagcgcttgaaaaatggccgatggacatggtggattcgctgcttccgagacttggtcagattattcatgagatagacaggcggcagagaatcgccctgaacgaacgtttccccggtgacacaggcaagattgagtatatggctgtaattagcagaggacaggtaagcatggcgaatttgtgcttgactgcctgccatagtgtgaacggcgtggcggctttgcatactgaaatactaaagaaagaaactttcaaggattattatagcatttatccgtataagtttaagaacatgactaacggagttacattcagaagatggctgtataaggcgaaccctgagctttcttcgcttatttgtgaagcgataggcgacggctgggtgaaagattatacacagctggaaaatctgcttccgtttgctgatgacaaagtgttcagagataaatttgcaaagattaagcttaataataaggagaaacttgcaaaatatatactggatcataatgatataactgtagatcctgcatctttatttgatgttcagataaagagactgcatgaatataaaagacagctgctcaaagcctttcatataatatataggtataaatctattaccgaaacacctgaaaatgcaaataagatgcccgagacatttatatttgctgcaaaggcagcaccgggctatcatatggcaaaactgataatcaagtttattaataatatagctaaggttgttaataatgaccccaggacaaaggatattttaaaagttgtatttattgaaaattacagcgtatctattgctgaaaagattgttgcagctgctaacttgagcgagcaaatttcaacagccagcaaggaagcttcaggaacaggaaatatgaagcttatgctgaacggcgctttgacaataggaacaatggacggtgcaaacgttgaaatacgggagcaggtcggcgatgataatatattcatttttggaatgcagtcagatgaagttttaggactatattcgacaaaccgctcgccgagccctgaattgtatgctacaaatatggggattaagagcattgtcgacacactgatagacgggacgttctccggagacgagcataatctgttttatgatatatataggtctttggttcagggaaataacggcagttttgcagacccatatttgcttttgcctgattttgaatcgtatgttcacacttgccagcaggcaaatagtttatataaagataatcaggatgaatggaacagaaaagctgtaataaacacagcaaaagccggattcttcagcagtgacaggacaattgaaagttataataaagaaatttggcatttgagataaaaataaataattaagcccatggcatttgtcatgggcttttgtttaatatataaagaaaagtgatctttgctgatattatgcagtttgccttagtagttaattagtttattttgtattagtgaatttaacacttatagaagttaatatataagtgaatttttttcacatatatttaatataaatattacaccgcattgttttgtgaactaatatttatttatttttgttttttattttatattccaataaaaagcgtaatatttatatatttattatattatcatttatttatcaaaaatatatgttcgaaataaaaattgttaataatttagccacaaaagtattgcgcttttgttacaaatatgctataatgtaaacattaaatgtattatatttacagcatatttgagttacggtacatatatattgtgtatcggttgttgtgtttatgtttttagatacaacaggtagtaattacatatgtaaaaaaattaaatatataggaattttatattccaaaaaacacaaggaggggttttttaatgagaacctttaagagaagtttggccttagtattggccatcgctatggttttgaccacctttggtatgaccgttgtttcagcggctcagtacaatgatactgaaggtcattgggctgagagttatatcaacacttggtctggctatggcgtaatccagggcgacggcggttatttcagacctgacgacgctattacgcgtgcagaagttgcacaggtaaccgataatgttatcagttatgaaaaaattgctgataatatgttcacagacgtatcaactacagactggtttgctgatgcagtattaaagctggttgctgctggtactctcacaggtaacggggacggaacgatgactccgaataactacatgacccgtgaagaggctatgacaatgcttgcgcgtgcgtatggtcttacggttgagaatactcaggcaggcattacccagtatgctgactatcagaacatttctgactacgctacaggttatgttggagctatgaccgctgccggatatgtaggcggatatgaagacggaacaattcgtcctaaggattatatctccagagcagagttcgttaagattattgataatatgattaagctttacataacagagcccggttcatacggtccagaatatgttggcggtatagttatgataaagacaggcggcgttacccttaacggaatcgttgcaggcggcgttgttgtatcacctcaggtgagcggcgatgttactataacaggttcacagatttcaggggatatcgttaatctctctgaaaaagcaaacgttacatcaaacacaggcaatgttacaaacccaagcgcaaccacaaagcctaacaatattgttataggcggcggtggcagcggcggtggcggtaacggcggcggacccacatcgcttactgttaaattccattacggcgaaaattatggaactgttaagactaagagtgtaacaaagggcaagaagttgtcagaaagttctgttcctacaccgaccgaaagcaattgggacggtctttggtacacatctaagtcagcagcagagaaatgcagcggaactacattcgatccgaccgtttcagctgttaacaagaattacgatttgtatgcaggacatattaataactatgatctgaaagacgtggaaatagctgttgataataagactgattatgtcaacgtttatgttggagatgttttaacagctacgaatcttgctccggcagctgctaagaattatgtatcatatcaatggtacagaacaaaagaaagcaatggaacaggagacaagatttccggagcaacaaagagcacatatacagctgtagaagccgataagggcatgtatctaaaagttgtagttacaggtgatggaacaaactataatggaactgtgtctgatgtttcaactatagttttggcaaaagacgctccttctatctatcctgaaaagacaacagcagcatttggaaatgacgcagcaacaactgtaactctgacagaaggtcagacaattactggagttaagactgagagcggagaaatgcttacagctgatcagtatacttttgatgctgaaacaggaaaactcacaatctcaaaggattatcttgcaggattgacagacggacaaaatgtattcacaattgtagtatctgatgatgctgcttataatgtaacatttgttgttacaacaacaggcggccctacagaaggaccggttcctacagaggatcctgagccgacagcaacaccggtaacaccggataagccgacagcaacaccagtaacaccggataaaccaacagcaacaccggtaacaccggataagccaacagcaacaccggtaacgccggataagccaacagcaacaccggtaacgccggataagccgacagcaacaccggtaacaccggataagccgacggcaacaccggtaacaccggatgagccgacagcaacaccattaccaacagcaaccgtagcaccgattcagaagtatgtagcaacggttaacgtaacaggtggtaaagctgtacttaaggatgcgaacggaaatacttatcctttagtagaagtttctaatcctacagaagaacctgttccgacagcaacagcttcaacagaggagccaacagaagccccggcaacagcaaaaccgacaatgccgccgcttacagagattacagaaagctacacatttatagcagatgatttcaattcagcaggaactttgccgatcagcgaaggtacaatgcttgataacggaaaagtatattcaccagctggaaacaatgctgcgacaaacaagaaatcttcagaaattaatggagctagtcatcttaattcaatgcgtctgaagggcgctcagaactcattggtatttaaaacagccgttgacgttgcggtaactgtatatggaaatgctcatgattccagagtatatgcagcaggcacaacaaacggcggagttgaattgggtaaaggccaaacaggaagcggagtatttacatttaatgcaagtgctggaaccactgtatatttgacagctgttaacgacgctgacaattcaggcggcgacttgtttatagcaggatttactgtagagcctacagccaatgcagcggctgaagatggtgcggttcaatatttaatcccggaaggcgatgtagtaacagtagacgcaacacctgatacagcaggtttgtatccgatagtaacagttaagggtgcagacggacaggacatcgcggtaagcgataacaagttcacaatgccgggacagaatgtaacaacggaagtaacattcggtgacgcaccggcaacagcaacaccggctccaacagctactgtttcaccggaaccgacagccacagcaacagttgctcctccgacagctacacctgtattcccaagctatgctaactggaatatcggtcaagcaaaaatcgataccacagatggcgcggcagcagaagtagtatatcctgctgaaggcggaaaagcagctatcgaagtaacgagcagaaatatttacacaactttggatcaggaagtctcagcaggtcaggctaatgtttcattagatgtatatattgacccggcagttccaaagaactttagaatttatttagagagcggaacagagaactatcagaatcctaatggtgaatatgtatttgcagaagtagcaaataacaacaattcatctgtaaattatggacctaatccggcagaagaaaataagctgtttgattatagtcaaatgacagccggctggtataagtttaatataactctcgactatgaaggaacagactttattactttaaaagttacagctccggatggcacagtggcaggcacagcaaagatgggcgcaattgcaggtaagtctacagctttaagacaggttcgtcttattcagacagctgcagccgcacaatttgcagatatggctataaccgtatcaggtcagccgacagctaccccggctccttctacaccaagtccgacagcggttccggtatcttcaatagtagttcctgctaatgatttgactttagacggcggggcagtgcttagcgataacgctggtcaaaattatacatggactgaaaaagcaacagatgagatgaaatcaacatttggcgatccaatcgatagcgttaacacagcaaagtttgctttaatgaacggcgatggaagaaatgtatctaagacaatcaatattccggctgacggcgaatataagctgatggttatgagtattgaatataataacagatactttacagcgagtgttgataatggcgctgcaattgaacccgagagtcaaactccaggtaagatggcaacaaataatgcaggtggaagcaatgttgatttgactgtgacagaatataatttaggcactttaacaaatggagaacatacagttaaggtaacatctgcagctaataacagcagaaatattttggctatagctgtagttccggttgctgcaccggcaacacctgatccgtcagcaacaccggaaccaaataagtatatcgcaacagttaacgtaacaggcggaacagcagttcttaaggatgcagaaggaaatgtttatcctacatatgcacctgaagctacagtagcgccaaccatagaaccttcagcagagccgtcagatgctcctacagcggaaccgtcagacgctccaacagatgagcctgctgctacagcaacaacagctcctgttacacctgtaacatataaatatacatcaacctcagaaattaagggtggaaatttgtgcgaaggcgatacatgcacatttgttgatgaagcaagtgaagagattagaactttgtttgcggatggaagcgatgctgctaaagtagctcctgcattaacagctaactataagaattatgtaggtggaacaggcagtaaggcatcacagccatacattgaaggaataaacttagagccgggtacgtacaacgtttattatttgggctataacaacgaagttgcaattgatgctactattggagacataagtttctcaatccctgcagccagcggagttccggtagctagggaagataataatgcatctcgtgtattaaaggcatataagtttacatttactgcagaaacagctttaacaaacgctacattaacatttaacacaacagaacaatggttgccggatatattctcagttattttgacaaatacaacagttgcagctaacgctgctggtgttgatggtgcagttcaatatctgattccggaaggcgatgtagtaacagttgacgcaacagctgaaactgccggtcaggttgcatcagttacagtaacgggtgcagacggacaggacgttaaagttgagaataacaagttcacaatgccaggacagaatgtaacagcagacataacatttgctgaagcacctgcaacagcaacaccggaagcaacagcagctcctacagctaaacctgcggaagttatgattgccggtgatatgactctcaacggcagcgcaaaagtttataatgacgcaccaaaagagccgacagctgcttacactgaggaatattcgaatatctttggtgaaaacttctctaaggctggaacaagcaaagttggattccttggttcaaactttggcggatatgtaacaaagaattacacaatcgatgagaccggatcatataaagcatatattatggtatcatatgcacagagcaataaccagtttgcgttaagcaaggatggtacacaggttgttcagggaacattggttgacaagagtgaaaaggtaggaacaaacggtcaggatttgtttatctatacatatgatatagataacttagaagctggaacatatgaatttaagtattattcagaacttggtcagtgttcagactttgtagctgctgctatagtggccgctgaagcacctgcaacagcaacacctgcacctgcaacagcaacacctgaagctacagaagcgccgacaccggacccatcagctacacctagtgtaagatatacatatacaatgggtgcaacaacaaacggttcatttgacgttcagaatgtatctcatccggagttagttacaaaaacagctgacacagctaataaagttaagtggacagcaaaaaatgacctagcaaaatttgagaatatagtagatcctgagccaattaccgtaggtgatattacaattgatcctcttaataatgctacaggcggagcgtcagatttctggaagcataacacagatacagttgacggtatcagcggaaatggtaatcctcgtccgtcttcgttgactggtactccttcagataaggacttgccgacaaatggaacagttttaaaacttacatctgcaaagagcggtcaggcagtagttaactatatgactaatgcaggtaagatatttacagttattgaagctaaacagggcgaaacaaccggatcatacttatataaggtaacagctccgtcaaaagctgcatatacatctgatcctattgagatgaaggttggatacgattattatgtattcgttccggcttctaagattgcagttggatatatcgagtttacaccatatattgaaactaccgaggcatttgccggtgatacaattaaagtattgccatctgcaaacgatggatattcagtagacgaagtaagctatacacctgaaaacggaaataaaactgttgtttctcaaaatgcagaaggttatacatttagtatgccggaagcaaatgtggagataaatgttgcattcaaagaaggcgcagagccaagtgaaacaccggctcctacagcaacagctgcacctgcaacagaaacaccggagccaacggcagaaccaactgaggctcctactgcagagccaacagcagaaccaactgaggctcctacaatggcgccggtaacaattgtaacagctgaatccggaatgagcacatcaaacggcggaaaaacagctgatgtggctttcaaggatataacagctgactatacaggggtttatccagcaatatttggtgagaacctttcaaaagccggagctaagaaaatgggatacctcggcggctcgagccataattacacaacaatgagttatgagattcctgaagacggattatacaaagtatatatgcttgtttacaatcctaataatggaaatagtatgtcattaacaaagagtggttcttctactccggcttttgatgctcgtcttatagacataagtcctcagctggcgtcagcaagtgatggttatgctattaaggctctgacatatacagttgcattaactgcaggaacttatacagcaaagtattacagaactgatacatctttctgttcagaccctatagcttttgctatagcaccggtaagcgaagctgcagctaacgcagcaacagttaatgttacagatgtagccggcgcatcagctgagttacttgattctaacggtatagcttatgaaggtgatattccggaaggtgatgtagtagaaataaaaacatcagatgtaacaggatatgcagtaagtgtatcggttactgccggaggaattcagattcctttgactgcagataataagtttataatgccaaaccaggcggttacagttgatgtagtttataatgctttacgtagtgtaagcgtttcagctacaggcggcagtgtagaactttataatgctgctgataattctgtaatagacccagctaattataacagtattccggaaggaactgttataggtattacagctacaccagatgttgctgaacaagttgcaaagattacagttgttggagcaacacttgacacagataagaatttgtttactgttagagacagcaatgttgaagtaactgttgagtttgttacaccaacaaagtataatgttaatttggatgcttatacaaacggaagtgtttcatcagataaagcaaccgcagcagagggtgaaaaagtaactcttacagttactccgaacagcggatacgtaactcaggaagtatatgtggttgatgaaacacaagctgcagaaacaattacatcaacggatattacaaaatatacgtttacaatgcctgcatctgatgttactataggagcaatatttgctcaggttactggatatgttgagtatttgtttgatggttcgcacaatacgtctattaattcaacaactgcaccggctataacatatcaaggtggtacacatcctactccagtatttacattgacaaatacatctaaaagctatggagtagcaacggctcttgatattaaggggaaacttcctcttagcggaacaagcataagctggaacaagaaagcatctaagggttcaaatggagcaggatattttattgatttgggtctcgtagattcttatgcagatcagaattgtcagatattcacaatgttgtcgccaaactctgttgctgatacaacaatagcaaaacttgagggtgcaaatgcaggcaagtttggtactattacggcagcggcagcaatggctgaaggcgtattcagaggaattgacgcttctgatgcacaggctgatggtacaattaaattgacatatggtaataagcaaggtctggtatattatatagcaattgcttattatacgccggtggttttataatctatttgcaattaatttagtttttcatcaaacaagggactgcatttgcagtcccttgttttttatattagtgtgatttcttaaaatatttttacactacagccggattatattataatattactcctgtttatctttaataccccatagcgttttgaagcataagctggttaattcgttcttctgttaaacggttgttcagtctttcagaatttaactggttattaataatttggttgtaatactgcatatatatttgtttcattacattatccattctggaatcctctatatccaaattattttgtgttgattcctgaccgttgagtacctcgttccagttataatcctgagaattattggcttctgtccagcgataatcttgttcatttttgtcatatttttgttggttaaaaagtgtgttccaataattttcatatgccgctttgtctcggtctgtatttgaagcgagaactgagttgatattagaaatagttttgttgttggctccatatgcgttgctgtaggctgagttgtaggtgtccagcatgttttctaataagtttatgtccgtgttatagctgtccgcataacgttcatatgcctgctgtgcaagctccggcaccatttctccgagtttgctcatatagtattggttggtttgcgctgcggcagtagccgcggcggagttcccataaccgccggtaagccccgcataattcgccatagcgtcttgacttgctctattaccctcagtgaggtatttttctttataggcttgataaaccggatcatcgtcagggtcatactcaaagtcttttcggttcattatagacctgctcaggtttgtgattgaatttaaatagcggttgttgtactcatctaatatttcgtttggagttgagaccccaagggtgttaaagtaatctgatgttaggtcctcaatatcgttttgatacgcccatgcctttccgttttcatctgtatataaggtgttcagcggtcttccccctatagtggccgagccgttgctgtaacctaacgcatctgctgatactccatattgtcccgcatattttgaatatgcgtctgaaacctgtactattggattattagacttggagtaatagcttaccagactgttctgtatttcagatgggctcgcatatgaaactccggcgttttcatccatatatgatggtttcatcaaagttcggccgcccaaggtgacggttccgctcctgtcgtcatagccaatcaggtcattgcttatccccatgttggtcagagtggagcggattccgacagtaccgtcctccctggacggtactgtctgtttctttgaaagggagggggatttgtttgctgccgccaatttgttatctgtgatatatttatctgatgtgtttggcatttgttctacctcctgtgtatgtgattatctctatgtcgtgcactgccgcctgacctgtgccctcaagcattatgcgaaaactgtcgcattttttgaatctaaccggcactttgtgaaccataaaaccattgccctgaatctcaccgcaaaacttaaaatcctcattgtcccaggctgagtatattttgactttggagcctgattttaaatccaggcggagatatactgtgtttattcccttgaaatcaaaatcatcaagggtaaattttttggataccacacaccagtttatctcttcatcgctctctcctgaaaatttatacatatcggttttagtaacgccgtaaagatgttcgttatagcgaacaaagtcaatgaattccgtgttgtcctctttatgccaaagactataaagagggtcatatactaaaagctcgttaccgtttgagtttccggcgcacgcatagtaacgctgtccgtcggttccgcttttgcaagtgaaatagttggtttttatacaactgctgattttctcaggttcaccgccgctgtactcataaaagccgtcggctcccatatagtaaagtatgccgccgagttcagcaatactttttccgtctattgcaccgccgcaggtttgcttgggtatagaaaaattttgcggtgagtctccgtagatgtggtgtatatagttgctcttaaaagcgacgacggctgttctgtagctgactatacctgtaaactcgccggcagtgccgatttcactgtaccagctgtcatctgctagacccctaaaggaattaaaattgaaacaatcgcctagtttggacgcatatatgtattcgccgttggttcctgttccaaacagacggttattatgaacgcatgcccagctgatatcaggaatacttatttcaatagtcacagaattgctgtcagtagtgtttttgaatagcccgtaactgccgtttttagtatataaaagaagtgaaagtttagatgttgtggcctcgtcaactaccgcactgactatttggctgtcagaagcataatctttttttgagtttattacatgggtgttgttttggtcttcactgcagccgcttatgattacactgtctcctaccttaaaaatgtcgtcaaattccgcgccgcttttctgtatataagcagtatatactccgcttatttcattatgacttgagtaaaattttgcgtctgtaacagtaatctgacgtcccatcttctttaactcattccctatttccccagtgtcagggtcaggaagatacctatagtacaccttgtcagggaaaatacatatgttcccattaaagtccactatagatttttcaccgtccaagagcttaatgtttgtgacagagctgcccttgtagtaaaaatagttttctgctacccctgtgaatgagtcaagacttcccggctggtattccggagccgtaaccgctgatattccgtttaaagaaacaatgtgttctctcggtttacgcggcgaggcggcaggaatagaatcggaggacatattatacatttcagacatttgtctgtcgtcaattttttctctttgatcatatccaaagaagtttaaaatatccactttttttgtgttgctgcttgtggacgaaccgctgggcggcagatacatattcctcacctcctaccagaaatttttgaaccttgccaaatcgttcaagggatttctggttttataatcttttttgtattcgctgtacaaattgttgtattgggtcatatgggcagaatacgcgtcgtaatcatgctgatagagcgccatttttgccaaaatatattctatatacagtctgtcatatggagggtctgcctctgtttcgtcgtctatgacgcgccgaattgccaaatgtgccgaggtttgcggagtaaatatatcatctgtaagatagactgcttctccgtcattttgatatacatagctatccaggcaggagtcccagttgggttcatcatctaagttttcgagaagtacgcattctatgttgtccccctcaaaaagtggaagctcagagccgaatatgatattctcactcagtttataagtaccttttacctcaatgtttctgatgttatcaggcttggtgagatacactagtttaagtattttaggagctgaattgctgaatgctgaggtcagtgaaccgcatagatgaggcaggcttcttaaatctgctttatctattaacttacctgccacatacgcagcttcaatatcgtcaaaagaaatatcatcaggcagttcaaattcatcagggcatgttactaaagtttcaataacggagtaatatttttttatgtcccgtcttaaagcgagtgaaacttcgtcgcaccagtgcagcttttcactgaaagtaaattgattagggctgagagcgtctgcagctgaaattgcgtttatgattttcatgtatccacctgccctctaagcctctttaaggctttcaatatatttttcagcctcaatttcctgtttatcgcttctttcaatggcgagagcaacacttctaggaaccattacttcaacgccgcgtttaatttgataattggttccgttaacggtaacggtcaaatcgtcttttttcttccagttatctttaattaatgtcacagggacaggttcattataaaattgttcaagttcatctgtaacagtttgttttgtatttgccatgtttacctcctaatagctgcaagttgtttcaactctaaccataaactccggagagagtatttctgctgtctgagttgctttccatccgacagtgcttctctggtcgagagggtctccggttcctgcgcttcccttctgtttgattattgtctcaaggccgccgcctgttatattagtaaccccataagcattctgaccaataaatagagtagagtatacgtccctgccatcctttccggctcctgccggatatatagttgttccaggaacaatagtagcgcttggagtttcagacagcgtgatgcttgcgcttcctgcgcttccggctgccgctgaggtgatagagtagtcaaatccgtttatctgtacagctttgccggacagagcagcagcgtcctttgcggctatttcttctgaaacagtaatggttttaccgttaacctttgcaacagtaaggctttcagggtctccggtctcgatgttttcaacggttctgagcggagctgccctgaatattttagcttctgtggactcaacgaatacaacgccgtgaattttgcctattgtgccgttgtaccaatcttttgggtcaacattctgctttatctctttccagtccgggtcgtttgtcaaatcgttggcaacatcagggtgaattatagccacgtaacagccgtctttcattggctgggcgttatttcgtttcagtgttgctacagctcttttaacagccgccacatttaaataatcgttatcctcatagttttcagcaccgcctaccagcagatttcggtcagacttgccgtttccatactgcacgttggttccggcatttaccttttctcttattactgtgtcaagagttcttcctgcctgatcgcctaaaacattttgtgtttctactataacgttgtcaatagcggacagggttaatatgtcagagagtgtaacataatcaccgtattggtcaacagtggattcaactgttgtgacattgagctggttgccctttggcgttactccttcggttaaaggtttgagcgctttaggcagcgggctgaatctgcggaattcaatagtctttcctgaaccctttgggataggcttgttctgtccgaactgtccatgaaccagttttgggctggcaaacctaatcatctgtctgtcgtaatacgctttcaattcaggagtaacgttatttccaagattattggttgatgtagtttgtgtattataatttatactcatttattatcctccttgtgtttacttattttataaactcttaaaatgaaattttttcaccgtttctgactctcttaactatttcgtcaagctcatcgtcagttaattcctcagggttctttttaaccatagctccgcttcctgccttgcctgtaccgttctcggtgattcgcctttcggcggacggcttttctccgcggctgcggtactgggaatcaccgtagttctgttcttccctatgacagagatagtaggcgtcttcaatgcttagtccatttccccaaacataattgcagaatttagggttttgtatttcacgtctcatatcaaaattaggatttttttctgaaaattccttgacctgagcgtcaatttctgaagttcttttattgatataatcctgcaaatcctgctggtcttcaccgtatccggcaaactgccccatttgctgggcgttttgataaccgcctggatattccgccgtttgaggctgacccatttgggtgttttggtaaccgccttgataacctgccgtttgtgactgcggtggggtatagccgtttccttgttccctatatccgccggccgccggcctttgtcttttgtttccgaatccgagcatatttttgctcctttcatattttattttgtggagattaagtgtcttccacaattaaaattataataaaaatatagtgcaaacgcgtgccattaaattagtgtacattattactaaaaaaaatgtattttttcttctagaaaaggctatattattagtaaaaatgaatgaaaatgattataaatgcttgtttgtgaaatatttatgaccgaaaacgcttgacaatgattgaaaatggtgataatattacggtgtaagataaataaatgaaaaatgaagcttaaaaatcaaatcttaaaaatgaaaaagaggggttgacaggtcatgcttacgcaggagcgtcataataaaatattggaactgctcacaaagcaggatacggtcacagtcggcgagttatcacaagggttagaaacttcagaatcaactatccgaagggatttggtaactttagacaaaatgggcaaggtaaaaaaggtgcatggaggagcggcggctattcatagggtgagcactgtttttgaagaggatgtcactacaaaatcagcactgaatgttactgagaaggaagcgataggcagagttgcagccgggcttgttactaatgatgattttgtttttatagacgccggaacaacgacggcggcaatgattgattttatttacgacaatgtcagagccacttttgttactaatggtatagttcatgcaaaaaagcttattcaaaaagggcttaaagcctatattataggcggacagataaaacttacaaccgaagcggttgttggaacagaagctataaataatttgagaaaatataattttacaaaaacttttataggaacaaacggtatcagtgttaaaggcggatacagcactcctgatgttgaggaagctgccgtaaagtcagaggtattaaaaagagggagaagcaattttattttaggtgaccataccaaatttgacaaagaatatgcggtaacatttggtatacttaaagacgcttgtatagttactgatgagcttgaggataatgaatttagggaacacgcggttgttaaggaggcttttgcatgatttatacagtgacatttaatccggctgtagattatgttatacatctggaagatatagaacttggcgctgttaacagaaccgagagtgaagagatattttttggaggaaaaggcataaatgtttctactgtgttaagtaatttaggcgctgaaaatattgcgcttgggtttatttcgggcttcactgggaaagctattgagagcggtcttaataaaaacggtataaaaaccgattttatagagcttgaaaatggtatcacaaggataaatgttaagataaaatcaaaagaagagactgatataaacggtcagggcccggttataagccatgaggcgatatcagggcttctagataaactaaaagttttgcagagaggcgattttctgattcttgcaggaagtattcctgcaacaatgccagatgatatatatgaaaaaataatggagcgtttaaaagacagcggttccaatattgtagtggacgcaaccggagatttattaaaaaatgttctaaagtatcacccgtttttagttaagccaaataaccatgagctgggagaattgtttggaattgaaattaatactgaggaagaaattattgaatatgcgggaaaactcagacagctgggggcaaggaatgttttggtgtcaagagctggagacggcgctgtattgtctgctgaaaacggtgaggttataaaaatgggagtgccgagcggtaaggttttaaactcagtgggcgccggagattctatggtggcaggatttatttttggatacttgcagagcggagattacagagaggcgctgaaactgggaactgcctgcggaagtgcgacggctttctccgcaggtttagctgaaaaagagaaagttgaagaacttatgaaaatcttgtaacttataaattataaatttttatataataaagaaaaggagaggtaaatatgaaggttattgatttgctgaagccgaacgcaatcgcgctaaacttcaatacggattccaaagaagctttgtatgataaactaattgacttgcaaagcaaagccggaaacatttcagacaaggcccagtataaaaaagatttgtttttgagagatgaagagggacctactgcaattggcgatggagtggctattcctcacgcaaaaagtgccgctgtaaagaatccaggattagcggctgtgacagtgcctaaggggattgaccttgacgctatggatggtggaaaatctaatttgatttttatgatagccgcaccgaaatcaggcggagacgttcatcttgaagttttatccagactgacggttatgctgatggacgaaaagtttagacaaaaattgctcagcgcaacgtctgcaaaggaatttttaaagtatattgacgaaaaagaaattgagaagtatggaaatgaacagcctaaggaaaaaacgcaggcttcaagcagcacaagcaaggggattaaaatagttgctgtgacggcttgtcctacaggtattgctcatacatttatggccgctgaggctcttgaacaaaaggccaaagaaatgggagtagaaataaaagttgagactaacggcagcggaggcacaaaaaatgctttgacaagccgtgatattgctgatgccgacggagtaattatagcggctgacaagaatgttgaaatggcaagatttgacggaaaacatatcgttcagactacagtttctaatggtatccataagccggaagctctaatagagaaaatagttaacggtactgccggtgtatactcacatacaggaggagctgagactacctcagaaggcggcgacggagtagggcactcagtatacaaacaccttatgaatggtgtttcacatatgcttcctttcgttgtaggcggtggtattttgatagcgctggcattcctgcttgacgactattctatagatccgtcaaactttggtatgaatacacctgtagccgctttctttaagacggtcggaggagtagcgtttaactttatgcttccaatacttgcaggatttatcgctatgagtatatctgacagacccggtcttgcagtaggttttgtaggcggagctctggcagtggcaggaactacgtttgcttcacttatgaatcctgacgtaaatgtagtatcagccggatttttaggcgcattgttcgccggttttgtgggcggctatttaactctcggacttgagaagctttgctctaaacttccggagtcacttgagggtataaagcctgtgctgatatatccgttaataggtattttggtaatgggactgataatgttcctcttcaacccgataataggtggattaaacacattgctgaatagtggtttaaaagcgatgaacggcgccagcaagatagttttgggattagtgttaggcggaatgatgtctattgatatgggcggtccatttaacaaggcggcttatgttttcggaaccgcttcaatagctgaaggcaactatgacataatggcagctgtaatggttggaggtatggttcctcctttggtaatagctctttgcacaactttctttaagaataggttcacgcccagtgagagaaagtcgggagctgttaactatattatgggtctctgctttataagtgaaggcgctataccatacgccgctgctgacccgcttcgtgtaattccctcatgtatagtaggaagcgcagtttcaggtgctttgtcaatggcgtttggttgtactcttatggctcctcacggaggaatatttgttttcccggttgtaggaaacgtattgggatatatagcagcgcttgttataggttcggttgtgggagcgctcctgctcgcatttttaaaaaagcctttgggcgaaaaagccggattagttaaaaaaggtgataaagttacggtaaaataatttaaattattattgacattgctaaaatatagtgataatattatagtatatttagtgaaaataattaaaggagtgtatattatggtttcaaaaacggttactgttacggatcctgaaggtcttcacatgagaccggcaggagtgtttaccaaagagatgtcaaagtttgattctgatgtgacaataaattttgacggaaagagttttaatggaaaaagcataatgaatgttattgccgcttgtataaaatgcggcagcgaaattgaaatagaatgcagcggaagcgacgagactgaagcgctcgaaaaggcggttgagctggtgcagtccgcagggtaggtgatgaaatgttcaagggaatagcaggctcagaggggattggtataggaaaagtcgcaatgataaaggagcaagacttgacctatgagccaaaatcaaaattgtcggttcaggatgaaacagctcgttttgagcaggcggttcaggaatttactcagagaactgagaaaatggcagaagaaatgcggaataatgtgggtgataaagagtctgaaatcctgatgggacatgtgctgatgatcagcgatcctgcgatgacagatgaagtcaaggaaggtataagcggcgggcttacttccgaagcggctacagaacaagtttttgagggttttgcctcaatgtttgaggctacgggagacgaattgactgtccagcgtgcagcagaccttcgtgatataaagactaggctgattaaaactctgctgggggtggaagaggtgaatataagcgcccttcctgccggcagtgtgatagttgccagagacttgaccccatccatgacggccgggataataagggagaatatctcaggtataatcacagaagtgggaggaagaacttcacactccgcaattttggcaagggctcttgagattcctgcagttttaagtatagataacataacaaaagaactcattgacggtgaagtggtaatagtagacggaacggacggcagcgtgattgcttcgccgggttctgaagaagtagaaaagtaccgggagcttaaaaagagttttgatgatgagaagaaagagcttttgaaactggcgggcaagcccacagtaacagccgacggcaggagagtagagcttttgtgcaatattggcaagccggatgactgcgctttagttattgagcgtgacggtgaaggtgtgggactgtttagaactgagttcctatatatggacagtaaagaacaacccggtgaggagcagcagtttgaagcttataaaaaggccgcaatgactctgaagggaaagcctgtaacaatcagaactttggatgtcggaggcgataaggatattccgtatttgggcttggaaaaagaggataatccttttatgggatttcgtgcagtaagatattgtattaagaatcaagacctgtataagactcagctgagagctctgatgcgtgcaagcgccttcggtgatataagaataatgattccgcttgtcacttgtgttgaagaagtcagagctgttaagaagcttgtagctgagatagcgtctgaactggatcagaacggagtggcatacaataaggacataaaagtcggagttatgatggaaactcctgccgccgctgtaatagctgaccttttggcaaaggaagccgattttttcagcataggcaccaatgacctcactggatatacaatggctgcagacagaggaaacgctaatgttgcttacctatattctgcatataatccggcagtgcttaggaacataaaaagtattatatactgtggaagggcagaaggtattgaggtaggaatgtgcggcgaagccgcttctgatccactgttgataccgcttttggttgcttttggactggaagaatatagtgtgaatccggtttctgttttgtcaacaagaaatgaaatatcaaaatggtcagtaaaagacgctcaaaaagttgcagaagaagctatggcatgttctacagaagaagaagttagaaatatcctgacaaaatatagaagataataagatatatacttatttcttatattatatatacaattaataaattgtatttatttttaaaagccgcagaaatgcggctttttttctcatattggctataaaatattaaaaccgcgcataaactgcattattgtaatgtagtttaaagtaaatagcaataaactatatattttataggtgaaattttagttgatttatataaataatgtgatataattaaataaagttataatggggtatgtttatacaattaaatttttctgagtgctatgccatgaactcaaaaaatttttttgtttttaaaataaagtataaagttattcaataatcgacatttctttttttacaatagatattttgattagaaatataattgtagattgattgcgtatttaatagaatgattttcaaaacgtcaggagtgagcagctaatgagagatatgaaagagcagctgagctattgtaaaaaaagacattcatttaagtttggcggtattcacagagtgtgtaaatctgttggtgcatgggcagtaattttatttatctttctttcatattgtccggctgtggttgctgaagacgtggatgagacagttttgactgttgcgtttcctgtcagtccgggaataaatgaggtttatgaagatggaacttatggcggatgcgtttatgattggcttagagaaatttctaagtataccggctggaaatatgatataaaaaccgcagatgaatcaaatgatgaagcgaccactgaattactggacggaatgattgaaggaaaatatgacatcatgggcggaatgttttatcaggaggaatatgagcagtattttaactatccgaaatatattatgggttcaaattattcactcttgatgtaccaaaaggataacagtgatattaaaggttatgattacaacactcttaacggtaaacgcataggagtttttggcaaagccgccagtaaaatagaacggttaaaaaagtttattgaatataataatttaacttgtgagcttgtgtattatgatgatagggaattatacgaaaaatgtatcgattcgggagatgtcgacctgatttacggcagtgacgtatatatgaaagacgggtataatgttgccgttaaacttgacagcgacccgtattatttggttacgtcaaaagataagcctgaattatgtgaacagttatcaaaggcgatggaagaaatttatgctgcgaatccaaattttgcagaggaactctataataaatactttcctgataaatatataaattccataacttttactgatgaagaagataaatttataaaggaatgcggaactttaaaagttgctgttataagagaccgttatcctctgttttatgagagcgatgggaaaaaaagcggaatcgtaccggaatgtttgaaactaatttctaatcggacgaatcttgattttgaatatgtgtatgctgatacatatagtgaacttgttgaaatggcagcatccgggaaagcggatataatcggagcctttatgaatgacgatacatctgcggatgatttggggcttataagaactgccggatatgctgatttagactcaattattttgagaaataaacaaagttttgacaagcaagacggtcttacgatggctgtacccgaaactctatccttaaagactacgggaaaaaacgattctattatcaggtatcctaagtatgaagactgtatggaagctgtaaacaatggcttggcggattatacaagaatgcctgcttcttttatagaaggtttttatacaaaggattattatgctaatatgactattgtagcggatacaaatattcaggaaacactgactctagcaatgaaggctcctgcaaatgttcaaatgtattctgtcctgagtaaggctgttaatagttttagcgatgaggatacagcccatattgtgtcacagccaaatttaagtttacctgacggtgtagttacacttaaaactgtcctttatactaatcctgttctcgtgattggtatatgtgtcggttttgtgtttattttgtccctaatggctgttttgtttatattttacagtatgcgtacaaaaatgatggctgtaaagcttgaaaaagcggaggagaccagccgggcaaaatcagactttttatccagaatgtcgcatgagatacgaacgcctatgaatgcgataatagggctgacgaatttggcaatattaagcagagacgctacccctgcattaaaagaggatttaaataaaattgattcatccgctaaattccttttgtctattcttaatgatgttttggatatgtctaaaattgaaagtaaaaaaatgacggttgaaaaattgccttttgatatgtatgaattaattgagcagataaaaattatgttcgtcccacagataagcgagaagaaattaaattttgacgtaacttgtgaacttgaagatacatgttatttaggggataaaatgcgtattaatcaggtgcttgcaaatttgatgtctaatgcttgtaagttcaccgacagaggaggcagtgtttggctgtcagttacagagtcaaaaattaacgagaatgaatcaaagcttagatttagtgtaaaagacacaggtgtgggtataaatgagaaagatattgatagggttttcaattcttttgaacaggcggaaggaagtaatttaagagctcccggaacaggactaggtctttctataagcagcagtcttgtaagtttaatgggaggagatttaaaagtaaaaagtgagcccggcaagggttcggaattttattttatcatagaactgccaatatatagtggcaaattgagtgaaccaaataacgtagctgataaaacaaaaaatattgttttagatgaaaatattttgaaaaatatgcgtgttctgttagcagaagataatgatataaacgccgaaattgccacagagctgttaaaaatgaagcaaatatccgtggatagagctccaaatggacaggaggctgtcaatatgtttgcaaaaagttcggacggcgaatacagtgctattttgatggatataaatatgcctgaaaaagatggattgactgctgcagctgaaatccgcaaaatgaatagaaaagactcggctgaagttcctattttggcaatgaccgcaaatacatttaaagaggacagagagaaagcggcagaagctggaatgacagggtttttgccaaaaccatttgacgctgaacagctctataaagcattaagaaattcaatcttaaaaaagtaaaaattaagcccgctgcctaatggctgcgggcttttttcgtggagccgataagcggaatcgaaccgctgacctattcattacgagtgaatcgctctaccgactgagctatatcggcaacaacgataaatattatatattattttgtttaaaatgtcaagtgcaatttttagatgtcaaaatcagcttattttagaaatttataaagttattcgtccagcttgtctttaacatagttggacacaagctcttccaagatttcatcgcgttccagtttgcggaccaaacttcttgcgccgttgtatgacgttatataagacgggtcacctgacaaaatatatcccacgatttgatttataggattatatcctttttcagacagcgcttggtatacagacagtattatttttttagggtcagcacgttctgtttcaacattaaatttaaccgtttcctgattttccatagttttcacctgcctttatattaaatatattatattgattatctaagttcagcgcctaagcaatttttaagtttttcgagtatattatttaggacgtcatttatttcgttatcagtaagtgttctgtcaggagctctaaaggttagagaatacgcaacgctctttttattttctcctacctgctgtccttcatatacatcaaagagtttataactttctaaaattccgtgttttgtgtcatttaatattttctctattttgccaacgcttattgacttatctataaccagcgcaatgtcacggtttgaagccgggaattttggaagagatttatattctctttcgaatgttgaaaattccattatggtgttaaaatccagctctccgcaatatatatcggtgtccagcttaaagttctcggctatgtcagggtgaagctgaccgattgttccgataatttttccacccgcgcatattttagcacatcttcccggatggtatgccggcgactctgtgtcggcttcaaactcagcgtttttgataccaaggtcatcaagaagattttgcactattcctttaagatcaaagaaatctacatcgccgtacatacccagagccacaacaattttctcatcgggaagtttttgattttcaaccggaatataggtcatacccagctcaaatatttttgctttcggaacccggcggttataattaatctttaaagttttgattaccgacgagagcatattggttctcatgatactgttttcttcgccaagaggattgattattttgacaacattatcggccggtacctttgtcatttcaaattccttagggtcaataaaagagtaagtcatggtctcatacataccatatgcagtcagaagctctcttatgcagtcttcggttttttgtttaagtgtttttccgccgattgttactctgcccttcatcatggtagtaggaagattgttatatccatatattctggcaacttcttcggctacatccgccattgtttcgatatctccgcggaatgtcggaacttcaacatttgaaccgttaacctcaaattccagtctttttaaatattcagccatatcagaggacggtatatcagtccccaaaaatttgttcattttttcaggttcaaaaggcagaactgttttagtctttttgattggatatatatctatacagcctcctataacttccccggcgcccatttcctcaatcagttcacaggcacggtttatagcgtttaaacagttttcagaatcaagtcccttttcaaacagagctgaagcgtcagttctcattcccaaggattttgctccacgccttacaagtataggattaaagttcgcgctttcaaacagaacggttgtggtagtatcggtaacttcagtgttggctccgcccatgactccggccacgcctattgcccttttttcatcagctattgttatcatacctgatttcagttctctcggctgttcgtcaagagtttcaagcgtctcaccgtctgacgcgtctctgactattatttttttaccttcaatattatctaagtcataagcatgcatcggctgaccatattcaagcatgatatagtttgttatatctacaatgttattgatagacctaagaccacaagcagtcagtctgcgctgaatccactggggcgatgggccgatttttacattcttaacagctcttgccgtatagcgcggacagatggaggggtcggcaatttcaacctttgcataatcattaacgtcttcattgtttcccgttggttttatttcaggtattttgaactctctgttaaaggttgcggcgctttcgcgggcaagaccgatgatgctcatacagtcaggtctgttggaggtaatctcaaattcagcaacgctttcgttaagacccaaagtttcggttatgtcctcgcctataggtgtatcatccggtaaaatcagtattccggaagcacgttcctttgaaatgcccaattcatcagttgaacacatcataccataactcataacgcctcttagcttaccctttgtgattttaataccgccgggaagtgtgcttttatgttttgcaacaggaacaacagcgccttcaaatacgttggaagctccggtaactatctgtatatcctcgtcttctccgacgtttacttggcaaacaaccagcttgtctgcgtctggatgtttttcaattttgtctattttcccaacaacaacgttcttaaactctgcaccggggttttcaatgccctcaactatagaaccgctcatggttagtttgtctgcatactctttctcgctgatgccgtctgtattcatataatcctttaaccaggataatggtaaattcatacttgtttcctcctaaatattagaacattggttctcagtaaacttctgaacctgcttcgggtttttaaatataagtatttgtttccccggatatttcctgccggcttcatcaagacggcggaggtatttttttctgtttttccttcctttgtgaagtacccagcttacaaattcaaaatcaattttttcatcgcagcctttacccatatcttcacgggttctgcctttgtagttaaaatagcgtttgagtattcgtttaaaacataaaaatcggttaaagtccaaaaatataatagtatccgccagctctaatcttttatcatatagaacctttgaataatttccatcaattacccatttatcttgattcagcacattttgaagagtctcagactcaatttcaggagtattttccacccagcccggaagccagtggagcgaatcaagatgcgtaggggtcgtccctattttattagctataaaccgagccaaagtagattttcctgcgcctgaaaatccaattatcattacgcgtttcatgattaaaattgctttaagaacccgagatcgttttcatagaacaatcttaaatcgtctataccatatctgaacatagcaacacgctcaagacctattccaaaagcgaaacctgagtatttctcagggtctatattgcagttagccaaaactttgggatgaaccataccgcatccaagtatttctatccagccttcgcctttacatattctgcagccttcacctttgcagttaaagcaagatatatcaacttctgcactaggttcagtgaacgggaaatgatgaggacggaatctaacttttgtgtcctctccataaagtctctttataaacacttcaagagtaccttttaaatctgccatagttatgccttcgtccacaaccagcccttcaacttgatgaaaaactggtgagtgtgtggcgtcaaccgcatcgcttctatatactctgcccggtgaaactatacgtatggggggctgctgtttttccataactctaacctgaactgaagaggtctgtgttctaagcaaagtatcttcattgatgtaaaatgtatcctgggtatctcttgcagggtggtcaggcggaagatttaaagcctcaaaattatagtaatccagttcaacttcaggaccttcggctatagtgaaacccattcctataaatatatcctttaagtcatttaaaacagtagtaatggggtgtttttttccgtgttcaggtctgttgccaggcagacagacgtcaatggtttcagaagcgagttttttgtcttttgccagctttatgagagctttactcttttcctcaagtattccttcgataaagcctctgacctcattggctaactgtcctataacagggcgttcctccggcgtaagtttgcccatacccttcatcagagatgtgagctcgccttttttgccaagatatttgactctgagattctcaagctcagtcaaatccagtgctttttcgagcgctgactcggcgctggttttgatagcgctaagctgttctttcatatatataatacctcccatataattatacaacgttatttcaaataattttaacacacaattcctaatatttcaaggcttttaaggtattttttaagtatgcaagtttattttactgtgattttagcttgtgttttatacggttttggtgtattattattccaatagataccttagggggaatcataaatgaagaatattttaaaatttgccggtgctgtgattgtagttctgatgtcgtgtataacattagtatttgcggcgggacaagcccagccggaagtaacggtgaaaaatcaaaacggattgacattaagaaatgatgttttttcgtactcagataagtttataacaagtgaaattaagaatactgacagtgcggattcttctgaggtgctattaatggcagcgtatgatgaggaagataatatcataagtatcagcagtaccggtgatttaaatattgctccgggggaaacggcagaatgcgttcttagtttggacagtgcagatagaactgtaaaatcagtacgagtctttgtttggagagattttgaaagtgcagaacctatttcggagacgatagtattcactaacgaactttatacttacagagatgatgcaaattcagtttttgtatctgttgaaggaagtgattccgacggagacggaacgtttgcaaagccattcagaacggttgatttcagtgtatcgaagctgtcatcgggtaaaactctttatattatggaaggaacctataaagaaaatatatatgtgggcgtaaaaggcacagaggcagagccgataacaataaaggcggctcccggcgcgcatgcggtgatagatggaggcggaaagctgaacgagaatataattgaacttgaggcttcgtcaagcgatattataatatcagatttagagcttcaaaacggctggggcggaatatacagcgaaaattcaacctctaaatcaggaaagaattttgtggtatgcaataataaaatacatgatatagacggcaataatgacgatacttttgcagtggtcttttatgctaaaaatgtaaatccggtaacaaatgtgattattgacgggaatgaaatatataactgcaaaacttatacgagtgaaacggttactctaaacggaaacgtggatggtttcagagtgtctaataatataattcatgattgcaataatataggtctcgacgcgataggctatgagggaacatgcaaaacaaaagaactggactgtgccagaaacggcgtgtttagagataatactgtttataatgtttcaacctatggcaatgagggttataaagatggttcaggttacgacttgtgctgtgcgggaatatatattgacggaggtcatgatattgaaatattagataataatatttataattgtgatataggagttgaagtagccagtgagtctacacgggcgccgtataatatatcatataatgtgtctgtaaataataatataatttctgagtgcaagggtttggcaggaatttgtttcggaggttatgataataaggttggctggacaaaacagtgcgattttgttaataataccttatataataatattgtcgggataatggtgcagcaggcagaagataatataatatcacagaatataatttacggcggagagaatggacttgtattttcttttgcagacgaggacggaaaacttgtttataaaggtgttggtccgtataatgacactaacaattttggagcaaactattggtatgacccgaatagtgtttcagggtataactgttggtttgatatgcttccggcggaacagctttctaaacagataaccggtgtagaccctaaatttaagtctcctaagcagaacaatttttctactgaactgaatgcgctgggttatggagctataagataattttaaataataaaactataaattatgtcagaaagatggagagatgatgaataatattttaatgtatgtatggcttttggtgggttttttcttattaataaaaggagcagatttgtttgttgacggcacttcatcaatagcgaagcttctaaaagtaccaagtataataataggactgactattgttgctatgggaaccagcgcgccggagatggcggtaagcgtgggtgcagctataaagggtcaaaatgatatagtaataagcaatgtgctgggttcaaatatattcaatcttttggtagtggcaggaggctgtgcggtcataaagagtcttccggtgtcaattgatttgcggaaaagagatttcccgttttctattggtatagctgctcttttgcttttcttttgtttaaatagtttgataattgggggaaaaggttttactatcaacagaacagaggggataattctttttgccggacttatggcgtatcttggatttttagtatactcagctgtaaagggcaggacaggccttcccggagacgaagaaataaagacaatgtcgcctcttaaaagcgttttttatacagctttaggtattgcaggaatagtggtgggcggagacttggtagtggattccgcaagtgatatagccgccgcttttggtttgagccagacaataataggactgactattttggctgtggggacatctcttcctgagcttgtgacttctttggtggcgacgcggaagggagaaaatgatttggcaatgggtaatgttatcggttctaatatttttaatatattaggtgtgctgggattatccgctgctgtcagtcctgttaaagtttcgggattctccgttatagatttaagtttgttcattggattctgcctgataatttacctggttacgttttttaggaacaagatagagagacttccgggtattttaatggtgttgacatatcttggatatatgacatatgctgttatgcgtgaagtattttaagtaaaataaatataaggagagatttcatgaagagaaaaacattttatattatagcaggagtttggtttgctatgatagtcttgatattgctggcttgttatactccgattgttgacccagtaactcaggaagaagtaaaaaagtacatggttttggcgatttgtgtaggagctttggcgcttatgcttattagaagaaaggtaaaagacgacaatgacaggagttaatggccttttttagagattaatatctccgaagttacagcgatataaaaaattttatatatttttcttattagggaactgtttatgacaaattttgccttgtaacttgtttataatactttcgtaatgaaatgttaatgcggttacggaggtatttattatgagaaacacagaattggtgtctgttgagacttctctgcaggtacagcaaaaaaagcggaaaggaatcgatttaaaattttgggatattccggtgcggcttttgggcttattgtttgcgggggcaatgcctataagcggaatggcaccgtttggtttgtcttttttgacgcttgaccgaaagttttcactaaaaagcgtcattaatttgatttttgtgtctgttggctatctgcttctttttgattttgagcttgctttaagatacatatctgcttgtgttatttttgagacggttttattcgttatagaaagaaacgaaaaaccgtctttgtatttcgttgctattgtttcagcggcagcattgtttctttgtgagtttggcgttttaatgtggacaggctttacggttgcaggtctaatacttataatttgcgatacaatgcttatggcagtcggagtgatggtgtttgatagaagtagggatgttttgcttgaaaataagtttttgtcgcgttcactgctgacagatgaaaagataagcttatgtataatggcaggtgtgattttgctcagtacaaagtcaatcactgttttggatacgtttaatatatctaactttttggcatgcgttttaatcggggtagtgtctttgtcaagacatggtctgactcatggcgccgttgcgggaatatgttccgggattatattaggaatcggcggtttatttccggagtttgtggcagtactcacaatctgcggcctgctgtgcggtatttcagctcagttcggaagaaaggttgtttgcctttgtcttggtgtatgcggtttagggataatgctgtatatgggtatacccggcggacaaacgcatataccaaatatatatgagttggttttggcggcggctgttgtgtactttcttcccagaaaggctgttataataggtgagaaagtaactgattttaatgttgacaattcagacgatactgagcgttttagaatgtatgttactgaaaaacttatgtgtatatctgattcgttctatgatatttcaaagacatttgattcaatgtcggacaagcagacaggcatggatatgagtgatatctcgctgctgtttgacacggcggcggatagagtgtgtaaaaactgtgagagagcgaatttttgctggaaaaaggattttaatgctacatatgcagctatgtttaaatttttggagataatggagcggaaaggcagtctgcagctcagtgatgttccaaaatgtttttcggacaagtgtgtacacctgctcccgcttataactgaaataaacaggctgtttgagatttataaaataaacagaacttggaaaaataagcttcaggagaacagagagcttacgagcgagcagtttaaggggatttctgaaataataaagaatgccgcgtcggaaatatgcggcgaaaagagttttgatatcaggtcggcggatgaaataaaagaagttttaaacgatatgggaatttcagcccagcgagttaacgttgtttgtgacaagaatggaaaatatatggtagaaatcagcgtgcttgactgtgatgatttctcagtttgccaaaagagaataaaacccgtaattaaaaaggtccttggaatcaatgtggctgtgccgtataatgagtgtgatacctcagacagcggaaagtgctgtatacgtttttgccaggtagaaggttttgatcccagtattggggtggcaagcctttcaagtaacggagaaagcggagacaagcactatacgaactatttgagcggcgggaaactggcggtaactataagcgacggtatgggaacaggacacaaggcggctatccaaagcgacgctattgttaaacttttgggaagctttttggaagccggttttgataagacaatagcagtcaagctggttaattcagtaatggtgatgaagtcagccagggatgcttttgcaactgtggatatgtgcgttatagatttgtatactggtgagatagaatttatcaaaaacggcgctgaagccagttatattaaacatacagaatatacagagactgtgcgcgcggcatcattgccaataggaatagtatcaatcggcgatattgagacgtttgccaggactttggaaaacgggtctatggtagttatgaccagtgacggtgtaatatcagcggcggaagacaattggattagggaactggttgaggtaatagacatggagataccgccaaaagaattggcgcagataatactagacgaggctgttaagagaaatgctgaaaatggtattgaaaatgatgacatgacagtaatatgtgtgaaattgtctgacagaagagttagagcagagcagaagcatgtgccgaaagcggcagtaatgtaatgatatagtttataaaagccgattcagatttgaactgaatcggcttttaaaattcgtttattaataattgaaaaaataatacattcatatattaataaaaaagaaaaacataatttgattaacaattaaaaaccatatgaggtgtgtttagctaataactgtaccgtataagatgatttacatttgaacacaaagtgtttaaaataaaagagactataaaaacataaaaaataaaatcaaaagatcatcagttaagaagagcatcggcagggtgcatttatgcaccgcgtgaggcgagcaatcatctgaacatgaagtgttcaatatataactcaatatttattcttaataatcagattaataaatataatattatgaaaatatatctttatacaatcggtaagattaattgacaatgtttttatcttatgttatcataacttcaaaatatatgactagaataaatatttttccgtgttatattagtaaactatatattaatttcagcgcagttttttaggaggctattttatgcttttttcttttgatgatataatggaatatgtggaggaaaacgacgtcaaatttatcagacttgtattttttgatattttcggcagtatgaaaaatatatcaattatctcgacagaacttccaaaagctttggagtatggcgtcacttttgacgcttccgaaataaatgggtttatgaatattggcgaaagcgatcttttgcttaaacctgacccttcaaccgcagaaattttgccgtggcgtccacagcaggatagggttcttagaatattttgcgatatttgttatcctgacggcagaacgtttgagggcgattccagaaatattttaaagcgttcggtagactgtttgaaagagctcggatactcgtgcgatatcggttcggagtgtaaattctatctttttgagttggatgaatacggaaatccaacaaacaagccgcatgacaacggcacatattatgatgtggctccggtagacaagggagaaaatattcggagagaaatttgtcttacgctggaggaaatgggtattcaacccgaaagttcgtatcatcaggcaggccccgggcaacacgagatagtttttaaatatggcgcaccggtagaagcagcggatcatctaatgacatttaaaaatttggttaagacaattgcgcatatgaatggacttttcgcttcttttatgccaaagcctttgcaaagacagaatggaaatggtatttttgtaaatctttcgctttatgatatggacggaaacagcgttatagattataataatgagactggcagacaatttatggcaggtatacttaaccatattaaggagattactctatttttgaatcccttaacgaattcatacagcagatttggagagtttgaagctcctaaatttataacatggtcacctcagaatagacagcagctaatgcgtataccaaagaatttggcaggagactgcagacttgaactccgctcgccggacggcggagcgaatccttatcttgtttttgcattgatgatttatgccgggattgacggaataaaaaacaagatgattttgggagaacctgtaaacgtgacctataaagaagacatagaaggtcttgaatgtttgcctcaaaacttagagacggcagtgaattatgcgaaggatagtgattttctgaaaaatgttttacctgaaaatatcctgtctacttatattgaaaataagaaaattgaatatgacaaatatgtcaaggcgagagttaaggagcaatatgaacgcgatttgtatttcggctctatataataaaatttaccattaattatttgggaggttatgccgttgtacaatagaattcttatagtttcggcatctcaaaagagcggagacgcgctggctcttatattgagacggtttgctatgaataacatagattttgcgtcaagcggagttgaagccagacgtgtagttttgcgttcatcatatcagcttgttatcataaatgctcctcttaaagatgaacagggaagctctctcgcttctgattttattcacagcacacattcatcagtaatattaatagctaaatccgacgttgcggatatgcttgcttcaagagtggagggagacgggatatttgtaattccaaaacctttgcagcagagaacttttatgggtgcggtaagattagcactgggattttcaaacagatttattgagatggagaaagagatttcaaaatatgaaaagaagtatgaagaattgcgaatggtttccagggcaaaatgtgttttgatagaaaaagagggatacagtgaaaaagatgctcatagatacatagaaaaacaggcaatggacagccgggaaagtaaggcaaggattgcagaaaatattataaagaaatatttgtaatttttatatataaaaaacagcttcacaataatgaagctgtttttgtttttattaactttatacctgaggcgaatcaatggttactgtttgagttgcctcatcccatccaactgtatagccaaatgcttcagccaggaatctaagcggaatatacatacgtccgccaataccgtcatattgtttaacaaaagcagttgtatccattggtgttacaacagtctgacccatgtcagaaattctgaatatgttataagaaccttcctgaacgatatacatttcagaaccatcaagaattagagcagcattagtattctcatcatacttaaccgtcttattcatagactcagaaacaaatctgataggaacgaaagttctgtcgtcctgctcaataatttcacccatttcagccggtatctctgcaacgtttccgttaataactatactttgagccgccgcaaaagccgcttgtgaaaagcttgtcaacacacatataactgctaaaaatcccgctagttttttcatataaaactcctccataatatattgttcattaattatagcataaccgatgaaaaatttcaagggtgtttttatagttttcagataagtcatttttttacagagcgtataaaaatattatagatatatttgtaaatcaatttaagaataaacggcattttatatgttgaagtttaatgattttaaatgatgttacggagtgaaatattttatatgttatattgtagtcgctcgaataaagtgtaaagaaatgtttaggttatatctaatataaaattatataaaaacgtatggggtataagcatcgtggagattgtgaccactcctgtaagataggtattattcacaattactttttatatttaaaccttggaaagactgcaacaaactagacagaaaggttaatggtgtttttagtgaacgttagtaggatatgctagaattcctaattgttattatatcacgtgaggcttgagtacacattttatatttactaaaatctttttataataaacttttccgcggctgcgcaccttacgcggcgtgcttcgtacgcccttccgaagcttgctataccgcattattctgaaaattttttagaattaatatcttaaaaaagtgttttttggtgaacatcggcagggtgtgcaaacgcacacctcgttaggtgagctgtcatctcacgcgaagcgtgaacatatataaaaaagtttgttataaacttttttactaaataaattattccgcggctgcgcaccttacgcggcgtacttcgtacgcccttccgaagcttgctataccgcattatttttgaaaattttttagaattaatatcttaaaaaagtgttttttggtgaacatcggcagggtgtgcaagcgcacacatcgttaggtgagctgtcatctcatgcgaagcgtgaacatatataaaaaagttggttataatcctttttactaataaatttttccgcggctgcgcgctttacgcggcgtacttcgtacgcccttccgaagctagctatactgcattattttgaaaactttttagaattaatatcttaaaaaagtgtttcttagtgaacatcggcagggtgtgcaagcgcacacctcgttaggtgagctgtcatctcatgcgaagcgtgaacatatataaaaaagtttgtcataattctttttataataaacttttccgcggctgtgcatcttatgcggcagatttcatctgccctccgatgcttactatgccacaatttcagacgttattgacatataaaaaaacaatatctattaatatattattttgaacaagtatggtcggtcacacctgtttggttttcaagtaaactattattacaatatagaccatttgtatattacaaaatccaatagagttatctgatattaaattttaaattttataatgaattgttttatagaatataaaatgcccgctttatatgcgggcattttgaatagtgtcttaagccataattactatttgattttcagaattcataagatatataatcaaatattggttaccattttcgtatacaacataggaatctttgccttgagcgtcaaactttgtctgtgagtatccggcgttttttaaagcgtcaagatacttgttataagcgtccatatccatttcatatttatagtaagtattgccgctgttatcagtctctgaagctgtcatagtttttccggtaacactttcaaatttgggtatagtagactttgcatagaattcatatgttccgtctccggtcggccactcataatctttgcttgaagcggaattgccgtttctgtcggttggaagaggatcgctcacctgtccgcctgaaccgccgttatttccgtttccataaccaccgccgttgttcccgggagttccgttgtttccgtttccataaccgccgttgccgcctgaaccattattatttccgtatcctttataaccgccgccggaatcaccgccgctaccattgttgtttccgtttccatagttataaccgccgccgtatttaccgaaataatcaccgtattgattaaaaaagtcaccatattcgtcatagccgccgctgtccgggatgtttccataattatgggcgccgtactgctgatgaatacggttatcttgtgctccatatctttgggttttaaaagtgctgtagacagaaaatccaataaacaccaaaacaactgcaagagatatagcggcaatcggtatagttatttctcttccccacagttttttatgattatttggctgataagaaataggttgttcaatgtatccgttctgtgcctgtgtaactcccaaattgtaagccgcattagtaaacggactttctgtattttcgaaatggtcattattgctttgatatgtggtgctgtccttcgaataagagctttgttccttttcgtcagatcttgctattgtgccgcaggcgtcgcaatatttggcgtcatccggtaatttttttccgcaattactgcaaaacattatcctcactccgttctaatttatttaataatattcaagtttattaaaaatctttcttataaaataattatagcatcttttatctaggaatgattacataattgttaataaattattatattttttagaaataattatactattgacgcgccgctttggatatcatcaagcgttgaggttaaaaccaatttaccgtcgtgttcggctgacagtatcattccgtttgactctaaacccatcattttgcgcggaggaaaatttgcaatgaagagcagattcttcccaataaggtcttcaggtttataatattttgctattccggataatatttgtcttgtctcgcctccgcattccagttcaaatctgagtaatttggaggatttaggaacttttttgcaaactttaactttgccgacccttatatctagtttttcaaagtcatcgaaggttaccggttctttaaacggttcaatttcaggttgagtttcctgttctgcaccgaattcttcagtaagttcttcaagttttttatccaaatctattctggcaaatataggcgtggcttctgagaccttggttccgggtttagttgctccgaagtttttaaggcttgcgtatgacaactcgtcagcaccggtttgttttgctattgcagaggcagtatcaggcaggaagggctgtagaagagatgtgatatatcttatcgcttctataagattatacattacggtttttagagtttcttttccttcgtctgtttttgcaagtatccatggtgttgtttcatcaatgtatttgttagaacggtcaactattttccaaatttggtcaagactgtctgaaactctcagtgtatccatagttttgacgattttttcactgcattctatgcaagtatttgaaagtgaactgtcaaaatcagtactgttgccgggagcgggtataataccttcgaaatatttattcaccattgatacagttctgttcacgagattgccgagtgtattggcaagatcagaattatatctgtttattaatatttcataggttatagttccatcctgagcgtatggcatttcgtggagcagatagtatcttactgcgtcaacaccaaaatgttttactaaatcgtcagcataaattacgttgcctatagatttgctcatcttatcttcaccgtttaaaagccaggggtggccgaatacttgtttaggaagttcaagacctaaggccattaaaatgataggccagtatattgtgtggaaccttaatatatccttaccgattatatggacgtcggcaggccaatacttgctgaactcaggcgaactttcatcgccgcggtagcctatagcggtgatatagttggtaagtgcgtcaagccatacgtatacgacatgtttttcgtcaaatgaaaccggtattccccagtcaaaactggttctggaaacgcagagatcctgaagaccgggttttaaaaagttatttaccatctcttttttgcgtgattcaggctgaataaagtttggattttcttctatatgcttcattaagcggtcttggtaattactcattttgaagaaataagcttcctcgtcttgtttatgaacttcgcgtccgcagtccgggcactttccgtcaactaactgagtatctgtccagaatgattcacatggagtgcagtaccagccctcgtatctgcttttatatatatcgccttggtcataaagttttttaaatattttctgaacggtttcgacatgatagccgtcagtagttctaataaatttatcatagcttgcattcataagatcccaaatttttttaatttcaccggcaacacggtcaacatattcttttggggttattccctcagcttcagccagctcctgtattttttgtccgtgttcatcggttccggtacagaaacagacgtcatagcccatatatcttttaaagcgggcaatagcgtcggtcaacacaacttcatatgtgtttccgatatggggttttcttgaggtataagcgatagcggtagttatataatatttttctttatcacacattataaatctctccttaagtttattgataaatataggatagacggtctatcaatctatcggtcaccgaagggtataccgaaatgttcgtacgcggaaggagtgacaactcttcccctgggagtgcggttaataaaaccaatctgcatcaaataaggttcataaacatcctctatagtatcagtttcttcaccgattgttgcagctagtgtttcaactccaacaggtccgcctccgtactgattgataaccgtcaaaagcattcgtttatctattgcgtcaagcccatggtcatcaatttccatcttattcaatgcgtggtcagccagttctttggatataacgccgtcttggcttagctgggcgaaatcgcggactcttttcagcaatctgttggctatacgcggagttccgcgtgaccgccttgcaatttcagaggcgccctcatcgtctatatctatattcaaaatacttgcacttcttttaataatagttttcagttcatttggtttatacatctcaagacggctgataacgccgaacctgtcccttagcggagccgccaaagcaccggctttggttgttgcgccaataagtgtaaactttggtaggtcaagccgtatggaacgggcggacggaccttttcctattattatatcgagagcgtaatcttccatagccggatataatatttcttccacacttctgctcattcggtgtatttcgtcaacaaataatatgtcgtcctgtgaaagattggtgagcagagccgctaagtcgcccggtttttctatagcgggaccggaggtaatgcgtatgttaacacccatttcatttgcgattatgcctgcaagagtggttttgccaagccccggcggcccgtacagaagaacatggtcaagaggttctccccgcatttttgcagcctcaataaagactttaaggttctcttttgcttttgtttgcccgatatattctgaaagaattttaggtctgagcgtgtattcaatttcagtgtcggcattggtttccccggtggaaactatgcgttcttcgttactgtcagttattgccatatgtttcactcgtttctttattcatcatgtcggtttatgtgtttgttatgttagtataaccgttcagtatactaaagtaggttttttaatccatattttatcatttcttcggcagaccctgttgctcctttcagtgctctgcgggcttcttcaggagaatacccaagaaccaccaaagccgatacggcctcgttatcgtcatccatttcgggagagaatatttcttcagccggcatatcggatatgtctgcatctttaaatttatctttaagctcgagaatgagacgctttgcgccttttggtcctaaacctggcgtgtttttagctagatattgagcgtcatcggtcacaacagaaagagcaaattttgagggagatatattagataacaaattagcggcggttttagcgcctattccgcttactcccaaaaccatttcaaaaatatttttttcctcctgtgtggcaaatccatataatgataatatatcagatgttgtttttatattcaaataggtgtataacttcgcttttgacccgatttcacccaaagcttccagcgaggggcgggtggaatatattctatatcctatgcctccggtttctattactgcaaagctgtcagtttttaatgccagttttccttcaatataatgaaacataattatcctgcctaatctttaaaattatttgcataaatttaattataacaaatatttcagtctttagcaagcccaaattacacagttttatgtctgtaaagagaaagatacttgtttggattgttcttgataaaatgagggctaattttatgttttaaaaaattacaaaacgggttttgatttgttaaaatggcaaatttacagataaaaccagcggtttttcggtattatatagagtggtttgtaggtttgtcaatgatgtgttacaaaaaagattaaaagagttcaccgaaattgataaaagagttgatgtagtcaatgggagctttccaattcacctaacgaggcgtctgccgccgccctaccgatgtttgctgaaaattatcttattttttatagttctcagttttaattatatcatttttttttttactactatccatttaaaacggagctgataattttcgctagaaatcgaaatcactcttatatattttttcttatcgtttatgatttatttatattaaataattaattctaattagttcctaaattacagatggttttatttttacaaatatatactcatataaaaaatattttctgcaagcaacggcagggcaaatgtaatctgcctcgttaggcgcgcagtagcaaattttatttatattaaataattaattctaattagttcctaaattacagatggttttatttttttttccgcgactgcgcgccttacgcggcgtacttcgcacgccctaccgatgcttgctataccacatttttataaaatttttatatttatttttattataatatgttcacgctacgcgtgagatgtctgctcacctaacgagacgcgcaagcgcgtccttccgatgttcactaaaaaactccgcatataagaaaatatttaaaataaaatttttatatttatttttattatatacctcaacttttctatgcactttattgtttcattttcaattatttccgtatatacagtgtttatagtgaacatcggtagggcagatgtatgtgatattatggtgatataactataacacaatttatgagttttccgtattctttttttctatttgtaacacatctattgtaatcctacatataatatataacaaattaagacaaaatatattgacttatagctggtaaaagtggtataatgtcttttatatgaattgaatatataactttatggatgtgataattttgagttttggaaagattacgcatactccggtaggacttgccgatgtattatgtgatgagtatgaacttaaactgcgtatagaaaatacagcttgtacagtttttaaagattatggttatcgaatggttcaaattccaacttttgaatatttcgatgtgtatagtgtttctaccccgactcaggcggaacatatgtttaagttttttgacaatgatggaagaatgcttgctcttcgccccgatttaactacctctgtagcgcgtatggcggcaactaagccggctgccggtaaattgccgcttcgtatttcttactgtggaagcgctttcagaaatgaggaaaatttcagtcaagcacgccagcgtgaattcacacaagtcggagttgaactaattggtgacaacagtgtaaatgctgatgctgaaataattcaaattgcaatagaaacatttttaaaatccggaattaaaaattttcaaattgatttgggtcaggttgaattttttaaaggtttggttgaacaagccggcttgagtgacagcgaaagcgatttaatacgcagtcatataaatgacaaagattttattgctgttcagtctgttcttgacaatttaaatattaacagcaatatgaaatcaatgtttcagaacctagcaacaatgtttggcggaattgaaattgttgataaggctctttgtgataatgacttaaaccaacgttccaaagacgcgttaaaaaacttgaaggatgtttattcaattctagttgaaaaagatttggacaaatatgtttcaattgatttgggaatggttcaaaatatagactattataccggaattattatacgtggatttacatatggcgtaggatttccaatttgcagcggaggaagatatgataatttgctggcgaaatttggaagagacattcctgctacgggtatagctataggcgtagagcgcgtcatggcttcaatatatgatgaaaataatgacagtgacaaggaaataagcagcagcgaatacgttaccgtggctcttgctaaaggcagattggcggaattatctgtagatatatttgaaaaaataggatttgatgtaaatcaaattaaagaaaaaacaagaaaattaatttttactgatgaagaaaataagttaaaatttatactggtaaaggcttccgacgtaccgacttatgttgaatacggtgccgcggatataggtattgtaggtaaggatacgcttttagaaaacaataaaaatctgtatgaagttttagacttaggttttggaaaatgcaaaatggcagtagccggtcctaaagaaatgaaagacaggattgataaacaaaacattatgcgtgttgcaagcaaatatcctagaattgccagagaatatttccataaagttaaagggcagaccgttgatattataaagttaaatggctcagttgagttaggtccgttagttggactttcagatgtcattgtagatatagtcgaaagcggtaaaactttaaaggaaaatgggcttgatgttttggaagaaatttgtgatttaagcgccagacttgtggtaaaccgagttagcatgaagttaaaacgcgataaaattgttgatattattcaaaagatgaagggagaaataaactgttgaagatttaccccgcaatagacataataggtggagaatgtgtcagactcgttaaaggcgattattctcaaaagacaacttattcacaaaatccggttgaggttgcaaaaaagtgggaagaagcaggcggtgaatttcttcatatcgttgatttggatggtgcaaaatcaggtgatatgccaaattttgaactcataagaactatagtatctgaacttaatataccggttgaagttggcggaggaatccgcagtatggaatgtgtggataagtatttaaacgctgggattgcgagagttatcttgggaacttcagctcttaaaaatcccgattttgtcaaattggctgttgaaaaatacgaggataaaattgctgtcggaatagatgctaaaaacggtatggtagcaatcagcggttgggaagatgtcagcaatacgcctgctgttgagtttgcaaagttaatggaaagtatcggagttagatatataatttatactgatatagcaactgatggtatgttaaatggtcctaatatagaggctatggcagaaatgcttgaaaatgttaatgtaaacataatagcttccggaggtgtaactactttaaatgatgtgaaaaaacttgctgctttaggcgtagaaggcgctataataggcaaagcgctatatgccggaaatattgatttaaaagaagctattttgaaaggaagatgttaataatggaatttataaaggatttgaagttcgatgaaaaaggtttgatacctgccgttgcacaagatgcggtaagcggtgagatattgatgcttgcatacatgaacgaagagagtattaaacagacaattgaaacaggacatgctgtgtattttagcagaagccgtcaagagctgtgggaaaaaggcgctactagcggcaatattcagaatgtggttgatatgtatgttgattgtgatcgagacgctatagtattaaaggttaatcaaaccggcaatgcttgtcatactaacaatcactcttgttttttccgtaaggttgcgaatggaaagcttatagaaattcctaccggactagcagcgagacctggaattttatatgatgtttataacgtaattgttgaccgtgtgaaaaatccaaaagaaggttcatatacaaattacctatttgaaaagggcatagacaaaatgctgaaaaaagtaggagaagaagctgcagaagttatcatagcttcaaaaaattatgtaaaatcagaggttcaatatgaaacagcagatttactttatcatctgtctgttgttttggttgagcagggtttaacttgggatgatatatttattgagctgcaaaaaagatataaataatattcaaaatttattcaggaggtaataaaaatggttggaattgagcacgtgggaatattttcaaatgacactgccgcacttaaggattggtatattgacatgttcggctggaaggttgtttatgacaatggcaaaggaacatttttcttaaaagcagatgacggtggcatgattgaattttgtaagactgacattgacggcggaaaacaggatatgaaagcaaccggtatcagacatattgcaatttctgtctccgattttgacggaatggtaaaaaaacttatggatgccggcgttaaggttctgacagaagctgctgttaatccgaaaggaattggaacaatgttttttgaggatcctgacggaaatgttcttcatttgattaacagaccttctccgctataaaccatacctaagttgtttggcacaaattaggtttacaagataaaagcttgtaaacctatttgtgttttgtttataatatgtaagattttacagccaaatgatataagttaatttcagataattttattaaattaatttatattatttggtttaaaatataagaagaggaagtaaccattttgtttagtgaaatttcaaataccggcgaattaaaaaaaatgaatattgaacagcttcaaaaattggcttcaagtataaggtcttttttgattgaaaaagtctcaaaaacaggaggacatttatcttcaaaccttggagttgtcgaacttactattgctcttcacaaagtgtttgaccttgaccaaaatgatgatattatatgggatgtaggtcatcaaagctatacccataagattttaacaggcagggcaaataagtttgatatgctaagaaaatatgacggtataagcggatttcctaaaacatctgaggataaaagggatacctttaatactggtcatagctctacttcaatatcagctgcaagcggaatagctaaagctaaagagttaaaagggatttcaggaaaaacaattgcagtaattggcgacggagccatgacaggcggaatggcatttgaagcattaaattattccggtcatacaaccaaaaacttaataattattttaaacgataatgatatgtctatatcaaaaaatgtaggtggaatttcaaaagcattaaagcgtttaagaaatgcaaatagataccttaaatttaagcaagatgttaaattagcactagataatatacctgttgtaggaacaccaactaaaaaggggttaacaaaatttaaaagcgacttaaaaaaaatagtaataaatggggacagcgtatttgaaagtatgggatttacatacatgggtcctgtagacggacataactttgaagagttatttactattctggaacattctaaaacagttgaagaaccagtgtttatacatgttcatacaaagaaaggaaagggatatttacctgctgaaaaccaaccagagctgttccatggcgttggttgttttgaaccatctaccggcagaattatatgcaacaatgacagaattacatggtcagaatgctttggaaataccatgtgtaaattagctgaaaaaaataaagatttggttgcaataacagccgcaatgccattcagcacaggattggttgaattttctcagaagtatcctcaaagattttttgatgttggaatagcagagcagcatgcggtcacattttccgccggttttacaagagcaggaatagttcctgtttttgctgtttattccacttttcttcaaagagcttatgaccaaattcttcatgatgtttcacttcagaatcttcatatgatttttgcaattgaccgttcaggtccggtaggcgctgacggtgaaacacaccaaggagtatatgatatatcatatctttcaccaatgccaaatatgactattttttctcctgctttagcagaagactttgaagctatactaaatatatctgtaaatgatttaaatggacctgttgctataagatatcccagaggttctatcttataccgttcagacttctctaatgtttcttttccaaaattggaatatagaaactgttttaaggctaaggtgttagagacctataatactgttgatgtattaatagtttctgttggtgtgatgttgaaaaacgctatagaaacaaaaaaactattaaatgatatgggattttcagtttctttggttgacgcattttgtatcaaaccgattgatatttcaactataagaagagaaagcaacaaagctaaaattgttgtaacaattgaaaataatgtaataatcggtgggtttggagaaattcttcagtctcagctcgaccgctcaattgttaaatttgcttacaaagacgagccaatccctcagggaagtgtaaaagaacttgaggaaaagtatggtttatcaccgcagtctatagcggataaaataaaaaaattactaaggtgatatattgttatgggaaaacagagacttgataattttttagtagaaaacggatacattgaaactcgcagcaaagcacagtctttaattatggccggaagtgtttatgtcaataaccaaaaagcatcaaaagccggtgaacaaataaaaggtgatgaaactatagaagttagagataatggtattaagtatgtaagccgcggaggtctcaaattagagaaagcattaaaggtttttccaattgatttatccggcaaaatatgtatggatattggcgcttctaccggtgggtttacagattgtatgctgaaaaatggagccgttcgcgtctattcgatagatgtcggatatggacaattggcgtggaaattgcgtactgacgacagagttattaacatggaaagaacaaactttagatatgtaactcatgatgaaattagtgacgatattgattttttttcagttgatgtttcttttatttcattgaagcttatatttcctccagcttttaaacttttaaaagaaagcggttatggcgtgtgtctgataaagccacagtttgaagcaggaagagacagagttgggaaaaaaggtgtcgttagagatatcaacgttcataaagaggtaatagaagaagtaattagtttcactaaagagattggatttaaagttttaggtttggattattcgcctataaaaggtcctgagggcaatattgaatacttaatgtttataggaaaaaccggtgataatgcggatataaatattaatgagatagttgaaaattcacacagcttaaataatctggaataaattttggtgatatatatgaaaaagatttctattgttccaaatacacttaaagatgagaattatttggaaacaaaaaacttaataaagtatctgtctttatatgaatgtaagattttttttgaagacattcataagtctgatctgtacgatttttgtaaaaatatcggtataaattattcttttgttccacgtaatattctgttttctgaggcaaattttttaattgcgcttggaggagatgggacaataatagaaattgctgttgacgctgcaaaatatgagattcctattgttgggataaatgtcggcactttgggttttttaacccaaacggataaaggtgattattctgccataaaagatgtaatagacaataattacgggttaactgagtgtatgatgctggatataagtatcatttctaaagataatcaggaaatctgtaattttctagcgcttaacgacttgatagttacaggagattcatataaaatgataaccacatctacttctgtagatggaaccaatatggggcgttactctgctgacggtcttatagtgtccaccgcaataggttcaaccgcatattctctctcagcaggaggtgctgttatgcatccggaagttgatgcaatgattattactcctatctgccctcatacattaaaggcaagaagcactgttatacctggaaacagcacagttgaaataacacagattccgccttttagaacagaagcagttgctcgcgctgacggaaaaataatatacaagtttaaagattcatccgaaaaaataagaattaaaaaatcaaagtatacgacattattggttaaacaagagcatacaaacttttttgatgtgcttagaaataaattatctgattaaaagatgattataaaaatatcgactgaggtgagtggatgttaaccgaacttcaaataaaaaacgttgcaattattgataatattacaattaatttcggagccggttttaatgttttaactggagaaaccggagcaggaaaatcaatattaattgattcaataaatatggccttaggcggaagaacagcaaaagatttggttagaaacggaacagaatacgcattttctcaagcagtttttgaagtaaatgaaacagttgaaaagaaacttacagaatatgatatagagcttgaagataatactttgattttatcaagaaaaattaccgcagacggcaaaagcagctgcaggattaatggcagaacagcgcctctttcaatagttcgtgagattggaaatatgcttttaaacatacacggccagctggataatcaggcgctgcttgtttcctcaaaacatcgtgagtttgtagataattttgccggaaataaagatatattggctgaatatttaaataaatatcttgaatattcaaaagttcttaaaaaatttgaagaactacagcagtccgaaactgataaagaacatagaatagaattgttaaaatttcaggttaacgaaataaaatctgcttctttaagaccaggagaagaagaggagctaataaaacggcgcgagtttttgatgaatgttgaaaatataatgtctaatgccattgaggcacataacgcattgtacggagatgaaatgacaaaatcagcatacgatatgctttatgatgcaaatcaaagtcttgaaaaagctgctgagtatgatgagaagttaagcagttattacgatacaatctcttcagttcttgctgatattgacgatgtaacaagagaattaaaatcttatatcgacggaatagattatgaacctgaagaaattgatattgttcagaatagacttgcattaatatcagacttaaaacgtaaatataactgcttggatattgactctgttttagagtactgcaataaatgtgaagaggaaatagccgaaattgaaaatttagaaaatacaattgaagcaataaaagatgacgtaaaaaaatctaaagacgctttaaccgcagcagcaaaaaaattaactgaaacaagaataaaagccggggaatttttagctgaatccataatgagagaacttgctgaacttgacatgaataaagtagtctttaaagtaaagataactgaatctgattttacaataagcggatgtgatgacatagagtttttgatttccacaaatcccggtgaaaatctcaaaccgcttagcaaaatagcttccggcggtgaaatgtcaagaataatgctggcaataaaatcaattttatctaaaggcgatattgtggacactctaatttttgatgagatagataccggcgtaagcggacgggccgcacagaaaatctcggaaaaaatatgtaaaatttcaagaacaaagcaggtgctttgtataactcatttggctcaaattgcttctatgggtgatttccactatctaattcataaagacagtgatgaaacaaaaacgagaacattcgttaatttattattaactgaagaaagaaaagatgaattatcgagaattattggaggggtatctgtaacggatactactttaaaagctgccgaagaaatgcttcagcaggcagaaaatcttaaagattcttttatataaaatatatttacaactgagtaattattatctatttgacaatatgattgaaatttattataatgatacaataaaattaaatatataatcattgggtaatgacaatattattataaacgaatttaaaccgaggatattatttatatggaacaaacaggatatgtagttgaaataaaaaatggcgttgcaaaaattagaattgaccgtgaatctgcctgcggaggaaaatgtgtcagctgtaaaggatgcccttcaaatgctattattgtagaagctaaaaatgaactcaatctcaataaaggcgacatagtaacgctatatgaagatacaagaaaagttatgaaatatgcttttattggctatggtcttttagcgattttgttagttgttggagccattgtcgggtatgttttaactaagcgtgacattatggcactagtgtctgctgcattatttgttgcagtcggttttttgattattaaattttcgtttaggaatatagacagtgaatttaccataaagtcagttgaaagacaaaatattgatgaataactgggagacagaatgaaaaatgatgctgtgttttataatttaaataaagatgatgtaaaacgcataaccgtgattaccgggcattttggaagcggtaaaacggaatttgcactcaattatgctttggcgcttaaagaattaggacttgatgttataattattgattttgacattgtaaacccatattttagaacaaaagatgcagaacaatttttattaaatcaaaaaatagatgtaatttctcctgaatttgcaaatttgaatatagaaaacccatatttacctcctgaaattttgcgcgcttttgatgataaatcaaagtatattgtttttgacgttggcggcgatgaagatggagccacccctttaggagtttataacgaacattttctaaaagaagaatatgatatgttttttgttttaaacgaaagacgtcttcttacgcagagtgtagatgatgctttacaaatatataatgaaattaaatatgtttctagactggattttaccggtatagtaaataatacccatttaatgcagtacactaataaagagattcttttagagggtcagaagttagcggagaaattttctgttaaaacaaatattccgattaagtttataaccgcaactcctaaaatacttgcagaaatatccgagtattctgatataaatacttataattgttttccgctaagactttttgttggtcctggattttaatataaactataaaattatggggtcattcccttaatatattgtatgataatctgtatagaaagaaggaagaaatatgccaaaagttagttttagacaagacaggtgcaaaggctgcggactttgtgtgtctgtctgtcctaaaaaaattattgctattgattctgctgttttgaatgataaaggatatcatccggcaggagttattgatatggataaatgtattggttgtgcgttttgtgcaacaatgtgtcctgattgcgtaatatcaattgaaaaataaggagatagataaaatggctaacaaggttttaatgaaaggtaacgaggcattggcggaagctgcaatgcgctgtggctgtagatttttctttggctacccaataactccccaaaccgaacttgccgcttatatggcaaaaaaaatggagaaaaacggcggaacatttttacaggcggagagtgaagttgcggctataaatatggtttatggtgcagcaggcgcaggcgcaagggttatgacgtcatcatcaagcccgggtatcagcttgaagcaggaaggaatttcatacatagccggagctgatctgccatgcttaatagtaaatatagttcgcggcggtcccggtctcggcggaatacagcctgctcaatctgattattttcaggcaaccaaaggcggaggtcatggagactatcatctattagtatacgcaccgtcttcagtccaagagcttgctgatttaacatcaaccgcttttgataaagctgataaatatagaatgccggcaatgataatgggagacggaatgctcggtcagatgatggaacctgtagagtttaaggagtatattgaccctgaaagtcttcctgaaaaaacgtgggcaactaccggaacaggtatgaaacgtaaaaagaatatagttaattctttatatcttacgccggaagagcttgaaaatctttgtatcgaaagagaaaaaagatataatacaataagagaaacagaatctttatatgaagagataaatacagaagatgcagatttaattattgttgcatatggaacgattgctagaattgcaatgtctgctgtcgaagaagctagaaacaatggtttaaaagttggtttaatccgacctattacattatggccgtttccggcaaaagtttttgaaaaacgtgcggaaacagctaaatcattcctttgcgttgaaatgagcatgggtcagatgatagaagatgttaagctttctgttaatggaaagaaacctgtttatttctatggaagaaccggcggaatggttcctcagcaggacgctattcttgaagaaataaaaaaatgtcttgatgcaaatgcataacataggagatgaaaataaaatggaaaaaatatttgatagaccacactcactcagtgatgtagtgctctcatattgccctggctgcacgcatggagttattaacaggctaattgcagaagtggttgatgaaatgggacttgaaggtaagaccattggcgtatgtccggttggctgcagcgtaacggcttataacttttttgaattcgatatgcaggaagcatcgcatggcagagcgcctgctgtagcaaccggtattaaaagagtacatcctgaaaatcttgtatttacatatcaaggggatggcgatttggcggctataggtactgccgaaactatacattctgctgccagagccgaaaatatcacaattatttttgtaaataatacaatttatgggatgacgggcggtcagatggcgccaacctctttagtgaatcaggttacgcaaactacgccgttcggcagaaaagtagaaaatcagggatatccgatacaagtcagtgaaatggtgtcaacattaagaggcgcctgttacgttgaaagagtatctgtagataatgttcccaatataaagaaaacaaagtccgctatcagaaaagcatttgaatgtcagatggcgggattaggattttcactggtagaagttctttcaacttgtcctacaaactggggtatgtcaccggttgaagcgcttgaaagaatacgcactgaaatgatgcctgaatttcctttgggtgtttataaagactgcactaagaccgggggtgttagataatgtatgaacaaattgttatagccggatttggtggtcagggtgttttgtttgttgggaaaactttggcttacttaggaatggatacaggaaagaatatctcttggctgccatcttatggacctgaaatgcgcggcggaacatgcaattgcagcgttataatttcagataatcaaattggctcgccaattatccagtcaccggatacacttattgctatgaataagccgtcacttgagaaatttgttgatactgtaaaacctggtggtataatagtattagacagctctttgatagacttaaaagttgagcgctctgatgttaaagttgtatacataccggctatggaaattgctgaaagtttcggaaatagccagcttggaaatatggttatgaccggagcttatataaaagctagagaaacaatgttttcagcagatgacttatatgacagcgtaaaaactcatattccccctcaaaagatgaatttggctgaaaaaaatattgaaatgataaaggcaggatacgaatacgataaatgttaatttcaatttcaaatcttagtaaaagttttggagaaaatcaaatattaaaagatattaatttgaccatagaggataattgccgctatggtcttattggcgtaaacggagccggaaaatcaactttgctcagtataattatgggagagctagattacgatgacggtgatatatataaatctccaaatttgacaatcggatatttgaagcagaatagcggtcttgacagaaactccacaataatatcggaaatgcgcaatgctttttctgacattattaaaatcgaggatgaactaaggcttatcgaggaaaaaatgctttcatattcagaacataattcatcggaatataaaagtttaatgtctgaatattcaaaaaaacagtcttattttgagagtatggacggttataatattgacgtcaagataaaaacggttttaaatggactgggattctcagatagaagcctagagacagaaataaatgttttatccggaggggaaaagacccgacttgcattagcggctctcttattggaagaacccaatttgttaatattggatgagcctacaaatcatttggattttaaaacccttgactggctggaaaattatttgattaactcctacaaaggttcgcttttgattgtgagccatgacagatattttcttgataacacagtagagaatatgttggagatagagcgtggtaagatgtattcttataacggaaactattcaaaatatttggttcttaaagaagaaagaaatgaggttttgagaaaagagtatgaggcgcagcagcttcaaatttctcaaatgcagacatatatagataagaatataaccagagcttctacgtcaggaagcgccaaatcaagagtaaaagcacttgagagaatggaattaattgaaaagccggatgatgatattaagcctattaaattaaagtttgaaactatcaaagaaccctataaagatgttttaacagttgaaaatctagacattgctgttggagatagagagtccgccggcggtattaaaaatatttgttcaggtttaaacctcagtattaaacgcggagataaggttgctctgattggagataacggaattggcaagtcatcgtttctaaaagtaattcaggatataattccccaccaaaacggttctgtcgtttggggaaaaaacacaagcgtaagttactatgagcaggaaaatttaaatttaaatcccgataatctagctattaatgaattgtgggacagatttccacgcattccggaggctcaaatccgaagagttttaggaaatgttcgacttacaaaagaagacgtttataaacctgtaaaagtaatcagcggcggagaacgagcaaagctagcgttctgtataattatgctggaaaaatcaaacgtcatattatttgatgagcctacaaatcatctggatttaccctcaaaagagatattagaacaggctatgaacgagtatgacggcactttattgtttgtatcgcacgacagatatttactcaataaagtgccaaacaaaataattgaaatgaccaaagacggttttacaatttatgacggaaattttgggtattataagcaaagaaaagaatggattaaacagaaacaatctatagaaacaaataataaagttgaaacaaataattcatcacaaaaaagcagcggaggatataggtctaaggaacagagaaaagcggaaactaaacgaaaacttcaaatcgctgagcttgaaaagatgatttctaagactgaggaagaaatttcagcgcttgaaaatgaaatgacaaaggaagaagtattttcaaattatattttgatgaatgaaaaaaacagcgagcttgagaaattaaattcaaatttagaagagtattatgacaattggaccaaactgtccgaagaacaagaataaaattatttgttcttcggaccttgactttcaatttctgataaaggattttgggcaacagcctctctaatttgattattgtttacatgagtatatatctcggttgtgctcaattgtttatgacctaatatttcctgtaatattctaatatcaacacctgattgatgcattaatgtagcagcagtatgccgcaatttgtgcgtagtatatttatgagaatccattccaagctttttaacatatttttcaactatatgctgaacggttctccggctgattcttttgtttctttcagataaaaataatgcgtttttatcttttgattcaggtgacattttttggcgtatttttaaatatgacttgattgctgatatacatgaattattaagatatacagtgcgctctttatttcctttacctgtaacaactaattcgtccccacgtatatctgtaatattaattccaaccaattctgcaagccgcataccgcagtttaagaacaatgtcaaaatacaatagtctcgttcataatttcgttcatcaacagcatttaataaattaatactatcctgaagcgaaaaatattttggaagcgagttttcaaatttaacagaatccaaatcagctgtcggattatcatgaagcaacttaactttgctgcacaaatatttataatacgatctcaatgacgaaatttttctggcacgtgttctagcttgatttcctaagtctcgatttaaaaaatcagcatattcatacagcagatttaaatcgactttttttaaataatcaatattgattttatcaatgtcaatttgattaaagtcattatttgaatttacaagattaaagtgtaaacataaaaatctataaaatgttctaatatcataaaaatactcattaactgtttttcttgatttgccctgaatactttcaagataaatcaagaaagaatgcaatggttcaggcgcatatttaatattgtccataataatcacacatttccttttattattttcatcttccatcttttgtcacaaaatttttattttgtgaaatgttctatttttattatatacctctactgattttatttccagtatttttagattaaaattatattacaatttatcttttaattttataacttgttgctattcaatatctgttaggatataattataaaatatacaattataataattttaaagcaggtacacatatatgataaaaattgaaggaattattgatacagtgattttttataactctgataatggttatgcagtctgtgatgtatcatgtattggcgagcttgtcacaatgactggaactatgccaaatataactgagggtgaaaaaataattgcttcaggtgaatggacaactcacgttgactatggtgatcagttcaaagttgagtatattgaacgcgtaatgccatcttctgaaagtgaaattgaaaaatatttagcttccggaatcttaccatatgtaggaaaaatgactgccaaaaaaattgtcgaaaaatttggcacagacgcacttgacgttatagaaaatgaccacgaaaaactgcttgaaataaaagggctgacaaaaagcaaaatcgaggatatttataaagcatttgttgagcaaataggtatcagacaaattgttatgttttttcaaaaatataatgtttccccctcttctgctgttaaagtttttaaaattttcggcactggaactatacctttggttcaaaataatccgtatattttagcagaccaaattgatggaattacatttgataaagctgatgaaattgctatgtctttaggatttgaaacgaaatcgtatgttagaatagcttccgggattaagtcaattattaaacgtatttcttttttgaacggtcatacatatcttccacggcctacaatcattgcccaagctgtttctatgcttgaagttgaacagggacctgtagaagacgcaatttctcaattattacttagcggcgaattaatatctgaaaaccagggtgattatgacgcaatatatttaaaacttttttatgacgctgaacgtgaggttgccgaaaaactaataagaatgtccggcgtaacatttgatatagatataagtcaaattgatggtttaatagacaaagtagaaagcgaagatagaattgaacttagtgaaaatcaaagagaagctgtaagacgtgcctttcagactgcagctttggttatcacaggaggccctggaacaggtaaaaccacaataataaatacaattatcaacgcaatgaaaattgaacataacaaggttatgttagctgcaccgacaggaagagccgcaaaaagaatgagcgaagtctgtggatttgaagccaaaaccattcaccgccttttagagattacaccgggagttgacgaggttggcagctgttttgcaagaaactcagaaaatccgctggattgcgatgttttaataatagatgaaatgtcaatggtagatattatattaatgaaacatttgactgacgctttatcctccagaacaagattgattatggttggagacagtgaccagctgccttctgttggagctggaaatgtcttgaaagatataattgacagcgacagcattgagtgtataaaattaacagagatattcagacaagcaaaagaaagtatgatagttgttaatgctcaccgtgttaataatggtgaagaacctcttttgaatgataatgacaacgattttttctttgttcacagagatgacccaatgcagcttccgaatactatagctgatttatgcgtcaggcggttaccacgatattatggattagatggtataacgcagatacaagttttaacgccgaccagaaaatctttgataggagtacaaaatttaaatacaattctgcaaagctgtttaaacccaccatctcctgacaaaaaagaatatataacaagacgttgtattttcagagttggcgataaagttatgcaaataaaaaataattatcagcttgaatggaaaagagatgccgagaaaggtttaggagtttttaacggtgatgtaggatttataatagatattgacagcagagcacaaaaaatgactattcagtttgatgataaaatagtcgtttatgattttttattactagatgaaattgagcttgcctacgccataaccgttcacaaaagtcaaggaagtgaatttgatgcggtagtaatgccaatgtttgaaacacacagacttttgatgacaagaaatctattttatacggctataacaagagctaaatcacttgttgtattggtcggtcaagaaggcgttatggctcagtatgtgaataatgataatgttcaaagaagattttcaggtttaaaagataaactaaaaatattttaattttcaaaaaaataggagatatatagatggaacaatacgcagcgccactaagagaattaatagaagaatttaataaactcccggggattggaaataaaacagctcagcgtctagctttctatgttatgaacctccctgaagaaaaatcagctaaactagctaacgcaattattaatgccaaaaagaacattagatactgttcagtttgtcaaaatctatctgaatctgaggtatgcaatatatgttcaaatactgcaagggaccacagtataatttgtgtaatggaaagcccacgagacattatgcaaatggaaagaacaaatgaatataaaggcgtttatcatgttctgcatggcgctatttcacccatggataatataacgcctgacgatattaaaataaaggaacttgttgcaagggttgcagagggcggtattaaagaagtaataatggcaaccaatccaaatttggagggtgaagctacttctatgtatatatctaaactattaaaaccttttggggttaaggtgacaaaaattgctcatggagttcccgtaggcggagaattagaatttgcggatgaagtaacgcttggaaaagcattaaactggcgtgttgaaatatagttgaggtgaaaagttttggagaataaatataatataaagctagctcaaacagataaagagattgaacaaattgcaaagtgcgctgaaattacttggcattacgcttatgataatttgctgcctgacggtcaagtagattatatgatagagaagttccaaagttttgatgtattaaaaaaggatatcaaaaataatgattatgtatattatattattcaagaagatgatgcagtaattgctttttgcggaataagaccggaaaatgataagttgtttataagcaaaatttatgttgatcccaaatatcagcgtaagggtcttgcgacgaaactgtttaacaaagttttaatagaatatagagataaatataaactattttatttaacagtaaataaaaacaatactaaagcgatatctgcatataaaaattttggttttattataactgacagtactaaaactgatattggaaataattatgtaatggacgattatattatgacttataataattaaattacttatattattttaaaatttatattaaaaaagcgaagataaatctctttaaaacagagaatcttcgcttttttatttattaacatccagcaattgatttatacttttttatccaacactgtttaaattaaaagataactttttttaaaatgccaaatgtagggttcttttttctaacacattaatatattattttattggcacagttggtgcatttgtgtttactgtctgtatttcttgagttagtgcagcttggttgccgtttggcagaagctgactttcatttcccattggttgagtaagcataaagcaaaataccagcgatttagctgctttagctcgggttacctctatctttggttcaataattttaccatttgaaacagagcctctagcaattccgctctcagttctgataagacctagattatacgcctttttgagtttttgataaaggtcagtattaatcgctgccttatcatctagtacgccccaaccggtaagcggtatatacggagtaccttcatacttgatatttggatcataattggggtcatcaggtgatggaacactgccattttgcgctatatacatatcaataattgatttgtccgctttttgatatgcatcatagagaattgctcccatcacttcacgggtaagagctgcgtcactagcaactatagtgtcttccaccagaggtggttccgctgtgaattcagctgttacatttgaatctttggttgcagtaaaggtggcctcttttgaaattccaataacctctccatctactaagattgatttattaatataatactcgtttggcaacgcaacaactttgattttgtcattagcctttgcaactagtgaagttgtgctatgcggatagtcatttgactcatattgaataccaaacaatcttcctgtgccgccatttgtataaacttgatatgtctttccagctttgacatcaaaagtcacagcgttatatttattatcttttgttgtgccggcaatagtagtattatttatatactttgtagatgttgtaccgtctgttttattttcacatgtaattattttatggtcaacaaacataagataaagtgtgagtacaccgtcttcctttgccacatactcaggctgttttgttccgttattacgaatttcaatagccgatgttgtaatatttttgtttaatgcaaacacaccaccattatctaccttcttaactatctccgacggagccttaaatgtatagtattcattatctcccagtacagagtttgctgttaccttacttgtaatatcagtagttgctgtgtgaaattcactctcattatagaccgttacagtaccgcccgccgccggttgtgttacattgattgtaacctcaccttcagcaagttctgtactattatctgatgaaaccgaaactgccgttgttgacacttctgcgttctttgtttgcagttcagcatatgttttattgtaattagtaagtgaattttcttctagaccaaatgctttttcggctccccttgcaaattcgccaaccgtaatcgtttgagttggtttaaaattgttattgctgtccttatggagcaaaccaacttcaagagctttttcaatatttggcctataataataattgtttttgctctgtttaaccgcaccgggaattatgccaactgtactcacatctgacgccatttcgggaaatacagcagaccaattgcctgattttgctgcttcctggacattttcaggcatgtaacttaccaatttttgcattatctctttgtctttataaatgtcatcagcggaattagcctggtcatatatgctttggagcataattctgcaccactgctttgctatagcttcacgataatgtgtaccgtctcctcttgttccattagctgcattgattgcaggagtttcgcctgcctcatatgtgttatagatatagaatatctcatttgcatctaaactatcaatatacgcttttgcaccactgtaaagctcaaccaaaccgatttctgaatccgaagcggccttttcacgcatattacctggagaatcaggatcaaatccattaggttttttagagctttccgaatatcttccgctgccggttctcggcattgctgtaacaagtacaggcgtcataccgcgttcttttatagctgtcatatacatatccagccacttattatagtttgcattattggctgcaagatcgccttcttttacagaagaaccacgttcgtatctatctgtgcttacagtctcgtcattgtgtgctgaatgtataaatacaaaatcgccgactttacctctgataagaatttcgtcaaatctgccttcatcatagttactcttcatagcacggccgcccattgagtaattaacaacattaaccttgtttaaatcaaaataatttttaagtgtttgtccccacgaacttatagtttcgttgaaactgtaagccttttgagtagagtcacctaagatatgaattgtcggcttatcacctgtcgcattattttcaagcggcgtcactttaatttttttaataccaacagtcttcggagatgattctgatggcagtttggaaggttctacatcgatttcaataaaattttcccctgtaccaaaatcataagaccatgtgtttccattccattgagcacttactgttctcggaacctgaccgcagttatcccaattacttgtacttgtcagacgtgaggcctgcatacctgtaggagcaacccaagtatccgctgatgtgcctgttacctcaacttctatatgatatgcacccggcttcccggtgtcaattctgtaaataagaccgccgtaattataatctttatcaccaccataatgcaaatatgagcctgttgtttctgtaactgtagctccattatctgatgaaatcttaatattatctgtcgctcccacctgtctcatataagattccggcattatggtatgtgatttatcaacaaacccctgaccattatctttattatacaccgggacttcacttaattttgtgaaatctattgttacttcactaacaggttcagaactatccactgtttttatattgctgagtggtataatattgttagttccatcccaaataaataatttagttttcccgctttcaggtttatagtaatccaatacttcttctcctacggttcctatatcaaattttgcacaatcagttataattttttcactgctatcctcataagttacaacgaacaatactgcattgcttaattcaccatttgaagtataactaatatatagtttaccggcatcattgaaataagcctcactaataacaaaaacatttgagttttcagtttgttctgctaatactgttacgcctgcaaaaactgtaaaaacaaaagtaatcattatgacaaaactcagccatctcttttttaacattttgcttcctccttttcccgtaagggttatatatttgttcaaattatagcacattcacatataaaatcaatagccaaacgtcttatagtttttaataccagtttacaattattccgtagaaagtacagtttatttgtacaaaagagatgtataaaaaatatttttttaaatagtttttaacaaaaaacagctttttactataaatgcaaaaagctgttctaaaatatattatttaatatgtgaagaaattattttataccaaatcttaattttacaaaatcacaaattatctttgcagtgtcatcaataccaagagcggaactgtcaaccgatatgtggtaatttgtaacatttccccactcttgatttgtataaaagttataataattactcctctttttatcggtctttttcattgtttcaagagcttctttttctttttgtttatagatgcgcataacgcgttctaatttaaactcttcattagcatgaataaaaatgtttacaacattatcttgatttctcaaaacatagtctgaacatcttcctactataacgcaggaattatccttaaccaaatcctgaataacctgagactgaattctaaaaatagcgtcagaattcaaaacatcgccatatctataaaatgaatttctatcggattgaagacccataactaaagaatataataaactattagttggcttttcatctataccttcaaaaagattttctgaaagcccgctttcttttgctgcaatagcaataagacccttatcataaaattctattccaagcatatctgctacttttttagcaacttttctgccgcctgaaccaaattgccggcctactgtaataacataatttttacctgcttctactttattcatatcatttcccatattatttcctcctaatacagatgattttaacatatttttttatttaatgcaaattataattgaaaatttattgtataaaataaaactaaaacttttgtacatatttaccaaataaagttttagaattcccaaattattatatctttaattcttcagatgttttcttgacattattcttaaagtatattataataacttagttgtataaatttataaatatacaattccttactcctatatttataggggtcaaagtccagaaggaggtgacaaatatggcagaacatatcaacaagtatgagactattatggttttagactcttctaaaacagaagaagaaatctctgcattgcttgaaaagttcaagtcattgattgaaaaacacggcgaaatcgaaagtgtcgatgagtggggaaagcgtaagcttgcttatccaatcaatttcatgaatgaaggttattatgtattggttaactttaaatcaaaccctgatttcccgaaagaacttgaacgtgtttatggtatcacagacggcgttttaagaaacatcgttgttagacgtgaggaggactaattatgattaataaagtaatcttaatgggaagactcactcgtgatcccgaagttagacacaccagtacgggaaaagctgtttgtagtttttctatagctattgataatggatatggtgaaaacagacagacagatttcatcaactgcgttgcgtggcaaaatcaagctgagtttctcggcagatatttcacaaaaggtatgatggtgattgttgcgggccgaatttcgactcgtacttgggaaggtcaagacggaaaaaagaattatgttactgaagttatagcaaatgaagtgaactttggtgaatctaaaaagtccagagaagaaaacagcggttattcaggaggatataataatgctccgcagcagcaagcatattcttcttatggtgcagagcagcagtcaaataattatactgctccagctcaacaaatgcccggcggacttgaagaagatgaatttactccgttatctgaaattgatgacgaccttccgttctaaaatttaaagttaaggagagtttaagatggctgaagaaagaagaaacgacagaccccgcggcagacgtcctaagagaaaagtttgctcattctgcgttgataaagttgattacatcgactataaagatgttgcaaagctcagaagatatgtaacagaacgtgccaagatacttccaagaagaatcagcggctgctgtgcaaaacatcaaagacagctgacagttgctattaaaagagcaagacagattgccttgatgccttatacatctgactaataaaatatttcggctcaggttctgcctgagccattttttataaaattatttaaaactattgtgtttttaataaaaataatgtaaaatattatttatataaataatattaatttttactaaggagaactgattatgaaagtacttgtaattggcggcggaggcagagaacatgcaattatttggaaacttgcccaaagcaaaaatgtatcaaaaatatactgcgctcccggaaatggcggaattgcggatttagcagagtgcgttcctatagatgtcatggattttgagaaattaactaaatttgctagagaaaataatattgatttaactgtcgtggctcctgacgatcctcttgcagcaggcgcagtcgatgcttttgaagcaaatggtttaagagcttttgggcctaataaagctgctgcactcattgagggaagcaaatcattttctaaagatttaatgaaaaaatataatattcccactgcagattatgaagtgtttgaaaacagtacagacgcaataaattatattaaagcaaataacaaattcccagtcgtagtaaaagctgacggtcttgctttgggaaaaggagttataatagctaaaacatttgaggaagccgaaaatgcagttcatgacatattagatgataaaatttttggtactgctggtgctaaagtggtaatagaagagtttttaaccggacctgaaatttctgttttagcatttaccgatggtaaaactatgaagccaatggtttctgctcaagatcataaacgtgcttatgacaatgatgagggacctaataccggcggtatgggtacgttttctccaagccgagtttataccgatgaagttgcagaagaatgtatggaaaaaatattcattccaaccatgaatgcaatgaatgcagaaaatagaacttttaaaggagttttatattttgggctcatgaaaactgcagatggcgttaaagtaatagaatataactgtcgtttcggtgaccctgaaacacaggtagttcttccacggttaaaatcagacttatgcgaaatatttaatgctgtaatagaccagaggcttgatgaaatagatattgaatggaacgatgatgcctgtgtatgtgttgttatggcttcaggcggctatcctaaaaactatgaaaaaggatataaaatcgatggtataaaacaagcggagagtttgggagcacttgtattccatgccggaacaaaacgctccgataatgatattttaacaaatggaggccgagttttaggagttacagctctaggagataatcttgaagacgcaattcaaaaagcatacaaatatgttgatttagtaaactttaagaatgcccactttagaaaagatattggaataaaaaaagaaatctagttaaaaaacttactatcatatttttctgcagtcagtttccataaacaggagactgacttttttatatttaataactaaatctgatatgtatcaacttacagcaaaatataatttgatttttttatacatcttcttctattactatttattctttctatgtttatatatttacataaaatttatgtcttgtgaaataataacaatagattataagaaagctaggtggtattatggatcaagaaaaacttcctgttaaaaatgaccgaggttactatgaaatacgactagagagcattggcggactgggagctaatctttgcggaaaaatgttgggagagctgggcgttacatgccttaagctgaacgctgccagtttttcaagttatggttcagaaaaaagaggttcaccggttaaagcccatattcgatggagcgagccggatgttgagattcagcttaacagcccgatagagtcaccgcatatattggggctttttcacgaggcgatgacaggtaaagttcccgtaacagccggattaactgaaaaatcaaaggtcgttataaatacttcacgctctccagaagatatacaaaaagctttaaatctttgcggcggagagatattttgtatagacgcacaaaagatagcaatggaaagtaaaactagaataaatatggttatgcttggggcaatatgtaaagcgtcaaactttgttcctttagacgctgctataaaaataactgaagaaactatcggtaaaaaatatccggatttaatcgaaaaaaatattgatggtgtacgacgcggatataatgagacgatttctaagttttttgagcgtaataataaaatagaaccactaaaatataaagaagcagaaaatcgctggggatatgaaaatgcaccaatcggaggtatcaataccaggataggcagcaccgtatcaaatgatctgtcagcctccagagaaggttatattcctttatttgttcaagaaaaatgtataaactgcggcttatgtgacactacatgcccggatatggtgtttcagtttatgcctggcacctacaaagaaaaaccggctatggttaatatgggcttagattatcaccattgcaaaggatgtctaagatgcgttgatgtttgtcctacaaacgctttagttgccggacttgaacgtgaacatccgaataaaaaatggtttgtcagaaataaagatttgattgtagataaattggaatatgaagatgcaggcgcaaacagctggattaccagcgaagcttatttgaatgaaaaaagagtggatggaggtattgtatgagtaaacaaaaacttttatttgaaagcggtaatgaattagccgcatatgcagcaaaacagattaattaccatgtaatgggatattatccgatcacaccatccacacaaatagcggaatatttggatttaatgaaagctaatggtgaacatgatatatctcttattcctgccgagggagagcacagtgctgcaggaatatgctacggagcgtcaaccggcggcggaagagtttttaacgcaaccagcgcaaatggacttttatatgccttagaacaattacctgtgcaatccggaacacgtttcccgatggttatgaatgtcgcttgcagaactgtatccggtcctctttcaattaaaggagaccacagtgatattatgtacactcttaacaccggatggataatactttttgcaagcactcctcaagccgtttatgattttaatatttgtgctttaaaaattgctgaaacggtaaaattgccggtcatagtagcttttgacggattttttacaagccaccaaaaacgacgttgttatgtatttgaagaagataagaccgttcaagattttataggtaaatataatgcagaatattcggcacttgatttagaacaacctgtttctatcggctcctatatgaatgaacctgacattttaaataataaatatcagcttcatatggctatggaagatgctagaaaagtaatacctgaagttttttcagaattttcaaaattatctgaaagagaatatcaattcactgaaagttataaaaccgatgacgcggaagttattttattcttattgggttcaagctatcatacagcaaaaatggctgtggatatattacgtgaacaaggaaaatcagtaggagtatttacatcaaatgttctaagaccatttccagcaaaacagcttgctcagaaatgcaagaatgcaaaaacaattattgttggagacagacaagacagttatggagctaacggcggaaatatgacgctggaaataaaagcaatgcttcaagacgcaaagttagatacacgtgttatatcaagaatatatggtcttggaggacgagacttttatgttgaagacgctatagaatttttagaagccggattagattcacattctaaatcatttgactataagggaatatatccgggcgatatgagtacgcctaatactcaatactttaatcctataaccgacgaagaatccagccccggtctaacaacatgcaaatggaacgatgataagcagaatatggaggtatcaggcggcagaataaatgaaactacaaaaatgccaaaaagacttgctcccggtcatggagcgtgtccaggctgcggaataccggtgaatgtcaatttacttctgagaggtatcgaaggaaacgttgtactgctgttccatacgggctgcggcatggttgttacaaccgcatatccaaagacttcttttaagattccatatgttcataatcttttccaaaacggagctgcaactttatcgggtcttgttgaaatgtttcatcagagacaaaagcgcggcgagtatccgaaaggagaaattacgttcataatggtaagcggtgacggcggcatggatattggaatgggaagtgcaatcgggactgcgttaagaaataatcatattattctatttgaatatgataacggcggatatatgaataccggttatcaattgtcatattcaactccaaaaggcgcaaaaagttcaacttctcatgtaggtgaatatcagtacggcaagtcattttttaataaagatatgcctcagataatgtctgctacaggtattccatatatagctactgtggcagaatcaaatccagcggatttcataaaaaaagctagtaaggcaaaagcgtattcacaggaaagcggaatgtcttatttacgtgctctttctgcctgtcctttgaattggtctgataagccaaacctagaaagaaaggtaattggagctggcgtggactgctgctattttcctctatatgaaatagaaaatggaataactaatataaattataatccagaagataaaaacaagaaaataaatgtacttgaatggctgagtatgatgggcagaacaaaacatcttaaagataaaaaatataaatatatagtagatgaaattcagggggaaattgaccgaagatgggaaagattaaaagctcaggattcaaatccgcttttgtaagaataaaaataaaatcatgtatattttaacagcaattacaaataatagatatataaaataactggaggtgagaagatgagtccaaaagaattactttatattgaagacgctcttggccatgaacaatttttgaaaacgcaatgccaggatactgccaacaatcttcaagacggcgaattaaagaactatgtttcacagcttgtaatgaagcatgatgaactgttcaaacaattctataatttagtgtaacatagcgctattattgatgaactcgttaacagagaaaggatgaaaataatatggatgataagaaccttatggaaagtttgctgatgtcaacaaaaggagtatgcgacctttatatgcatggttcaattgaatcgggaacaactaatgtaaataactcatttaataaagcattaaatgacacattatgtatgcaggatgaaatatataagaaaatgacagcaaaaggttggtacccaaccgaacaggctgaccaacagaagataagccaggttaagcaaaaatttgctgcacaagcgtaaaaatatataaataatataaaatgcactttcattgatacgatagtttaaatacatcgacaataaaggtgcattttattattcaaaacaaaaacgccgtataaatacggcgtttggcaccctctacgtgagtcgaacacgtgactagcccttaggaggggcttgttatatccacttaactaagagggcagattaaataatcaactgtttaattatatacaaagtgacctttattgtcaagtgaaaaatataaaaatttcatgctttactgtaggattacaatagatgtgttacaaatagaaaaaaagaatacggaaaactcataaattgtgttatagttatatcaccataatatcacatactctcagatggttgaaaaacaaatagtgaaaaagtcttttgaaattgagtttcctcaatcatcgaccttaggatttcttggctaacttccgttacttccttccgcttccttcttccataattttcaggctcaatgccttactctcttacttccgctctccgcttccgttactcttctcagaaccaaggggtctccttagaaaggaggtgatccagccgcaccttccgatacggctaccttgttacgacttcaccctaattatcaatcccaccttcgactgcgctctccctaaggttaagctacaggcttcgggtgttatcgactctcatggtgtgacgggcggtgtgtacaaggcccgggaacgtattcaccgcagcatgctgatctgcgattactagcaattccgacttcatataggcgagtttcagcctacaatctgaactgagactgctttttgtgttttgctccacatcactgctttgcttcactctgttaacagccattgtagtacgtgtgtagcccaggacataaggggcatgatgatttgacgtcgtccccaccttcctccgatttgtcaccggcagtcctgccagagtccccaacttaatgatggtaactgacagtaagggttgcgctcgttgcgggacttaacccaacatctcacgacacgagctgacgacaaccatgcaccacctgtctccacgtcccgtaggacttcacctatctctaggctatgcgtgggatgtcaagtcctggtaaggttcttcgcgttgcttcgaattaaaccacatactccactgcttgtgcgggcccccgtcaattcctttgagtttcaatcttgcgaccgtactccccaggtgggatacttattgtgttaactgcggcacagaaggggtcgatacctcctacacctagtatccatcgtttacggcgtggactaccagggtatctaatcctgtttgctccccacgctttcgcgcctcagcgtcagttatcgtccagaaagccgccttcgccactggtgttcctcctaatatctacgcatttcaccgctacactaggaattccgctttcctctccgacactcaagatatacagtttcaaatgcagccccggagttgagccccggtatttcacatctgacttgtctacccgcctacacgccctttacacccagtaaatccggacaacgcttgccacctacgtattaccgcggctgctggcacgtagttagccgtggcttattctgtgtgtaccgtcattatcttccacacttaaagaagtttacaacccgaaggccttcttccttcacgcggcgttgctgcgtcagggtttcccccattgcgcaatatcccccactgctgcctcccgtaggagtctgggccgtgtctcagtcccaatgtggccgatcaacctctcagttcggctaccgatcgtcgccttggtaggcttttaccccaccaactagctaatcggacgcgagtccatctttaggcgataaatctttgattatcataccatgcgatacaataattttatgcggtattagcatccctttcggaatgttgtccccctcctaaaggcaggttactcacgcgttactcacccgtccgccgctttccatccttatcttctccccgaaggctgccgttcgtataaatcgggttgcagcgttgttccaaaggagaattcttatgggaaaagaagcatttgatttctttcctttagacgtgcatcttagtgataagatggagcttatagaagcagaattcgggttaatagggtttgcggtaatcgttaagctgtggatgagaatatacggcagcagaggttattactgtgaatttgatgaagaggttgcattgatgttttcccacaaaacaggggttggtgtcaatgccgtttctgaaatattgaacgcagcatttaaaagaggtatttttgacaatgttctgctgtctcctactaatcttgcaggtacatccaattttatttcttctccatttttttgcatcctattactgtcaattgtcactgatacttttattccatcctttgttgctgttgccgtttgggtttcattttcccattctacttctgctcccaatgcttcgaatattgctctcattggtactaatgttctatcaagcaattgacgcaccaaattggttggcagtaacattagcaaaatcatgttttcctgctctgaagtcgctattatatatattaccgttcgaaaaaacggacgtttcattctccgaaagactcataacctgcgatatgttattaaaggctccgtacagctctgatacatttagtctcagattcagctctgtttcacagtttattatttcttccctgcttccttcataaataaaaacgccgcagaccacgcacctctcgtaatccacagcgtttccttatggtcggggtgacaggattcgaacctggaacaaacaacgctatatacgtatatttaagaatatcgactgataattgactttaaaaactgaatgtatttaacttttccgctgtttcggatttacgttcctgtctaatgtgcgtgtagatatcttgagttaattttatgtctttgtgtcccattaattcttgagcgtcttttgcttctattccggcctcaaaaagtttattatatacctcaacttttctatgcactttattgtttcattttcaattatttccgtatatacagtgtttatagtgaacatcggtagggcagaagtcgtctgcctcgttaggtgaactaccatctcacgcaaagcgtgaatatatttagaatagtttgttataaacctttctaattacaagttttccgcgactgcgcgccttacgcggcgtacttcgcacaccatcatcccaatcagcataccgctgatgagttgaaattgattactgatatgcgccgccgtaatcccaatgctggacttgttgtgttttgggttaagcttcgtcaaagaggctatactcgttctattacaggtctttaccgcatatcatatactacgtcaaagtatctttcataattatttctaatcattactccttactcttctctttattcaattttcaaacatcttctcaacctatcttctcagatggttgaaaaacaaatagtgaaaaagtcttttgaaattgagtttcctcaatcatcgaccttaggatttcttggctaacttccgttactataaaaataaatataaaaattttataaaaatgtggtatagcaagcatcggtagggcgtgcgaagtacgccgcgtaaggcgcgcagtcgcggaaaatttgtatttagaaaagattatggacaactgttctaaatatgttcacgctacgcgtgagatgatagttcacctaacgaggcagacgtcgtctgccctaccgatgttcactataaacactgtatatacggaaataattgaaaatgaaacaataaagtgcatagaaaagttgaggtatataataaactgataattaatcttatagaaagttataaagataataataaaagatattaacaaatccgcgactgcgcacctaacgaggcgcataaatgcgccctgccgatgtttgccaaaacaacagttttattagagaaaataaataatatatcggaatatctttattcacggcagttcacaaagtcaacgggaaagttacagggcttttttcatcatgaagccatgcttcatggtgaaatgagcggggtgcgagcgccccttggagccgttaggcgacctaagcgagcaagcactttttctttggtgaagcgtttctttttcttgccagaaaaagaaatggttcaaacaccattataatgtaataataaaatttttatatggggtcatatacaaaaaaacacttatgttagattttaaacaaaatatataaataaaaataatgatttaagacaagttgatgttgcagaagttcttggaacaagtcaaactgtatattcaagttatgagcttggcaaaaaggatattcctgtaagacatttggtgaaattagccgacctttataacgtacctactgactatatattaggccgtactaatgtattgattccatatcctaaaatataaattgtatattgaacactgcgtgttcagatgtttgctcacctaacgcgcttgctaccgcaagcctaccgatgttcactgaaaaccctgctttttttgtattaatttggactaaaaacacaataaaaatctgattatccactaaaacacagtatctatcagcattttcaaggaaacaaatacatcaatttactacttatttactaccattgaatgagccttgatacgcaagttttcctagatatgcaaagatatagtacagcacatcagtattgaaacaagaaaaaattgaatatttcatagactatggaacgcataacatgacgttccttttctatttctagccgttcttattggacggctattttattactcaaaatgaaaggagcattagatttatgaaaaagatgttaaaacgattgtgtacgggcttcttagctcttgcaactgtcgttactgctttaccaactacaaccgttcatgctgaaagcaagcaatactggacggaaagtgcagagcgtgtcggtatcattgaaaaagtgatgaatgacggttctatcggttctacattcaatgagggcatgatgaaagtcgagggcgaaactgcctattgtattgacatcaatacagattttaagaacggctacaagaccagagctgacgcaagctcacgcatgagtgccgaccagatttcagatgtggcgttatccttagagtatgtcaaacagtatggcgaagctcacaaggaactgaactacaaacaagtttatctgttggaacaatgcgttgtctggcagagattaagcgtacatcttggctggcaatgtgataacgtgcgagcttcttatgatgaaattccaaaatctacgcaggacgaagttttcgctggtgcaaaagcctttgttaaagagaataaaggacgctatgaatgtggcggttatatctactctggcgaggggcaggaattgggacaattctgggcgaaactgaatgtcggaaatacgaaactgcaaaaggtttccagtaataccagcattacagacggtaacgggaattactctattgcaggtgcgacctatggtgtcttttctgataaggactgcacgaaacagcttgccacccttacgactgatgaaaacggaaatacagatattgtagaggtaaaagcaggcacagtctatatcaaggaattatccgcaccagcaggatataaagtggataaaactgtatattccttaaaggttgaagctggaaagacagcaaccttgaaagtatcagatacaccgaaagtaacggacactttgattgagcttttcaagattgatatggaaacacagaaagacaatccgcaggggaacgcttctttagcaggtgcggaatttacatggaagtattatgctggcttctacaataaaggaaatctccctgccgaagctactcgtacatgggttacaaagacaatcgctgaaacagacagcgacgggacaacccactacatcacaaaattaacggacgcatacaaggtgtctggcgacagcttctatatgcaggacggcaaagcggttcttcctttaggaacactaaccgtagaagaaacaaaagctccaaacggctacttgttagagggtgcatatatgcaggctggcgataagtccgaacagattaagggcttatatgtaacacagattaccgaggacggagaccttgccgtactatctggaagtaaccagttttccgtatcagacaaggttatccgtggcggtgtcaaaattcagaaacgagatttagaaacgggcgatacaaagccacaaggaagtgccactttaaaagatactgcctttgacatcatttccttaaatgataattctgttttggttgagggaaagctatacaagaaaaatgaagtagtaaaaacaattcatacagatattgagggtgtcgcttctacttcttttgaccttttaccttatggaaaattccgcatcgttgaaagtgaagcccccaacggttacttaactgacggtgcaaaaccgattgattttacaatcacagaaaatggaaaaatcgtggacttatctgacgaagctcattctatctacaatcagattaagcgtggagatattgaaggcgtaaaaatcggagcaggtacacacaagcgtcttgctgatgttccttttaggatcacaagcaagacgacgggcgaaaatcatgttgtggtaactgatgataacgggcagttctccacttctgctgactgggcttcacataagcacaataccaacgcaggaaagaccagtgaggacggtgtgtggtttggaacttctgaaccagacgacagcaagggtgcgttaccttatgatacctacatcattgaagaattaaaatgtgatagcaacaaaggctttgagcttatcccaccgtttgaaatcgtggtatcaagaaataaccttgtgattgatttagggactttgactgatgaatacgaaaaagaaatctctatccataccacagcgaccagcaaggacggagaaaagacaatccttgcaggaaaagagattacgattgttgatactgtcaaattggacggacttacaaaaggcacaaagtatcagctcaaaggctggcagatgttaaaggaagaaaacgcagaacttcttattgacgggaaacgtgtagaaaacgattatacctttgtcgctgatgatgaagaaatgaaagtggaaatttcctatacattcaatgcgtctgctttaggtggcaagaaccttgttacctttgaagaattgtatgatttcagcaatccagacgaacccgtgaaagttgcggaacataaagacattgaggacgacgggcagaccgtacttatcacagagcgtatcatcaaaattcatacgactgctaccgataaagacggcaataaagaacttgaagcaggaaaagacgttacaatcattgataccgtaaccttagagggcttagaagtcggcacaaaatatcagttaaagggctggcagatgttgaaagaagaaaatgcagagcttcttatcaatggaaagcgtgtggaaagtgattatacctttactgctgacagtgaaactatgaaagtggaagttgcttttacgtttgacgctacttctcttgacggcaaacagcttgtaacatttgaggaattatacgatttaagcaatccagacgagccgaagaaagttgccgagcataaggacattgaggacgagggacagacgattacctttaaggaaaagccagaagtcccagaaaaaccagagaaccccgaaacaccacagacaccagaaaagcctagcagaccgagcgacagtcccaaaacgggcgataacaccaacctttacggactgcttgcacttcttatgacttctggtgctgggctggcaggtattttcttctacaaacgccgtaaaatgaagaaattataaggcggtaacggtatgatgaaagaaaaatcacgctctccgccgaagctgtcaaacggcagacttccgcttattctggcttgtctgcctacaacctgcaagaacacggatagtcaagggtgcgaagcatacattttaccctttactatctgtgggattgctggtatttcccgaaccgccagaataagaaatcacaatcaattaacttatcaaaaatagaaagaaacgaggtaaaacactatggaaatgaaatatgtcgtgccagatatggcacagtcttttggaactcttgaatttgcaggcgaaagcgagccagtctttgaaaaagataaaaataaccgcagggtcttaaccagacgaagctataacctttattccgacgtacagaaaggcgaaaatgttgtggtggaaattcccgtgcaggctggcgaaaagcatttcaagtatgaacagaaagtaaaacttgtcaatccgaagttatacggaagaggttacgcaatcggggatatgggacataccgattatgtgttgcttgctgatgatattgtagcagttgaagaaaagtaaaggagtgaagaatttatgagattatcaaacgggtttgtcattgacaaagagaaaacatttggagaattaaaatttacagcggtgcgtgatgtgttcttgcagaatgaggacgggacaccaagtacccagcttaaaaagcgtatctatgatttgaagtgcagtctgcatggtggaattatccccgtgtccgtaccgccagaagtaccgttaagagaatttccgtacaatgcagttgtggagcttgtcaatcccgtagcagatacggtatcaagaaagacgtttggtggtgcagatgtggactggtatgtaaaggcagaggatattgtgttgaagaataaaggcaaccagaacgcaggcaatccacagaataataacacgcagggacagccgaaaaaacaaaattagagattagatttttattgtgaggtaattcgttgaatgatataattaggataaattgtgaggtgcttatctatgaaagtattagttagttcatgtatcatgggaaaaaactgcaaatataacggtgggaataatctcaatccgaaagttgtagagtttctaaaagacaaagaggttatcgaaatttgtccagaattattagcgaatatgcctacaccacgtcctagtgcggaaatagtaaatggtattgtcatggatataaatggaaatattgttgatgaggaatatcgtcatgcggtacagttggctctaaatgaaataagaagtatggaaatagatttagttattctgcaatcaagaagcccaacttgtgcagtcaagaatatttatgatggtagttttacgggaaaattgataaaaggtcaaggtctgtttgcacaagcgttaattgaggctggatataaagtgttggactcagaagatttttaatgaatggtaatgaaaaagcagttagtcttaggattgactgcttttttcgtacccagaaaggagtgattgatttatgcgtaagatttggaataaaggacaccgtatcagagccagcgacaagcaccttgtttatcatttttccatagggacgcttctgttggtattcgtggcggttctcctgctactgaatacaaaacagttcatgcgtaccgattgggaacatttcagcttgttagaaaatggcttgacgctttccccttacaacttcataaccatagggatagcgactggtgtttgtgcattggtcgcttttctgtattaccgcttctgttacgacagtttcaagaagctcctgcaccgtcaaaagctggcaagaatggtactggaaaataagtggtatgaagctgataccgtacaagacagcggtttttttactgacctgcaaagcagatcaagggaaaaaatcgtctggtttccaaagatttattatcaaatggaaaaaggcttgcttcatatccgctgtgaaatcacattaggaaaatatcaagaccagcttttgcggttagaggataagttagaaagtggattgtattgtgagctgaccgacaagaccctgcatgacggttatatcgaatataccctgctttatgatatgatagcaaaccgcattaccattgatgaagtaagggcagaaaacggctgtcttaggctgatgaaaaatcttgtctgggaatatgacgcactccctcacgctctgattgcaggtgggactggtggtggtaaaacctattttctgctgacgctcattgaagccttactgcataccaacgctatcctttatatcttagacccaaagaacgctgaccttgcggacttagggacagttatgggaaatgtgtatcacaccaaagaagaaatgattgattgcgtcaatgccttttatgagggcatggtacagcgaagcgaggaaatgaagcgacacccgaactataagacgggcgaaaactacgcctatctgggactgccaccctgctttcttatctttgatgaatatgtggcgttttttgaaatgctgggggcaaaggaaagtgtgagcctgcttagccagttaaagaaaatcgttatgttagggcgacaagcaggatatttccttatcgttgcctgccagcgtccagacgcaaagtatttttcagacggtatcagagataacttcaatttccgtgtgggattggggcgtatcagcgaattaggttacggtatgctgtttggttcagatgtgaaaaagcagttttttcagaagcgtatcaaggggcgtggttattgtgatgtgggaacaagcgttatcagcgaattttacacgccgttagtcccaaaaggacatgactttctacaagaaatcggcagactggaagaaaaaaggactgcaagcaacgaaagctgacagtcctacttcaatttcaatatgtcgtttggggaacattccagaaaatcacagagctttgcaaggattgtgaggtcaattctggaaaccttgttcttgcaatagttattaagctgtgtccgctgtaatttacacgcttcacagactttgtttttgctgatattcttctctttcaaaagattttctaaatcaatatatacctgcatacgctgtacctcgtcttttctttgaattataagatacaactgtattgataaataagatgtattaccgtagactgtattataatacaccctacaagaaaggacagtaacagtatgtgcaaaaagagaaaaataataacaatcacggtactttttgtactgggagtggcggtttcctatctgcaatggggacgtgagattgatgtagcaggaagtataggcacttcatcagaaaacttccatgaagaacacgttacctttacgctcaaccgtcttatcataacagacaaagaaaagtgtgcagaggaaatcatcaaaaaatgcagggagaatgattttgcttctactctgttcagctatgatgtggcaaagccaaacgctttatatggtacggtgtaccgttcccgtttttccatgaaaggacaaaagcctttgtttcacttccgatatacgcagacagcggacacgctcggttcatacaacattgttgatgatccagaagcgttcacgctggtaatcgaataatgcaaggcaggacgggacggcgacgtgcgaagcgaaaggcgacggcacggactagccgttgctggtgtggcgtaagccacgccagcaggtaaaacccctcggcatctaacagaggggtacgtttgcaaatagacaatagacaaaaaacataggaaacataaggcttctggcatggtttcctaacaaaaatcgactgtgaagtcgccttaaaaaacttcacacttgacagattgggggtatggttctgaatgaagaacaatggataaaagaattacgggagaaacggattgcttacggtatctcacaaggcaggctggcggtggcttctggtatcacaagagaatatctcaacaagatagaaagcggaaaaatgaagccgtcaaaggaacttctggaaactttgcataaggaattggcaaggttcaatccagaagcaccgcttaccatgctgtttgattatgtaaaaattcgttttcccacgctggatatacagcacataatcaaagatatattaaaactgaatgtcaattatatgctccatgaagattacggacattacagttatacggagcattattctttaggggacatctttatctatacgtcggctgacgaagaaaaaggtgtccttttagaattaaaggggcgtggttgcaggcagtttgaaagttacctgctggcacagcaaagaagctggtatgactttctcatggacgcattagtagacggtggcgtgatgaagcgtatcgaccttgctatcaacgaccatacgggcattttggatattccagagcttgcggagaaatgcaggaaacgggaatatatcggaaagtccagaagctataagttttaccagtcgggcgagcttatcaagcacagagaggacgacagagaatatatgggacgtactctttatcttggttcgctgaaatcagatgtgtatttctgtatctatgaaaaggactatgagcagtacgtcaagctggggacaccgctggaagaagccgacattatcaatcgttttgagatacggcttagaaatgaacgtgcctattatgcagtacgagatttgctgacctattatgacgcagagcagaccgccttttcgattatcaaccagtatgtgcggtttgttgatgaagaaccagacaagcggaaaaatgactggaaacttaatgaccgctgggcttggtttatcggcgataacagacagagcttaaagctaacgacaaagccagagccttacaccttagaccgcacattgcggtgggtacaaaggcaggtagcaccgaccttgaaaatgctgaaaaagattgataaaggaaatggtacagactacatggaaacaatcgaacagcaggcaaagctcacagaaaagcatgaaatgataatcaaacagcagacgacccctacaaaagatttggtggaaagttaggagtgatgaaaaatgtgggtattattaaaagacttcctgctggtatctatgggaatgggtatcggcgtagtcttgatgtgtattttgaatgtcggcaaagaagctgactatgaaatgaaacaattagaagaaagcgaggacaattaaatgaatttcggacagaatttatatcaatggtttttatcaaacgcacagagcttagtgcttatggcgattgtggttattggtatctacttagggttcaagcgtgagttttcaaaacttatcggcttcttggtagttgccttgattgctgtcggcttggtgttcaacgctggcggtgtgaaagatgtattgttagaactattcaataagattatcggtgcataaaattttattgtggtgctgatatgagaatggtataatttagaatatgaaataaagtgaatactatttgaggttgaaaatatgattatttatagcaaattggaaatcaatagaataaaagatttttgggagttattaaatcgtttagatactgaaacagattacatgatgtacgaaccaaatgaaagaaaagcgaaaactactattcaagaattaaaattagatattcaagacaatgtaattcaaggttttgattttttgcaagtggcaacagaaaatgacaaaatagttggttatattagagcagaaagaggaaaatttgaaagaaattttcatacggcatatattgttataggtatcttaaaaaaatatagaggaaaaggtattggaactactttttttaataatttagatttatgggctaaaacaaataatattgtccgtttggaactgacagttgaatgttgtaataatactgcaaaaaatttgtatgaaaaaaatggttttaaaattgaaggaataagaaaaaaatcaatgtttgttgctggttcctttgttgatgagttttatatggcaaaaattctataaaataaattttcaacttcattatttacaaagtaattggtcttaggattgaggtgttttattatgaatgagagagaaaaaatcattcgcttatggttcgatatgtggcttaaacagcaagatttaggaatggataaaatttttacagaagatgttgtttatacggaaagctggtgtcctaaatatgaaaatcttaaaacagtaaaacattggtttaatgaatggaatactcgtggtaaagtcattatttgggatattaaacagttctttcataaagaaaatcaaactgtcgtagaatggtattttaaaaatgaaatgaatacgggaagtgttgaagaatttgacggtatttccttaattgaatggacagaagataacaaaatcaaatcattaaaagaatatggttgcaatttgaataactacaatccatatcagcacagcgataaccctcaatttagagatgaaaaaataagctggttttaaaacttaatcaaattatatctatacacacaaagcagttagtcttaggattgactgcttttttcttacctaaatttcagattggagtgatgaaatgaacgatatttttaaggatatgcaggtaaaagtcggctgtgaatacatttccgacctgccctcttacaagcgtaaggtgtggcatgaaatgaaacgactgaaccctgccgactatgaagaaagacagttagaagatttttcaaagtatgtgtttggtatgtcgtaccagaccataaaagatgtgataaaacaacagaaaggacgtgaggaacaatgcaggaaacaagggtgctggtggaaacgagaggaacaactggcgaagaaacaatatcatactggttcgacctgccgatagatgttgccgagtttgaagaaaagctgggtgtcggtgcagaaagtggggattaccgcattatcgaaaaggtgttgccttatgctgatgaagtccacgaacataccagcgtgtaccagctcaacgaattagattttatgtaccgccagctttcgagcgatatgcaggaagaatatacagcacttcttacggtgtatgaaaatttagaagcactttatatttgcagaaatgtgattacggtttatcacgactgcaaaatcatgatagatgttgcaaggcaaaagctgatgaacgacccgacgttcaaacatctgtccgaggactgtcaagaatattattttgactttgaagcctatgcttctcacttgcaggaacacgggaaatttttagtaacggaacacgctatctttgaactgccagagtaggaaatgaggtggtgcttatgattgatgatatggcggtttacattgctaatcttggcaaatacaatgagggctatttagtcggtgcttggttcacgtttcctattgacgaggaagatgtgaaagaaaaaatcggcttaaatgaacaatatgaggaatatgctatccatgataccgacaacttccctattgcgattggagagtatgtttccattgaagaactcaatgaaatgtatgaaatgatagaggaacttcccgactatatcgtagagtgtctggacgaatttatcagccactacgggacgctggaagaagtcgtggaacacaaggacgatatttattattatcccgactgtgaaaccatgacagacgttgcctattactacatagacgaattgcaggcactaggggatattccacccagcttacagaactacattgactatgaagcctatgggcgagatttggatatgggtggttgctttattgaaacaagccgaggtatgtgcgagataccatactaacgctggaagatcagcgacaagcattgttgctactgacagcgtatttctcttttaagggacagtctgaaacatggctgtccttttctattttgaaaggagctgaaagaatttgaaaaagattaaatcttatacgggtatctggaacgtggaaaaagtcttgtatgcaatcaatgactttaacttgccctttcccgttacctttacacagattacatggtttgtgattacagaatttatcatcattctgtttggggatattcccccactttccatgattgagggagcatttctcaaatactttggtattcctgttgctctcacttggtttatgtcgcagaaaacctttgacggaaagaaaccgtacagctttttgaaatcacagataacttatgcgttgcgacctaaaatcacttatgcaggaaaagccgtaaaactgcataagcagatattgaatgaaacaatcacggcagtaaggagtgtgaactatgttcccgataaaatatattgacaataaccttgtctggaacaaggacaatgaggtgttcgcctattatgagctgataccgtacaactattctttcttatccgcagagcagaaatttatcgtgcatgacagtttccgacagctaatcgcacagtcccgtgagggaaaaattcatgccttgcagattgccacggaaagctccatacgaagtatgcaggagcagtcaaagaagctggtaacgggaaaattaaaggaagttgcctatcagaaaatagacgaacagaccgaagcgttggtatctatgattggggacaatcaagtggactaccgcttttttcttggttttaagctcatggttacggaagaacagctcaatctgaagaacatcaaaaaatcggcgtggctgacgttcacggaatttctccatgaagtgaaccatacgctgatgaatgattttgtttccatgccgaatgatgaaatcaaccgttacatgaaaatggaaaagttactggaaaataaaatctcccgtcgctttaaggtgcgtcgcttggaaatcaacgattttgggtatctcatggaacatctttacggcagggacggtatcgcttatgaagattatgagtaccagctaccaaagaaaaaattgaacaaagaaacgctgataaaatactacgaccttatccgtccgacaaggtgtgtgattgaggaaagccagaggtatttaagattggaacatgaggacaaggaaagctatgtatcctattttaccgtcaatgcgattgtcggggagcttgattttccgtcgtctgaaatcttctatttccagcaacagcagtttacattccccgttgatacaagcatgaatgtagaaattgtggagaacagaaaggctcttaccacagtaagaaataagaaaaaggaattgaaagaccttgacaatcacgcttatcaagcaggaagtgaaaccagctcaaatgtggtggacgcattagacagcgtggacgagctggaaacagacttagaccagagcaaagaaagtatgtataagttaagctacgtgatacgggtgtctgcacccgatcttgacgagctgaaacgccgttgtgatgaagtcaaagacttttacgacgacctcaatgtaaagctggtgcgtcctgctggggatatgctggggcttcattctgaatttcttcctgccagcaagcgatatatcaacgattatgtgcagtatgtaaaatcagacttcttggctgggcttggctttggtgcgacacagcagttaggggaaactacgggtatctatatgggctattccgttgatacgggaagaaatgtgtacctgcaaccgtcccttgccagtcaaggtataaaaggtacagttaccaacgctttagcttctgcttttgtcggttcgcttggcggtggaaagtcattctgtaacaatcttctggtgtattattcggttctctttgggggacaagcagttatcttagaccctaaatcagagcgtggcaactggaaagaaacgctcccagaaatcgcccatgaaatcaatatcgtaaaccttaccagcgacaaggacaatgcagggcttcttgacccgtttgtgattatgaagaatgtaaaagacgctgaaagtctggcaatcgacatcttgacattccttactggtatttcctctagggacggcgaaaaattccccgtgttgcgaaaagcggttcgttccgttacccagagcgacagtcggggcttgctccatgtaatagacgagctacgccgtgaagatacgccagtatcaaggaatatcgcagaccatatcgacagcttcacggactatgattttgcacacctgctgttttcagacggtacggtagaaaatgctatcagtctggataaccagctcaatatcattcaagtagctgaccttgtactgccagataaggacacaacctttgaggaatacacgaccattgaattattgtcggtatctatgctgattgtgattagtacctttgcccttgattttatccattcggacagaagtatttttaagattgtagaccttgacgaagcgtgggcgttcttaaatgtggcacaaggcgaaaccctatcaaataagctggttcgtgctggacgagctatgcaggcaggcgtttatttcgttacacaatcttctggggacgtggcaaaggaaagtctgaaaaacaatatcggcttgaaatttgcatttcgtagtaccgacttgggcgagataaagcagaccctagaatttttcggcattgacaaggacgacgaaaacaaccagaaacgcttgcgtgatttggataacggacaatgcttgttgcaggacttatacgggcgtgttggtgtagtacagatacaccccgtctttgaagaactgctacacgcctttgataccagaccgcccgtacagagaaatgaggtggagtgatgaaagaaaggataaaaggtgcgttcacaaaaaggaagatacttcactttctcaaaatggctctgttcgtggtggcactctcccttatcctgctttcacttttggggacggtggctcatgcgacgggacttgtagacgataccataaacgaagaaaatctttactcaaaatatccgctgtcgaattatcagcttgatttttatgtagataatagctggtcgtggcttccgtggaactggctggacggtatcggaaaatcggtgcagtacgggctttactgtatcactaattttgtctggacgataagcctttatttaagcaatgccacgggctatgtagtgcaggaagcctataagctggacttcatcaacgatatggcagacagtatcggaaaaagcatacagacccttgcaggcgtaacacagaacggtttttccagctctggcttttatgttggtttcctgcttctcattatcttagtggtgggactttatgttgcctatacgggacttatcaaacgggaaaccagcaaggcacttcacgccgttatcaactttgtagtggtgttcgtactgtccgcttcgtttatcgcctatgctcccgattacatcaagaagataaatgaattttcatcagacatcagtaccgcttcacttgatttgggaacaaaaatcatgctccccaactctgacagcgagggcaaggacagcgtagacttgatacgggacagcttattttctattcaagtggaacagccgtggctactcttacaattcgggaacagcaacgcagaagaaatcggggcagaccgtgtggtcgctcttgtatcggcaagtccagaggacgaggacgggaaaaccagagaggaagtcgtgaaaacagaaatcgaggacaacgacaacaacaatctgacgataccgcaggtggtaaaccgtttaggtatggtgtttttcctcttgttctttaacttaggtatcacgatatttgtattcttgcttacgggcatgatgttgtttagccagatactttttattatctttgcaatgtttttacctatcagctttttactttccatgataccgagctatgaaagcatggcaaagcaggcaatcgtaagggtgtttaataccataatgacacgggcaggcataacgctcattgtaacggtggcgttcagcatttccagtatgttttataacatctccaaagattacccgttctttatggtagcgttcttgcagatagtatgtttcgctggtatctacatgaagctgggcgatttaatgagtatgttctctttgaacgctaatgacagtcaaagcatgggacgaagaattttccgcagaccgtatctgtttatgcgacatagggctaggcgtatggaacaccgtattgcaagggcggtaagtgctggcggtatttcgggcggtgtggctggtgcggtggctggaagtgccgttgctaataaacgagctgaaagaaaaaatacagcttctaaagaaaatcggggcaataccacttccagcatgggacagcgtgcaggctcaaaggtgggtgctgtcttagatacgaaaaataaagtgaaagacaaagcaaacgctgtcaaagaaaacatcaaggatatgccgacacagaccgcttatgcggtgtattccgcaaaggaaaaggcaaagtccagcgtgtccgacttcaagcgtggcatggtgcaggaacagcagtccagacagacgggacgattggaaaagcaggaacagcacaagaaaaatatcgctgacaagcgtatggagcttcaaaaggcacaagaagcaaggcaggcacagcgaaaggctgacggatcagcgacaacaggagctacccgtccccatgagcgaccagccacagcttcaaagccgagtgcggaaaaaatgcaggaagtcaaacgtcctgccacagcgaccacttcaaaagcaagtgagccagtcaagacaaatgttatcaaagagcgtccgttatcttctggtgcttctgataggaaagcgacccagtctgcacagccagtacataggcagaatgtagaaaaagtggtatcgcaggaaacacgccagaattaccccaaagaccgcaggacaaaggttcagcagacgcagagcgtccagaagaaccagcagacaacagagaaaacccgtaaccttgtaacgaagaaaggacagaagaaaaaatgaaactgaaacatatcgctatcattggcagtctgtttcctatcctcttttctctggtgcttttctttggagtgttgattagtgcggacagcgacgacgagaacagcaatttttcttctggcattacgggtatgaacctatccgcagaagtcttgaaacatcagcctatggtagaaaaatacgccagagaatacggcatttccgagtatgtcaatgtgctattggctatcattcaagtagaaagtggcggtacggcagaagatgttatgcagagttcggaaagtcttggtttaccgcctaattccttagatacggaaagttcaatcaagcaggggtgtaagtattttgcgtccctgctttcttcctgcaaaaatcaaggtatcgacgatttgaatgtagcgatacagtcctataactatggcggtggctatgtgggttatgtggcaggaaaaggaaagaaacacacttttaatcttgcagagagcttcgctcgtgagaagtcgggtggaaagaaagtaacctacaccaacccgatagctgttgcgaagaatgggggctggcggtatggctatggaaatatgttctatgtggaattagtcaatcaatatctgactgtggcacattttgataatgcgacggcacaagcgattatgaatgaagcgttgaaatatcaaggctggaagtatgtgtatggtggcagtaacccgaacacttcctttgattgtagcggacttgtgcaatggtgctatggaaaagctggtatctccttaccgagaacagcacaagcacagtatgacgctaccctacatcttccactctcgcaggcaaaggctggggacttggtgtttttccattctacctataacgctggttcgtatgtaacgcacgtcggcatttatgtaggaaataatcagatgtaccatgcaggcgacccgataggatatgcagacctaagcagtagttactggcaacagcacctaatcggtgcaggacgagtaaaacaatagaaaggacttgaaaaatatgtttaagaagaataagaaacagacagaaactctcaaagaaccaaaagaaaaaaaggtgcgtactgtcaaggtaggcacacataagaaaaccgtgattgcgttgtgggtggtgcttatcgcaagcgtgagttttggggtgtataagaattttaccgctatcgaccagcacaccacccatgaaaaagaaatcattgagcttcgcttgcaggataccaacgggatagaaaatttcgtaaagaattttgcgaagtcctactacacatggaataacagtaaagaagcgattgaagcaaggacacaggcaatcaacggttatctgacaaaggaattgcaggacttgaatgtggataccattagaaccgatataccaaccagcttcacggttacagatgtgattgtatggagtatcgaacagtcgggaacggacactttttctgctacctacgaagtagatcagcagataaaagagggagaacagacaagcaatgtgaaagcaacctataccgtaaaagtccatgtggacgctgacggggatatggtaatcgttcagaaccctacccttgcaccagcaatcgaaaaatcggactatgagcctaagacaccagaagcagatgcaagcgtagacgctgatactgtcaatgacgctacctcttttctggaaacattctttaagctgtacccaacagccacagaaaaagaacttgcctattatgtaacgggaaatgtgcttgaacctatcggcagggactatctttattctgaactggtaaaccctatctttacaaaggacggggacaatgtgaaagttaaggttgctgtaaaattccttgataatcagacaaaggcaacacaagtatcgcagtatgaacttgtactacataaggatagcaactggaagattataggataaatcaagaggcttgtagttagcatttttgcatgattacaagcctaaacttattgacaatcgtatcatataatactatactgtacttgtaaaggtaatacagtataagacaaggcggtggtatagtggatatttttatcaataatcatgccagcataccgatttatgagcaaatttcttcacaaataaaggcaatgattatcaacggagatttgaaagctggagaagcacttccctctataagaggactggcaaagtcgttgcatattagtgttttaacggtgcaaaaatcttatgatgtacttcaaaaggacggttttattgaaacaactgctggaaaaggttgctttgtatccgttcaaaatcaagatttctacttagaagaacaacaaaagaaaatagaaaattattttatagaagcgattgaaattgcaaaggtaagcggaataaagctggataaattacaatctttacttgcactattatatgaggaggaatgagattatggaaaaatatgctttggaacttaatggagtaactaaacaatatagtgacttcaaacttgacaatatttcctttactgttccgcaaggtagtatcgttggattgattggagaaaacggagcagggaaaagcacaacaattaaagctattttaggtttgattgttactgagcaagggaaaatttctgtatttaatgggaaagatgtcaacgctgaaacgaaagaacatatcggtgttgtatttgatggaagtaattatcccgataatttaacacccaaaaagttaggaaaagtttttcaaaatatttatgctgaatggaataatgaaaaatattttgagctattaaataagtttgaacttcctatcaataaaaaattaaaagaattttcaaaaggaatgaacatgaagtattccttagtggttgctctatctcataattcaaaattgcttattcttgatgaagcaacaagtgggcttgaccctgttatacgagatgatattttagaaatgtttttagattttattcaagatgaagaacattccattttggtttcatcacacatcacaagtgatttagaaaaaatcgctgattatatcgtatttatacatgaggggaaagtattattttcaagacctaaagatgaattgactgagcaatacggtatcatcaaatgcaatgctaaacaatttgatgaattgaataaaaatgatattatccgttataagaaacaagattatgaatggcaagtgcttgttgcaaatagacaaaaagcaaaaaaggaatatccacatactttagttgtacctgcttcaatagacgatatcatgttactttatgtgaaaggggaatgttgattatgaaaggcttattattaaaagattattttgctattaaatcttcgatgataatattactcattggctttgttgtctttgggttcggagtttctttttatgctccaccctatgttttaatgctgatagcttctattatactagggcaatttgtaacaactacaatttattcagacagaaaatgtggttggttgaaatcatcaataacatttccaacatcaaaaaaatcacatgttagcagtaaatatattatgtatgctctattatgtttgttaggggttgttgttggtctagttttaagtattattattacttcaatccgtaatgaactagatacacatttgcttttattatttacttgtatgacaactactatgatatttatgtcaggggctgttcttattccttgttactattttatcaaagaagaattaagcggagctattggaattttagcatacggaatatcgggtgtatttttctttggcatgattaagttaattgaaaatcatgttttggcacttactattagcatttttacagcgataatactttttgttatttcttggtgctttctttgccaacagataataaacagagatatttaggagtgatttaatgctaagaataaaaaaacgagatattaaaaaagcgttaaaagcaggtgcaaaggctggcgctatgtcattagctgatgttcgggaaaatattgaagcaacgattgatgaagctatgaatagcaccgacccagaggtgcaggcaaatttcaaaaagtattttgggaataaacgccctacaccagaagaatatatttatatcattacgaaaaagacaaaagtaaaagtgtaaataaaaacgccgtgggaaacaactcacagcgtgagatctgattatcacggcgttaaattatttttggagcaaatagttttctccccagttgcatagttcatcaagaataggggttaaggtttttccaaattcagttaaagaatattctgtttttggcggtacaactgggtaaactttgcggttaatcaatccgtctttttctagctcacggagttgttgtgctaacattttatctgttgctttgggaatgagcttatgaatttcgttataccgtaatgttttattcattaaatgccacaaaatgacagccttatattttccaccgattagttgaatggttgcttcaactggacaactaaaaccacagcaattattttccataatgttctctcgcttttcttttgggtagtatattacaaaatagtgcgttcttgtctaatagactattacgaatataattatagtataggttgacctaattcacaagaacaaaggagattgaaacatgaatgtattagatattgcaaaaaagaggtattccgttagaacatacgaagataaaccagtagaaaaggaaaagttggagaaaatacttgcttctgctcatgttgcaccaacagcggcgaacttacagccagttaaattattggtggtgcaggacaaagaacgattgaaaagtattgcaaaagctggaaacatatataatgccccattggcaattattgtttgtgcagaccattcaaaagcatggacacgaccttttgataacaaacagacaacagatattgacgctactattttgacagaccacatgatgttgcaggcaacagagttgggattaggtacagtttgggtatgcttttttaaaccaaatgtaatcaaacgagaatttcaattaccagataatttagaaccagtcaatatattagtcattggttatgggaaagaaacaccagcagacccagaacgtcattttgctacacgtattcctatggaagaattggtttcttacgactatttataaaaggtttgtaattgtaattttttagacaatgaaagtaacgggtcgtgaaaatgcttcacagaattgtgatctgcattatcacggctcttttactctctgtttactttcaaaactgtaagtgtaattgaatactgcccttactataatttaatcgtattccaaaacaaataaatgtggcaggaagaaaggagcgattttaatggaacacattttaaatttagaacaagtaaaaaaatactacgggggtaactctggaaatatcacaaaggcagtagacggtatttctatgtatgtagacaagggcgaatttgtcgcaataatgggagctagtggttctggaaagactaccctattaaactgtatctctacgattgataccgtaaccagcggacacattacagtcaacaatcaagatattaccaaaatcaaagataaagattttgctgatttcagacgtgaaaatctagggttcatttttcaagatttcaaccttttagataccttaacgattgaagaaaacatttctttgtcattggtaatcaacaaacagaaccctgctgatattgacaaacgagttcatgctatcgctgataaattgggtattcgtgatattttatcgaaatttccttatgaagtttctggcggacaaaaacagcgttgtgcttgtgcaagagccttaatcaatgaaccgaaactgatattagctgatgaaccgacgggagctttggactcaaaatcttccagattgttactggaaacaatgtctgacatcaacaagaaaatgcaggctactattttaatggtaacacatgacccgtttagtgcgtctttttgtaaacgtattttgttcttgaaagacggtaaaatattcaatgaaattttcagaggggaaaaaagcagaaaagatttcttcaatgaaatactggatatattaaccttgctcggaggtgaagtgggaaatgttaggtaaatatacaaaaagaagcattaaagattatttgatttatttgataactgttactatcgcattttctcttatatttgcttttaacttagtggcaagttctgaagaagtaatagaattatcgacaggcatggatacgtttaagtatattctagcttttgtgaatgttgttattatatttgttatctgttttttgattaactacaccacaaaatttatgtttgaaaagcgaagcaaagagcttggaacatatatgcttcttggaattagaaaaaaagaaattgctcgattgcttgtaattgaaaatgtgttattagcgatatgtgctttggttttggctattcctcttgggttcatatttagtcaatttgtatcattggtaattgtaaacttattaggtattccagaagtaatctttatttcaataaattttgtttccataggattgcttgctatttactttttggcaatatacgtattggttctgcttaatcttttacgaagaattagaaaaatgacggtacatgattttctttattttgataagcagaatgaaaagaaaatgttccgtagcaataaaaagagaaatattattttcattgttagtgttatattaggaattactgctattttgctttgggcttcacgttggacaatggaaaacagcggtaaacaagaaactcttacgtatttgatgattagcatgatgatgttgattatcagtatttatggtgtatcagctacttgtgcagatatgttgttgtcggttttattgaaaaataaaaaacttaaatatcaaaaagataacctttttgtaacaagaacttttgcgtcaaaagcaagaacaatgagttttacgttcgggacactttccatgttgatattactttctttgttatgtttaaatttttcaagtatcaataaaggagtgtataaagcaagcatagaaatgacagctccgtttgatgttcatgtgtttgaagaaaaacaaccatttaaagattttaaagaatatgtgaatgttgttgatgaagattatacaataaataaagcaatcgaatttgatgtttataaagaaccgaaacatcaaatgcagaattattttgacgtgcaattttatgattatgacccagtaatgaaattaagtgattataacgaaatactgaaattaaagaatatggacaccatagaattaagtaatgacgagtattttcttgtaactagcaaagatttgttatataaagttgaaaacaacaaggatattgaaaaaattcagttgacaagtggaaaagaattaaaactaaagggcattgatacaaaaacgtattggtatcaaataaataatactggaagatttgctgttattgtgcctgatgaatatgttcaaggcttggaagtatctgagcaacatctgattatagataccatagaagaaacagatacaaaacttagagaaaaaatcaaacaagatttgaaacatcgattagtaatagtaaatgatgatggtgaaacagtcgtacaatattatagactttctgtaagaggttctgctattgaagaacaaaatacgatgaccgctatgattgcaagcatttgtctttatattgcctttattttgatttcggcagttggaacagttcttgctattcaatcactaagtgactctacaaagtacaaataccgctatcaaacattaaaaagattgggagtgaatgataaatcattatttaaaacaatcagaaagcaattactaatattatttggtgttccagttatttattcaattcttgcaagtttctttatgctggtatcagtcaataatgtttataaaatttatttagaaagtgagtatagttatttaatttacttcgtagtaggtttggcgattttcttctttatctatggaatttattggatagcaacgtatatcggtttcaaacgaaatatcaatgaggagagttagatttttctagctctcctgctgtggaattattataatggtaaatcaagggggtgtggaaatgagaatagcaattatcgaagatgatgaaatcactcgtctggagctttctaaactattgaacacacaaggatatgaaacagtcttgttgactaactttgaaaatctgacagaggaattaaagcaatattgcgtagagctggttttgcttgatattaacctgccgtatgaaaatggctatgaagtatgcaggaaaataaaacaagctatgccagtacctattatctttgtaacaagcagagatacaaatgctgacgaattgaaaagtattcaagtgggtggaattgactttatcacaaagccgtatgacacgcttattcttcttgagaagatcaagcgtgcattgcagttatcaaacccgaacaatttccgtgagcttgtcaaaaaagattgtacccttgatttacatttatccattttgaagtatcaagagaaaagcattgaactgacaagaaatgaatttcgtatcttatactacttctttatgaatgaagataaagttattagcaaagaagaactattggaaaagctgtggaacgacaaatattatttagacgaaaatgtattactggttaatatgacccgtctaaaaaagaaaatgaaagaaatcggtattgttcatttattggaaaatatacgaggaaagggttggaaactgtgagcttttttacattcttagaagaaaaaataacagagatattgtttcagcttttctttcttgccttagtagtatttctcttgattttctacggtgtagatacgctatttgttgtattgctggtaattctgttcatcagcatacaaggtttttttcaatggtgtttgtatcggaagaaacgtaacgcttcacaacatattattgatttagtagacggactggaagaaacctattatattgcagacgttttaccaaagccaaaagaatttcaaaatgaagcctattactacgcactaaaaaaagcctgcaaatctatgaatgatgaaatcagtaaaatcacagaagaaaagcaggactatcaagaatatgtggaaagtttcgcccatgaaattaaaataccgataggggcattgtctttgacgtttgataatacgaaaaattatacgttaaaaaaagaaactgataagatatttcagttagtagagcaaatgctctattatgcaagaagtgaaaatacggaaaaagactactttgtaaaacagttaaatttagacgaagtgatacataatatcattttgaaattccgtcattcacttatggaaaggaaaacggttatcaatatccatgatatagagaatgttgtttataccgatgaaaaatggctgacattcattctatctcaaatcgtgcaaaatacgattaagtattttgacaagcaggaaaataaactgacgatatacagtcaagacaatgaaacaaatatactgcttgtgatagaagataatggctgtggaataaaagcgtcagacttatcaagagtatttgaaaagggttttactggttcaaatagaaacaaagcaaatgcaacgggcatgggactgtatttatcgaaaaaattatctgatagactaggtttgaaattagatattacttctaaagaaacggaatatacaagactgacaattacattcccaaaaggaacagtccataatttacattaagcattgaatagttgcttattgatgataaaacaaaggaagtgatacacatggagttatatcttaatgatgtttacccttatgcacaacaaatatcaaattatatagaacgagaaatttttcaacagaaattaaaagcaggtcaaaagctactttcaataacaaatttaagtaaagaattaaatgttagtaaacatacaattcaattatcttataaaatactgagaaagaaagagttaatcgtaaaaaaaggaaatgatttttttgttacaaaagataactgctgtataataacaaaaatgaaagaagaaacagatttacagataatcaaatgtctgcatgaattagcagaaatgggatattcaagagaacaaacaaaatccttgattttaagaaaattagaaactttaaaatttcctcaataagttcgattaggcattgcatagtattttgctgtaagggggcttgagttatggaatgttttaagtgcaattctttacaatttaattccacctaacagtacactattaaaaaataaatattatttagctttaaaagctcgtacagactatatgttttgtgcgggcttttttcatacccgaaaaaaacttaaaaatttttcaaaagaggtcattaaatcacacctagctgtccttatatggtgcggaaagagggataaacacttttcaaatcataaaggaaagggggtgagattgatgaaaccgtctgacttccagaaaacagttcaatgtcgttttgaaagttgtttaaagaaagttgttcgtagtgtcgtgaaagattattacaaggaattaaaccgtcgtaaaaataaagaaatatctttcagcgaattgccagatgtcattgttgataaaatgactgtttgggacgactacgaaacagattatacaatcttttcagtatgtggcattgatattcgtgtccttgatgatgaattggcagaagcattgaagaaacttccagaaagaaaacgcaatactctgttgatgtattactttttggaaatgacagaaagtgaaattgccaacttgcagaaaatcacgcaaagcggtgtatttagaaatcgacatcacgctttggaaattatgaaaaaaatactcaaggaggaacattagaaaatgaaacagttatttaaaaagccgtcctattacttgatttcatcagctatggacggaaacgaaaaagcgattgagaaattgctggcattttatgacccgtacatatcaaagtgctgtttacgttcactttatgacgaatatggcaatgtttatattgttgtagacatggaattaaaaggacgtatcagagaagcacttatcaaaatgattttaggttttaatattgaagatatggacttggaaccagaaaaataagcagtttttagcggagcatgatttaatgtccccctctttcctgctctgcccctgcttctacatgaaagcaacacgctttcgctacagctctttgacaactgaataaagcagacagatacgtttgtgagatagcgagccacgggaactgtacgccacgaccttttaaaagaaagcgagcgacccacgcagtgatccgagagcgactgttggaaaagtcgttttgccacgacctatcctcacagaataatgatacgtccgcatggtgcggttctgcccacaagaatgggaatagttgagatactaacggagttttccaaagccgtctgcctgcttgtaaaaaatgacacacagtaaagggggtgcatagattatgaacaatactgatgtgcctatctgggaaaaatatacgctgacgattgaagaagcgtctaaatacttccgcattggcgaaaagaaattgcgtaaattagccgaagaaaatcttgacgctggctgggttatcgtgaacggcaaccgtattcagattaagcgaaaacaatttgaaaaaatcatagatacattggacgaaatctaatgtcattgagccgtagatatggtataataaggtatagcgtatcacggctcattccatgacggaaaggagctttacactatgtctaatgtaaaacgaaaagacagtaaaaatcgcaatttgcgtaatggagagagccagcgaaaagacggaagatacgtttataaatataccgatatatacggaaagccacaatttatttattcttggaaacttgtaccgacagacaagacacctgctggaaaacgtgatgatatatcgttgagggaaaaagaaacacagataaaaaaagaccttaacgacggtatcgacacagcaggcggtaaaatgacagtctgccagctctacgacaagaagaacagccaaagaaagaacatcaaaagggctactgaaaaaggacgacagtatcttatgaacgctctgaaaaatgacccgttgggtatgagagcgattgataccgtcaagcagtcggacgctaaagaatgggctatcagaatgagtgaaaaaggatatgcctacaaaacgattgataactataagcgttccttgaaagcgtcattttacatggcgatacaagacgactgtatcagaaagaacccgtttgaatttaagctaagtgatgttctggaagatgatacggagcagaaagttatccttacaccagagcaggaagaacgcctgcttgcctttatggaaacggataagatttacagcaagtattatgatgagattgtgcttctgctggaaacgggacttcgtatttctgaattttgcggactgacgacgcatattgatatgcagaacagaatactcaatatagaccatcagttattgaaagatagcgaaatcggctactatattgaaacgccaaagaccaaaaacggaaaacgggaacttccattgacagaacgggcttatcaagcaatccaaagaatactaaagaacagaggaaaagcacaaccgctgattgtaggtggttacagcaattttctattcttaaaccgtgagggcttgcctaaagttgcaggaaactatgagggcatggtgcgaggactgattaagaagtataacaagtatcacacggacaagttaccgaacatcacaccacattcattccgacatacttattgtacgaatatggcaaacaaaggaatgaaccctaacactctgcaatatctcatgggacacgctaacataaccatgacacttggctattatgcacacggtacatttcaatctgcaaaagcagaactggaaagactggcttgttaatatcggagcttatatttactactcatttactacttttggttgcattttcatgctggtaaatgccagcttatgcaaggtatcttccaaaaagaaaataccgataaagccctaaaatacggaatatatcggcatttaccaacttatgaaaagataatcagaaatttagtaagtttttatataaaaaactcagttttttaattagtaaataaataagaactcgaaatatctttattcacggcagttcacaaagtcaacgggaaagttacaaggcttttttcatcatgaagccatgcttcatggtgaaatgagcggggtgcgagcgccccttggagccgttaggcgacctaagcgagcagtactttttctttggtgaagcgtttctttttcttacgagaaatagaaatggttcaaacaccattattatgtaataataaaattttttatatggggtcatatacaaagttaattttaataaatatttttttgatatattgaacactgcgtgttcagatgatggctcacctaacgaggcggcattagccgtgtttgagtattcatattattgacattgcaggtaatggcaaaacaagttagtatgtatcacacacacttttaaaaaaagtgtggtcacacctaccgatgttcactgaaaaccacaattttttatatattaatttaaaaagaaaactcagttttttaataagtaaaataataattaccataactaacaacggggcacgattaaaaatcggccccgttgtcttatttatttaaattttcacactttaaaatttaattgccaagcaaccatattaacctgctgttttatattgccgcgcaatttaattattctattatcctgtctatatcctctttcaccaatttaagaagctcattggcctcctcctcagtctcgcctttcatcaaacagtacagcttaattttcggctctgttcccgacggacgaattataaagttgttctggtcttcaagctcaagataaataacattagactttggcagaagtatcccgctcttttctcctgtcagcttatcaactctctcacttgtaagataatccctcacagcaataacctttttgcctgcaaccatctccggcggattctctctcagcctatccattgttgactttatctttgcaagcccctctattccctcaagcgttacagacacaacttcttctttatagtatccatacttcttgtagatgttgtccatctgctcaaatatagaagttccgttctcctggtaataaagcgccatttcagcaatcagcattgtcgcaacaaccgcatccttatcacgggcgtaggttcctttaagataaccatagctctcctcaaatccaaaaatgtacgttcctattccgttctcttccgactcttttatcttctcgccgataaacttaaaaccggtcagcacctctttcatttcaatgccataagcgtcgcaaatggcctgaattatattagtggtaactattgtttttactatgtatccgtcctttggaaccgcattcttttctgcaagagccgaaagaatatattccgaaagcagggttccaacctggtttcctgtaaaggtaacgtattcgcccttgtcattcttaaccaaaataccaactctgtcgctgtcggggtcagttcccactattaaatccgcaccgcattccttagcatatccgatggccagcttaaacccttccttattttcagggttcggggattctactgtagggaaatcgccgtcaggaagctcctgctccttcaccacaacgacattgttaaagcctatacgctttaatatctttctgacaggcttgttgcctgctccatggaaaggagtataaacaaatttcagggtgtcgcccttttctttagcgagctcaggattcacacactgcttttgaacttcgtccaaatatgcctcctcaacctcgtcgccaatcataacaatcatgccttggtctattgcctgctcaaaatccatctttttaacgccggtaaaaatatccgtctttcctatctcatcaagcacgattgttgcaagctccggattcagctgtgcgccgtctgagccataagccttgtatccgttatatttcgccggattatgactggccgttacagctatacctgctgtggtctttaagtatcttattgaaaacgacagctcaggaacgggcttaagctcctcaaacaaatacacctttatcccatttgcggccaatatctgcgccgcctctttggcaaacacatctgacttatgacggctgtcataagcgattacaacgcttaaatctgcgtcctttccatttgtttttattagctgattcgccaatccctgggtggcctggcccacaacatattcgttcattctgtttatgccggcgcccaaaacacctctaagtccggctgttccaaactccagcgtcttataaaagcggtcttttatttccgcgtcatcatctttaatgctctcaagttctgccaccgtttcagggtcagcttcatttatccatcttgcatattcatctaaatattccattttttgcgcctccgatttgtttaatttgtactatagagacattatactactaattcatggcaatttcaaccacttttaatgtagaaaaaaactgcggttttttgtatacatttctgaaagattagaagaggtataacaaactattttaaatatgttcacgctacgcgtgagatggcagctcacctaacgaggcagacgttgtctgccgcgtaaggcgcgcagtcacggagaaatttgtaatcaaaaagaattatgacaatccaccatatgtatattcacgcttcgcgtgagatgacagctcacctaacgaggcagacgttgtctgccctaccgatgttcactaaaagcgtgagatgcagggtaataattctaaaataactaattatataaaactgtggtatagcaagcttcggcagagtaaacgtagtttaccgcgtaaggcgcgcagtcacggagaaatttgtaatcaaaaagaattatgacaatccaccatatgtatgttcacgctatgcgtgagatggcagctcacctaacgaggtgtgcttacgcacaccctgccgatgttcgctaaaagctgtttgcttatatatacttattattttttatgtattattcttatcagtaattatttcgttagctatttgatataactttataactttatattatcacacatataaaatataaatttattcaactttatatataaaaataaccgcttcacattttagtgaagcggttgtttttattaatccattttgctgaattggtctttgccaactccgcaaagcggacatacgtaatcttcaggaaggtcttcccactttgttcccggagctatgccgttatccggctcgccttcagcttcatcatagatatatccacatatatcgcatacgtatttcatttctcttacctccaaaattatatattaattaattatttttcactctgccatactgaaatttccaacaaacattattagtttgcgctatctttattgaaaaatacattacatcaacaagaatagatataaaatagtaatgattactatatttgagattatataccatttcacattatttgtcaacagtttttttatatttttctttagccgtactaatctcatcacgttcccgctgtttgggttctttaatatcggcttttgcctttgccagcttttcagcatccctatcggcttcaattttatttttttcagcgtcattatctgttagattgggtgatttatcttttggcttcgtttttgccatgccgcttcttttataagctgtgactcctattaatatcaagagaccaaatgcgagcaataatatccccaaaatcttccaaatattgctgcgcctgtgaagcacggtaaactgtcctgccctgtcagtctcaaacaccaaataactgccgtccctttcggcgtctaatattttggtcttgccgtttataactattcctatacagtttccgtcctcatccttatcacggatatggacttttatttttccgctgtattccggggttatttcaaattcgtatgccgcaacagtcttatagtcgccggaataatccccgtccgcgtctgattcccatgcgtgaacctccgaaccgtctttaaaatttccctcaacgagcagcagaggcggttcttccgccgtccctaaagtctttacagcatccaaatactcagctttaaatacagtgtttcttcttatggggtctgaggtatccttatcccactgcgggcaatacccgtcgcgaggctcaatatcgggtatttcttcagagtttaaaacagtattgtagtctaccgtaaactctttgactgtctcctcatcaatatcaaatttcactttaaaatgaaaagccgcatattcagctgatttcgatttaatcaaagcgcctatatttgaagctgaattatcacttaataccctattttggggaagaaatatatctccgctccccatataccatgtatcgttgctgaatcctgtcatcttttcagggatattatccgctccggtcatttcagtataatccagagccacggcttttccttcataatcggtgccgtcaataccgctcagtccctcttttataaaatagttgttctgtaccacgccgcctgcggttcctgttattgcgccgctcttttcaacaacaccgtctattctaggcagagcgtaacaggttgctatagtatccccctctccggctatgccgccgacatggtcgctgccctttaaatctgaaatggctgcacaattatatatcttgccttttgaatatcccgcaatacctccaacatatcccccctcatcagaagttatattggtttcagtcacagaattttttattattccaaaagacgcgtcgccaaccactccgcctccgtagccgtttctcgaaaaaacttctccctcgcttatacatccgttaaccactgctttaactatagaagtcggagtaattatttttccgctgggaagagttacattatttccgtacttaaccgccgactctataccaatcgttccgcctattccgcccaagtctttttcacctgtcacttcgccgctgttgacgcagtacattacaagggcgtcgtcggtgttcattcctgccacatttcttgatatgtcgatatctacgctcgtcagattttttaatgtatccttgatttcatcctcatttaaatccagtttttcatccgcatacgctgtcatgaatatagtatccgatataacgcttcctaccgttttcggtttagcagtcggaaaaagtccgcttaatatatcattaaccttttcaatagcctgtttaatatctgttctgattttggtaatctgctcattggcggcgtcaatctgtgccttcgcattctttaatattgtctccgcctgctttaacggtccgcttatggcgtccgcaatatcattggagtcatttcttatagagtttaaggttcttgtaacagcattcagcgatgaagttatactgcttgaaatagggtcgagcatagtatcctgaatataatccagcctgccgtctaaagagtcaagcctgtcgctcaaagtctgccagtctccgtcgttgtaagcgtcatttacatcggttatcagattatcaacgtcctgcagaacatcatttaaactctcacctgcccggttggcggtatctatggtattattaatagaatccagcgcttcccctaacgaccctttagtctcatcgttaagctgatccaaaagtaaacttcccgactcagaaagccctcccaagtcatcacttatctctcttgccgaatccgagagactgtccagcaatcctgtcaggcttccgctgtcagacgagctaattctgtcacgtatcgcgtccaaaagcccggtttgactgctagtcaaactgtccaaagctcctgacaatgacgactttgttccgctcagccccaaaagatttgaaagaagtccgccgccgccaaaaaatccaaatctgtcaagaactccgtttatatcagtgtttaacctatcccgcagactgtctatatcgttaatggtattattccagctgtcgtcaatatcactcttcacgttttcacgaatctcgttcacatcgtcctttactctgtccaaatcttctatgcttatatcagtgtaaggctcaaatctgccgaaaattccgcccacgcttttagacccgaatatatcacctatattctgacactctataacacagcccgactggtttccaacaattccgccgatatttatccctacatttttatagccgatttcagcgtcattcaggcaattttcaagcacgccgtcgtttatcccgcaaattccgccaatgttatggctctcctccaccggagatgaatttactttgcccgaattcttggatgacttgacccagccgtaattctttccgacaactccgccggtgtctttgtttcccaaaacagaactgacattgtaacacgcttcaatatatccgttctcctcattctgtccgactattccgccgactatagcgtctccctcaatctcgccgtcaaaggaacaatttatcactctgccctggtttttgccgactattcctcccaaaactgagatagaattctcgtttattatgtctgtgcttattccggcattctttaccacgcttcctataacgtcgctgatagacgcggctccgtcagtaacctttttcgcttttactttacccgaaatattgaggttgcgtatttctcctccctcgccgagttcaaaacacagtccttttgcagatccgtcaaagtttaaatctatattggttatacggtgaccgcctccctcgaatgtgccgcagaatattttcataggctcaaactcggttcctgacatatctatatcattcagcaaagtaacctgcattccgcgggaatagctgtcatacacacaatttttagcaagcgccgcaaaatctcccggcgttgatatggttattaccggggcggttccttctccctccgccaaacaaatatattctgccggacaggaaacaaggatgaccagcgccgccataaacgcaagaaccctgcgaagattttctgatattctattcattacaaatcacctctttttgactattttactgcttctgctcgtcttccggaccgctcatattctcaactatcgctttaacatcgccctttaccattccgtgaattgttccgtttacgtatccgtttatatagccttttactcttccgtcaacataaactataccggtgcgttcctttttctctttcttttttaatgtaaacgctcccttttcgaccagcttatcaaatagcaccatgatttgcggaagcagcgtcattaccaagattatagagataagtgttccgcgccccaaacattttcccaaagccgaaataaccgggttggttgaaataaaccctatcaggaagccggcaatcatcattatcaatcccgatgtcaaaatcgttgggaacgcgccgtttatagcttctattgcggcggcttttttaccaatctccggctttagttcaagatacctgttggtgaacactatagcataatctatagtcgctcccatctgaattgagcttaccaccaggtaccccaggaaatacagcttctcattcataaggtatgggaacgagaagtttatccatatactgccctgtattgtaagcaccagcagaactggaactgatgaagacttgaaggtcgccagcagaatcagcagcactgaaataattgtaaaaaggttgattttctgattatcgccgctgaatgacgattttaaatcaagagctgaaatagcgttgctgacaagaataggatcgtcataatacctctttgcttcctcgcgcactttatcgtgcagagctataacttcgtcgctctcgttctttcccttatatgtaaacacaagccttgaatactcttctccctcaagctgatctctggcgtctgacaccttgtcataaacctcgtttatgtccgaattcttttcctcacccaaatctataacgccatagtccatctgttcgtgaacaaacatcagtatatccataatagacacggtataactgtccacgtcctggaatattggggtatactgcgacactgaagcgccgtaagcctgaaacagaactctggaagttgcaatatccaaactcatcaggtcagcaaactgtctcggagtaaccttgtcagtcaggcaataatcatcgtctacctctacgtttgccagtcccaatgcagtagaaatgccgtcgtattcttcaacatcctgaagtattttcttttccttatcatagctccctttcggcactatcactgcaagctgtccgccgacgtcaaaattttcttttattttgttctctgcctttttgctgtcgctcagcctcggactggacacagaatcctgatcgaaagcgtattgacacatagacgacagaaatattgaagacactattaccaacgcaaaaattattggaacgaaagaccttgttttcataacaatctttccccaaaaagatatatcaggcacataatttttatgaacggttttgtctatagcgtttgaaaacatatacaaaagtccgggcataagcaggaacactgttataagagaacatataattcccttacagagcacaagacccaaatctttgcctataccaagctgcatcgtcataagcgccgccagtcctgccacagtagtaagactgctggaactgatttctataatcgctttagacagcgccgccactatggcgtcatgtgaatttttagtctgcttttcttccgcaaacctgtgtgacaaaataatagcgtaatctattgccagggcaagctgaagaacgattgccaccgagttagatataaatgatatggtaccgagcagatagtttgttcccatatttaaaacagcagcaactataaacactatcaaaaatactgcaacgtccataaatgatttagaagtaaacagcagcatcaaaactataataatagccacatacattattatttgtctcatgtccgccgccaaactgtcagacgagttgtcaatcgacgcagaatatgtataacagtcatactcagcaaacttatcttttacctcattctctatttctatctcacgctcattgtcaagaccgctgtccagagttaccgtatatatagctgaagagtttttataatggtcctcgctgtcgtcgaactcaacttcttttacgccgcccacctcttcaatcttgtctgtcattttttctgcctggttatatggaatatttgaaatcatcagtgaaaaagtgtcgtgagtaacaaattccctgtccatcaaatcaagcccttgctttgtttcagtcgactcaggcaaatacgctgaaatatcattttcaacctgaactttaggaatacaaattgcgcagaacacaaaagcaatagcaaacaacagataaaatgcttttcttttgtctactataaacagcgctactttttccattatattctcatctgaatttttcacggtatcactccattcaaatctactcttaacaatattatattctgccgcctgcatactgctataccggcgcttcttcgtctatttcacagagtaagtataataccattccgagctttattcaatagacaaacactatattttgtcgtataacttaatttttgtataaaatatacaatcatgtctataattatatgttatttatttacttgacatgtgtctgtttttattctataatgtatgctgtaatagtacatttatgaatatattttgttgaggtgagaataatgcaggagaatcaaaaaaaggaggacctcagaattaggaggaccaaaaagctgctttctaacgcactttttgaattgattaagaaaaaaccatttgacaaagtgtcggtctgtgatatttgtgacgcggcaatggttcaccgcgcaaccttttattcacatttcagcgacaaatacgaacttttgacctacagcatagacgaacatatcccgcttgacaaactggaattttccgctcacggaaccgatggagcagtaaatcccgaaaaagttgttggtgatattataaattacgttgcaagcaataaggatatatatgcttccatactaaaaaagaacaacgactattctattcccgacaggattcaggatttgtttgaagaaaaaatattaaaaattgtgaacagagccgttgaaaacggcgaagagattcctgttaaaccggaatttttggcaagcttttattccggcgcctgtctaaacgttgttaccaagtggctccagggcggtatgcccctcactgcggacgaacttatcggtaacttaaacacacttttatccttatcccatattcattaatacaaattctacaaaaattatatttttgcttgatttttatcctaatccgtgctataattcctttttgtaacagatatgtaacatttctgtaacaatcaaaactaactttggaaggaattataatgatttttgacagaataagaaaaatggcaaaagatatattcaagcccaaactggcggcggttctaacagccggcgttatgattatggggtgtgttccggcttttgcgatagagtcggaatatgattatgattttcagattgacgtttccgcattttcaaacgcagagctcggaaccatatcctctgacactccgagcggaacgacagctgatattactttaaacggaaaccagctttatataaacggccatgagaaatatttagactcgccgatgctttatgccaacgacacgctgatgctggccttgacatcaatgcagaattttatggagtgtaaagtctattatgacccggcgttatacactgcctatattattaaaggcgaatattctatcagaatagcgcttggaagcaatttggctataattaacaatgcatacacagagtactgggacgagccgctgataaactatgacggcacgctgtatgttcccctcaaatccttaatggattcactgtggtatacaactgatatgtcatataacggaagcgtgaatataatcagtcatgctcccgaaaactatcaatacagttatgtcggcggagttcatgttgtgtacattgacccgctgaatatcaaagctgaggctattgttaacaaatccgccgaaagctcagggaaagctaactacagcaattcttcattcttcggctgggaagcaacaggaaacacatattcggttggcattattgtaagcgacggacagattatctctaattatgcgacgcacggctatccggtaaccacgcttattgtacactatgacggttctgttgaagtaaagcaggtctatgacataacgactgagaacaatgttatgtttgcggtcagcggatgcggcgttctgccgaaagtcatgtcctcagaagagggttttgtcggagcatttgatattgacagatacaccaatagaacttatattggctacaacccggaaatgggcaagatagtgctgtgcgtaagctcatctaccacgctggctcgtgccggtcaggtattatctgatttaggatgtgtgggaggtttggcactggacggcggaggaagcgcggcgcttgggctaagcaatggaactaagttcagttcggacggaagaaagcagtatgctgttttatattgggaataaatattatatagccggagaagttctccggctatttttattttaatgcagaaagattaattgtaaatctaatcaatacgctgtttaaaaggtgattattatataataactacatatatctaagaaataataaaaaacagcataaatttattttatggtaatctcttttatatatgcgtttatataaaaacatataagctatttagttataatcttataccacaatttactctttaaattcaccgtaaatatcaccgcttcttgttatttcttatataatatcgctaaggctgaatagaaagcaatatagaattcgggtgattatgccatccctccgcaataaaaggagatgataacttatagtttagaatgacataatttatttaatagtatttctcttgttaattatataaataaaaatctaaaatagcttgagttaacttttatctaatacttttgcacgaccgtataaaatcctgccttttatcttacatcctttaactttgtctgcttatgtattatttgcttataaaatatatgtacagaatatatgggtcattatcaacaaattattaaagtttctaagagattaggctaataaaataatgcccacaaataaaagaagaattaattttgaacactaaatttgggtataactttttttatgatttttatatcttattaaaaacattattgtctcgtttatttttattgctatttatttaatatataagtaattaaatagattaaaactattaacccctataacgactctttatataactatcttttaatctagagaatatgtatcttttctacatcatagaaacaaaataaaatttttactttaatttattctattttatgtaggtttgtcaatgatgtgttacaaaaaagattaaaagagttcaccgaaattgataaaagagttgatgtagtcaattggagctttccaattactgataattaatcttatagaaagttataaagataataataaaagatattaacaaatccgcgactgcgcacctaacgaggcgcataaatgcgccctaccgatgtttgccaaaacaacagtttttattagagaaaataaataatatatcggaatatctttattcacggcagttcacaaagtcaacgggaaagttacaaggctttttcatcttgaaacgcagattcaagatgaaattagcgtgggcgagcgccccttggagccgtaggcgacctaagcgagcagtactttttctttggtgaagcgtttctttttcttgccagaaaaagaaatggttcatacaccttattatgtaataataaatttttttatatggggtcatatataaagttaatttttatgaatatttacttgatatattgaacactgcgtgttcagatgatagctcacctaacgaggcgcataaatgcgccctcccgatgttcactacatacccagtcttttgtgtaataattaaatgattcaaacacctattataagtaaaataattattattatatggggtcatatacaaagttaattataataaatagtttctttatatattgaacactacgtgttcagataatagctcacctaacgtgcttgttaacatacatcacaactaagcaatttattgacattgtaggttaaacaaaacaaattaatttggttcacacgcacctaaaaggtgcggtcgcaacaagcctaccgatgttcactgaaaaacccgcttttttataataatcaaatagtttgctttttaacatatggtttaatatattagtattttagtagaattatagagtattataaaatcttatatttaatttttatcaaaaatatgttataattgtttaagaagcagataaaggagcggttattatgtttacactcgctcataaaattaaatataagctaactcaatttttggccgctctgccatttggcaggagacgctgtataatttgcggcaaaaaatctctctattttttaccttgcggtcaaaatgaggatatatttcaaaagataaatattatcggcggcggatggagaaaaaactgtaagtgtcctcattgtaagtctttagacagatatcggtggacgtggtatgttatcgtgaattttacagacattttatcaactgaatgtaaagttctgcatatagctcctgaaccgcaaatagcccaaaagataaaaaagataaatccgaattgtacttacataaccggtgatttagctaaagggcgcgcagactatattatggatataacaaatcttacagctggaagtaatacatttgactacgtgattattaatcatgttttggaacatatttctgacgaaaatgctgcgctctcagaaataaaacgagtattaaaaccggacggaaaatttttgttttttattcctattgcgaaagacagaaaaacttttgaggataaaacaatcacttcctccgcttccagaattaaagcctttggtcaagacgaccattgccggctttacggcaatgatgttttaaaacattttgaatcttttggatttaaaatacaaatatacacccctcaagaattattagaaccctctaatatcaagaaattgggctttcttcccgatgacaggctgttttcagcggaattaaacaaatcaagtgaatttgcagataataattttcagaacattttgttgtaatattaagataaggcagataaaaatagtgattttgattacaagtcactatataagtttttatttaagatataaaacaaatttcatattataaaaaacttatttattaaaagcaaatagaaacaatattacggcttcaataatacctttactgaattcttacatcataaaattcataataaattactaactgtatctaatttttaaaaataattttacatacctcaacagcaggacagcatattactgacctgctgtttttatatacactgcttattttataataatatctaaaaaatcatagatatatttcggttccatataaagagcctcgcacaacctggtaaatctaagagctttttttgcctcatcaaataaatccggtaggtattcaacacatttgctgtctttataaacctttactgcatacgacgtgtaactgccaatgtctatatgatggtagctttctttttcatatgtatatctatatatcataccgcagactgtccccgccggcacacattcttatttttcgagtgtatattatgatacataattctataaatatcaaaaacattgatgtattttaaatgaaactttgaatctaaactttctaaatacacttaacttcgcatccttagtcaaccttaaatgtttacaatatccatttctctgtttggatccatatccggaattacatagccgttagctattaatttatctacaaaatcatctattttgacatcaaatatttttaatatattaataaaatttaatactgttggaacacatcttccattttctaaatttgcatactgcctgcaggagattctgcatatctcagccataacctcctgacttatttcatattctgaccttatttcatataaaagcccgccaaatgttgatttaactatcttttccatttcaatattgttcattaaattcactcctgacaaaatatagaataattttatcagaatttgccatattttaacaggtaacacatttcagaaaaacgcttttagataacgaaatatattcacttaatttgataaaatatattcaaaatatataaaaggcaaaaattagtccattatatgaatgcaaaaaatcatttcattaaaaataagatactataaaaaattttattttcccgattaatatttataatatgtaaaccacagctaaaagctgtggtttaaaaactttaacttattttctcagcctgcatcttattgaatcagaaaaaatgcgttttcactcggcggcaaaccgggttcggtttgttttgccaatattgcgtctcctttagtaattgtcacattaaccggaacatttacactccagtttccgcaaacatcaactgccgtataaacttgagttccgtcagaaaatgtcactgttatttcagcccccggaacaccggtgccgtttacacccctgtaacattcacttacagacgtaatgaccggacgctgactacgctcctcccgagtattataaaccttaaaattctgaatcgggatcccattaaccgttattgaaccattattagacacaataacatcatacatcttattatccagcttataaccgtcaggcgctattgtttctctcatggtatatattcccggaacaagtgtgccaaagtctacattgccattataatccgaaaccgctcttgcgccatttgaaagtctaaattctgcccctgcaagtcctaatgtgccgttttggtcagtctttttaaaagttagtccttcagacggctgattttctattttgaattcacccataggaattccattgattgttattttaccacaattagatacttcgacataataaacccgtgtattcggcacgtatccacccgggacactgctttcaaccaaggtgtattttcccggagacagattgttaaatctaactgtgccattaataccggataccgctttctgaccatcagacaacgtaaatacggcgccctgtactggcaaacctgttacggaattaacttttaaaaaagataatgatataagcggattattacataactcaccgcattctgaactctttccgtctattattacctttccgtttggttcaactattatctgatgaaccttgtcatccaactggtatccgtcagctgctgatacttccgccaattggtagcaccccggcataattgacgaaaaattcagcgaaccatctgtacctgatgttacagtttcaattacttttccattcttgcatattgcataagacgccccggatattggttcgccggttacacaattacggacataaatagtaaacgaaacatcttcaggctggttgcacggataattgccgcactgacagcatgctttacagcaatggcagtttggacagcgtgcttgacgacgattacatacattacaaagtgttgacatattactaccccctcctttccatattatgtctattctccatttttcgttcttttttttcttaaaaaatctacattattttatgccatatccatattataaaaaagtaacctatttactataaagctcttagacaaataaaaaagaacacatttcatgtagtgatcaatcacaaataaaacatgttctttttatctttactctttgcaaaatggctaaatttcacataatatgaacaaacaaaaatctgaacagaagaattttattttttcattcccctttaaaaaataacacaactcctctaaacgttaaattcaatccttatgacaatattttgacattccgcagctgtcgcatccacatccgcaagaacctttgccgcgttttttcttcctgaccaagtgtattactattgcagacacaatggccaaaagaataattgaaactattattgttgaaatcataaaatcacctctaaactctcataacttttctgttaacctttaagatatttgattcttttccgggtctcaacagcagatatatgaatgctgcaataatcaatagagctgccaccgtccacacaccaaactctccgcccgtgaacaagtttccgatttgataaattgcaagggctgcagtataagcaaatactgtctggtatccgattgcaaaccaagtccatttagcgctgttcatctcgcgcttaatagctcctattgctgcaaaacacggcgcgcaaagcaaattaaacactaagaaagagtaagctgctatcgcggtatagcttgcagctaaggagctccaaatctctgctccgtcttccgcaacttcgccaaacccatataaaactccaaaagttccgacaacattctctttcgcaatcaaacctgtaacagcggcaacagcggctttccagtcaccccatccaagaggcgcaaatattggggcgataactccgcctatctttgcaagcactgagttatttaagtcttctaccattccaaagcttccgtcctcaaatccaaagccctgaaggaaccatagaactatggttgacagcaatattattgttccggctttctttataaacgaccagccgcgttcccacatacttcttaaaacatttgtcactgtaggcagatgatactgcggcagctccataacaaacggagccggatccccggaaaacatctttgtctttttaaggataatacctgaaaccacaatagccgctataccaacaaaataggcgcttggtgcaacccaccatgccccgccgaacagagctcctgctatcaatgctataatcggcagcttagctccgcagggtataaatgtggtagtcattatagtcatcttcctgtcgcggtcattctcgatagttcgtgaggccataatacccggaacaccacaaccgcttcctatcagcataggtataaaagatttgcctgacaaaccaaactttctaaaaattctatccataataaatgcaatccttgccatatatccgcagtcttctaaaaacgcaaggaatataaacaatacaagcatctgaggcacaaatccaagaacagctccgactccggcaactataccttcaaggataagactgtttatccaatcagctgtacctattgcattcagcaggtttttcaacaaaaccggtattcctggaacccaaatgccaaatagattccagccttcgccgaacacaccgtcatttgcccagtcagtggcccaagcacctacagtggttaccgacacataatacactatcaacataaccacagcaaaaatcggcagtgccagccagcggtttgttaccactctgtctattttatcagaagctgtaagctttttcttcttatttttcttataacatccgccaataattgacgatatgtacttgtatctggcgtctgtgataatactttcagcgtcatcatccaattctttttcagctttagacactatatccgagacatcaggaactatattcattaaattcctaattttattatcgccctcaaaaagctttatagcatagaatctcttttgttcatcaggaacatttataccaattcttttttcgatttctgacagccactcttcaagacggttgtcaaaactatgtaatatcttaacgccgctgtttcttttcgctgtctttacagctttctccgcggcttcctttactccatttcctttcaaagccgaaaccggaaccacttcgcatcccaattcttttcccagtttgccgaaatctattgtatcaccgctcttttcaactacgtccatcatgttaacagcgacaacaacaggaattccaagttcaataagctgagttgtcaaatataaattacgctcaatattactgccgtctacgatatttaaaatcacatcaggatgatcattaatcaaatagtttctagctaccacctcttcaagagtatacggagaaagtgaatatattccaggcaaatccataatacctacgtctttatgacctttaagttttccctctttcttctcaacagttactcccgtccagtttcccacaaactggttcgcacccgtaagggcattgaacattgttgttttcccggaattaggatttccggcaagcgcaatttttattgacatctgcatttacctcctatattacagccgtatgaaccggctgcaaccaaataattttagtttacttcaatcatttcggcgtctgactttctgatagaaagctcgtagcccctaaccgaaatttcaaccggatctcccagcggagccagtttgcggacaaaaacatcagttcctttagttatacccatgtccataattcttctcttaactgcaccttctccgcggagctttgaaattctgacagtctccccaactttcgcgtctcttaacgttctcattttaacatctccttttaatttttaaaccatgattctgtttgccattgatttatcaatagctatcctggtatctttaacattgataatcatattgcctgataactcagaaacgacagttatttcaaccccttcaacaaatcctaaattttgaagaaaccttctgacttcatccttaccgcctacttttataactctctttttctcaccaatctcagccatagacaaaggcatcatgcttcccctcctttcaaaaaatatcttatttttattatatttaaattgatattagttagctaatactaaccatacggtataaaatatagttagctcgcgctaacctctataaaaagtatatcatcgctccataaacctgtcaagcaaattctaataaaaaagtgtttttttgtctatttgcataattttgttaaaaataaaaggcaaaacatagttagtgtttgctaactatatataatcatacagattaaattttaacggcacagaatttaaactgttaatccattctatgtatcacaatacgacatattttaaaaattatttataagtttacacaaactcttctgtgtttagaaatgacttaatttttagtaagctttttataacatatttctattaagctgtgcatttagaatttcactaaagtgcacaggtcagatagaattaataatataaattttctataaacattccgtaggccgcttgacagtgcaaataatcctctatataatttttatatattacagaacggagaataaaaatgaagaaaattttactactggaagacgatgcgagccttatagacggattgaaatattcgttaagtaaaaatggtttttctgctgattttgttggtactgttaaggaagctaagatatttttaaaaactgaaaaatacgacttgcttcttcttgatgttactcttcccgacggcacaggttttgaaatatgtgattttgtcagaaacaccgggaatacagtccccatcatctttctcactgcttctgacgaggaggtcaatgtaattcggggcctcgacagcggagctgacgattatattacaaagccttttaaactggccgaactgttttcaagaataaatgcactattacgcagaaccggtataacagcacaaaaatataatgaaacttcagttaaatgcggagatgtaacagctgacttattaaagcatactataattttaaacggaaaaactcttgaattgaccggcgcagaatataaactcctgctaattctgatacgaaacgctaatatagttgtaaccagaaatatgatattaaacgagctgtgggactgtgatgaaaaatttgttgacgataacaccctttcggtatatatccacagactgcgcaaaaaaattgaaaatgatccgtcaaaaccacagcatttacttactgtcagaggattcggctacaaatggaacgaggtggggttatgagtattttttatgaaaaagaaacccggaacttttgtgtttctgtcgtgttaattatcttatttttgtttgtgctcgaaactattttgtgcatataccaaaaagacatcattcaaaagatttttgtatcccacgaccaatctatcacggctgcgttattggaaaatggtgtttctgaaaagataatagctgaatctttgacaaacacaacaaaaagtcctcaaagttatgagcttttaaataaactcggaataaccgaaaaaactgactcaagatttttaccttttgtttcagactttcaggtcaaatcaaaaacatttatatttctgataacatctgtattttttcttttgttggctatattaattattatttttttatataaaagagaccaaatttataaaagagcaatacaaaccgttacctgctacacaaaaggagatttttcttcaaaactccctcaactaaaaaacggaaccatttatcatctattcaattccattaacgatatggctgctgctctaaaatccaaacaggaggctgaacataaaacaaaagaatttttaaaaaatatgatttctgatatatcacatcagcttaaaacgccgcttgccgcactaaagatgtataatgaaatagtattggacgaaccgtataacactgagaccgttaaaatttttactgaaaaatcatcctcttccattatacgaattgaacagcttatatcttcacttttaaaaattgcccgttttgattccggcagtattgaatttaataaatctgaatacacattaaacgaaattgtttatcagtcaataaacgaattgacaaccagggcaaaacatgagaacaaagaaatttcaataaatggctctgtaaaagataaaatattttgtgatagacagtggacggcagaagcgttgagcaatatagtaaaaaacgccttggatcacaccgacgcaggcggacatataaaaattgagtggaaaaactccccaatatttactcaaatttttatttccgacgatggctccgggatttctacagaagatatccattatatatttaaacgattttataggggaatcgtaccaacccaaaacaataatacctccggaataggtctcggtcttcctctcgctaattcaattattgagggacaaggcggaaacatcacagtaaaaagcgagttaaatgccggaacaacttttacattgaccttctttaaatagtatatcttacaaaactgtaagataaaattcacgctatagtaagccgcgctttgtattctcagtaaaaggaggtatttaacttatggaaatcttaaaagtacaaaatctgagtaaaacctatggaaacggagagacacgtgtagatgcgttaaaaaatgtctcattcaccatgaacaaaggggaatttgcagcagttgtcggagaatccggttcaggaaaaagcaccctattaaattgcataggcggtcttgaaacgccaacatcggggaaaatatatataaacaacgatgacatatttaaaatgaaagagcaaaaaagaactattttcaggagaagaaacatcggttttgtttttcagtcttttcagcttattcccgagttaaacgttgagcaaaatattatctttcctctattactggactataaaaaaccggacaaaaaagacgttgacgaaattcttaacgtgcttgggctttcgaacagacgtaagcatctgcccagccaattatccggcggtcaacagcaaagagtcgcaatagggcgagccatgataacaagacccatgttgattttggctgacgaaccaaccggaaaccttgacagtcaaaacagttccgacgttatagaacttttaacaagagcttctaaaatattcagacagaccattttaatgattactcacaacgtaagtcttacttcatctgcagacagagtattccatgtagccgacggcgttctcactgatttgggaggtgataataatgaaaagttatcttagccttatccctatttcagccaagatcaataaaaaacaaaataaaatgactatggtatgtatcatactcgcagtttttcttgtaaccgccatattcagcatggctgatatggaaattagaagccagaaaataaaagcaatcaaagactatggaaactggcatatagcattgaaaaacatatcagaaaaagatgccgggatactttctgcacgatcggatattgctgcggcttcttggtataatactttaaattaccgtttaaaagacggatattttattaacggtaaagacgcggtgatatgcggaacagaacaatcgctgctcaatgatataatgcctgactctatagaagaaggacaatatccaaccgatgataatcagatcattctgacccaaaatgctaaggatatactaaaagtatctataggcgatactatcgagattaatctaccttcaggcgagagaataaattatattatttccgggttcggcatggacagttctatgatttcacaagctgacgcaatcggcgcctttctgccaatgcctgcttttaaaaatatttatagctctgctgaagattcagatatgatatattacgtccaatttgacaaaaacgtaaacattcgcagagcaatcgaagatataaagaaacaatatggattcaccgaagataatatttctcgcaataccgctcttttaggtactatgggatacagcaatgattcatatatgctaggtctttatggctcagcttttgtattgtttttgttggtgctgattgccggagttttaatgatagcaagcagtttaaacagtaatatatcacagcggacgaaatttttcgggatgttaaggtgtattggcgccgaaaaaaagcaaataatacgctttgtgcgccttgaagccttaaactggtgcaaagctgcaataccaatcggagttatcctgggagttttagttgtatgggttctttgttccttgttaaaatttttaagcggcagttattttgaagatatgcctgttttcggaataagttatttgggaattatatcaggaatagctgtcggtctcctcaccgttttgatttccgctcagtcaccggcaaaaaaagctgcaaaagtatcgccgctttcagcaataacaggcagttataacaatactaaaaatgtataccatgctgccggcacaaacttatttaaagtagacaccgggcttggtatatatcacgctaaaatgaatataaaaaattttattctaatgacaggttcctttgcattaagcattgttttatttcttgctttctcagctgttgtgagttttatgaatcatgctataaaaccgcttaagccatatacacctgacgtatcaattataagtccggataacacatgttccgtaaacagagacctaaccgctgaactatccggtttgcgtagcgttaagcgagtttatggacgttcatttaaatataatatgcccgtaaaaataaacggaagcgacagaaaaatagatttaatatcctacgaatccaatcaatttaattgggctgataaaaaaaattatatattagaaggggatttatcaaaggttctcggcaatagtgattatgtgcttgctgtatacagtaatgaaaattctttgcatacaggagataaaataaacctaggaaacgaaacagtttcaatatccggagttctttctacctgcccttttgaaagtgaacaaggaactgagacaattatctgttcagaagaaacttttaaaagaataaccggtgaaaagaattatactataattgatattcagctcacaaatcaagcgactgatgctgatgtaaactatattcgcggtttagccggttctgatataacattttctgaccgccgcctaagcaataaggaagtcaggggggcatttttggcatttgccttatttatatacgggttcatattaatcatcgctctaattaccgtattcaacataataaacagtatctctatgagcgtatcctcaaagattaaacaatacgcctctatgatagcaataggaatggaaaaaagacaaacagtcaaaatgataacagcagaagcagtcacttatgccgtaacaggcagcattctgggaagcgtcctggggcttccaattcataaatttatgttcagctttcttgttacgcaacattggggagatacttggcaaataccgttatcagcactgtttataattatatttgtggttctgttatcatcctttgcagcagtttacggtccggcaaaaagaatacatgatttagaaattgccgccgttataaacactcaataaataaaaataccgcaaaaaattcctataatcaggatgtaaaaaaaagacatgtgtttgatgcaatcaccgattgtcagatatttggttctaacttttggaaaaccattaagttcacctaaaacgcatgtcttttcttatatatatgaattaaatatttaaatataagataatctcattacgataccctaaaaataaatccaatttaaaaggtcatacttgtctcctcaattcaatatacttatatatactcaaacggaaaggaggaaataatataaccgcacggttatattataaatatagtatgagagaagaactgaggagaagaggttctttttccgagccaaaccgcaagaacaatataaagaatgaccgttttgaattaagaatgaaacttatattaaaacaatctatcgccgtggcggtaataataatcggcggtatacttataaacaggtcgggattcgagtttggacgaaactgtatatccgctcttggaagagctgtaagatataattttgactttattggtctctggaacagcatttgtggatttttttcagaaatatggcaattctggagtgaaatattttgaagaagttaaaaaacattttttctgctctccaaacacacctctggcttataccaataggcagtcaccttgcagtaagcccgctgttttttttactggccgccgcttcaatcttaggcggctacggaaaccttttctttattgcatatatctccgcttttctgcatgaattgtcccatgtgttttgcgggaaaaaacttggcgtatctatcgtcagaatcgaaattctgccatttggaatatgcggaaaattaagcgccgggttcattaaaaatccatacaaagaagctgtaatcgccgcagccggacctgcattcagcggcgcactggcagcactgctctatatgctaaacaaaaatccaatgctgtctgtatacagtgaagctatagactacggtataaaaataaacctgtctcttatgatacttaacctagtgccggctcttccgttagacggcggacgaatagcaaaagctattatatcaataaatttaggagccgttcgagcctcaaacttaatgctgaaaatcagcagagtgccaataatcggaatgctgcttgtttcagtatggttgctccttaccaacgacttcaatctgtcgctgatacttataggcgcttttctgctgggaaacttgagtattgaacaaaaaaatatatcattaatatcactgaaagaaatattgtattacaaaacacggcttaaaagaaccgaattttgtcaggttacaagaatggcagcccatgaatcagttcccgcaagactgttcctgcggaaactgggctgctataaatatcatataattgacgtcatagatgacgatggaaaaataacaaaaactgtaacagaaggacagcttttaaacgcacttataagtaagagcataaggctgtcaatgggtgaaatataaaagggtctaatctccgaaacagatacctagttctctgcctgttacaacctcgttggaaccggggctgacgcatttcagttttccggcaacctcgctcagaggaaccggaacaatttcattattctgcaaagccaccatatagccatatttattctcggaaatgagctgagcggcactggttccaatcctggttgtaaagactctgtcatacggacaagggcttcctcctctttgaaagtgcccgggaacacatacgcggatttcatgattaaacttttcttttatctcatccgccacgcgataagcaattgaaggctgtaccatctcagcccttctctgtttaagttctttctttttcaaagcggcctcctcttttgaaatagcaccttccgccacggctataatagaaaacttcttgccggatttttctcttttgttaagctcggcaaccacactgtctatatcataaggaatttccggcagcagaataacgtccgctcctccggcaagaccggcataaagagtcagccagcccactttgtgtcccataacctcaacgataaacactctgccatgagacgtggctgtagtatgaatcctgtctataacatccgttataacattaagcgcactatagaaaccgaacgtcatatctgttccccaaatatcattatctattgtctttggaagaccaataatatttagaccttcctcgctcagtaaattcgcagtcttatgagtgccgtttccgcccagtacgacaagacagtttaaccccattttcatataggtatctttcatcttctgaaccttgtctacattattctcatcaacatccctcattctcttaaacggctgacgcgatgtccctaaaatagttcctccaattgtcagaatccctgaaaagtcgcggggttccatttttttatactcgccctctatcagaccataataaccgtcctgaattccataaatctcaacatcgttctggaatcgctcatataaggcttttccaacagcgcgaatggcagaattcagcccctggcaatcgcctccgcttgtaagaatcccaattcttctcataattattcctccaattttctgttaaacagatttaatatcattttcaccaaaattcacagatttactcaaatacttttaggccctctttttcactgatgtaaatctcagttcggtgtatatcataacttattatatttatttccggcgctagatagtccgacaacgcctttaccgcaatttcaggttttaagtttttttgacctccggcagacaaaattagttccatttgcagtatactgccgtcactgctttctgaatgttccgaaatactgtaatcaattatgaaatccattaaatttacaggctgttcgcctttctttttggtctttttcataatcgtatattccggcatatcaaaaaatcccttgactttttcatcggctatgaccttatccgatataattttaacctgatactttgcggaaactatatcattagcgctgtcctttatatcaccaacatgcaatatccgcatatcaggcggcagattattattgagacgctccattatttcactgtcttttattccgtcctcaaaatcaatgtccacgaattcactgtcgcttgtgacacctattgacaaaggaagtgaaaacgttatcttttgatgagggttaaacccgtttgagtatttcacaggaagttccgccctcataattgaacgtgtaaagcatctcagcaaatccaaatgtgaaatatacttagccatgtttaacttcgaaaatttaagacgtcttttactcaaaacagacacctcctccaaagctggctgctccgcagccgctgcacttttcgcggcaggttggagttgtcttctcctcatacgccctcttatgttcctttatcaaaaaagatttaggcactcctatatcagcgtaatcccatggcagaatttcgtcatatcctatgcggcgcaaagcgtaaaactcagggtcaattccattaattttaaaagcttccatccacttgtcaaaatcaaaaaagtcactccagccgtcaaacttacagccaagtttctgcgcagttatcaaaacttctcccagccttctgtcgcctttagcaaagacggcttcaagaagactgatatcactgttatgccagttataaacaattttctttgaaccaatatgctcttttaaatattttgccttttcctccatttcggaaatcttattctgaggttcccattggaacggagtgaaaggcttcggaacaaaaaatgaggtgctaatcgtaacgcttacgcttctgccttttctctcctcaaccggtatggagaagaagccctcgtcaataacttttttgcccagctcggcaatccctaatacatcttcatatgtttcagtaggcagacccagcataaaatacagcttgattctgttatatccgcctctgaacgctatattggaggttcgtattaaatcactctccaaaacatttttattgataacatccctaagtctttgcgttcccgcctcaggagcaaaagtcaatccgctctttttaaccttttgaactttctccataagctccatagaaaaattgtcaacacggagggacggaagcgaaaggttgatacgcttgtccactgttatatccagcagcttatttgtaagctcgtccaaatcggtataatcgcttgtgctgagcgatgacattgacatttcttcatatccagtgttttttatgcactctccggcagtctcaaccagcttgtcaacacttctttcgcgcaccggtcggtatatataccctgcctgacaaaaacggcaccctcgtatacatccccggaacagctccagcattattctgtcatgcacggtctccataaaaggcacgataagtttttttggaacataagtgttatccatattgaggattatacgttttctaacctgtttcggtaccccttcacggttaggttcgaatcttgagatagtgttgtcatcattatattctacgtcataaaactttggcacatatactccgcccaaaggtattattgacataagaaaatcatcacggtctgtgcttccgctgtttttccattctttatacacatccataatctcgctgttaacttcctcaccctctccgaggataaaaaaatcaaccaaatccgaaagcggctccgcatgatacgcgcatggtcctccgcagcacacaaacgggtcaccggctgttctttctgccgtgcgcagcggcactcctgcgaggtcaagcatattcactatattagaatagctcatttcatattgaagcgtaaatcctataaaatcaaaatttttcaccggaacataactttccatcgaaagcatgggtattccctcttttctcatctcctgctccatatcatcccacggagcaaacacacgctcacaaacggtatcctcacgctcattcagcatatgataaagaatcttcattcccaaatgagacattccaacctcataaacatcaggaaaacaaaaagcaaaagtcagcatatcatccgaccatttcttatgcacgcttccaaattcgtttccgatatatctggccggtttctgcacgcgctttaaacaaccttcatatttgattttatactcgtcagtaaatctgctcataattccccctatttttttagcgagcctaaaagaccgcgaaccaaagaatttacagcggttcgtcccgcggaagtcaaaatacttttagccgccttttcaatctcattataacgcttttctctctgtttttcttctcttagttccgccttggcttcttttatagcttcagctttcattttagcctctgtctcttcctgctgcctgtttattttctcttcctgcgccttattttcagcaatttcactcttttccgctttagctgaaagtatttcataagccgattccctgtctattacagcattatattttgcccccatatcgctggaagctatcatctgagccataatattattatcaacaggtcccatcaaactttgaggaggcagaatgttagcccgctccaccatagaaggaacgcctttttcatcaagaaatgatattaaagcctcgccggttccgcactcggtaacggcctgttcagtatcaaactttggatttggtctaaacgtttgcgcagcagctttaaccgctttctgctcgcttggagaataggctcttagagcgtgctgtattctgtttccgagctgagataataccgtatcgggtatatctatcgggttctgtgttataaaaaatatcccaacgcccttagaacgtatcagccttaccacctgctctattttttccagcagttcttttggggcgtctttaaataaaagatgcgcctcgtcaaagaaaaacactattttaggcttgtccatatctccggcttccggtagaatctcatacaagtctgaaagcatccagagcatgaacgcagagtataaatcaggctgcaaaaacagcttttcgcaatttaatacattaatatatcctctgccgctgccgtcagttttaaaccaatccttaacgtccagtcccggttccccgaaaagggaatctcccccctcttcctcaagtttgattaaactgcgctgtatagcgccgatacttgctgtcgttatattaccataggtatttttaaaatctgacgcattgtctccaatatattgaaccatagactttaaatctttcaaatctaacaataaaagtttttggtcatcagcaatcttaaatataatatgcagaattccctcctgcacatcattaagccccaaaactctggacagcaaaagcggtcccatttcagaaacagtagtacgtatcggagtacctttgttcccgaacacatcccaataatatgtaggatatgactgatacttaaaacctgcgtcattcaatccaaactttgctattaacccctgcattctttcactgtcagctcccggctgactcataccggataagtctccttttatatctgcgagaaaaacaggcactccggcatcgctaaaagattcagccatcacctttaatgtaatcgttttccctgtaccggtagctccggcaatcaaaccgtgacgatttgccatctgcggaaacagaaaaatagggttttcatttttacccatccaaattttattttgataatacatagcttatgtatatgactaaactcgtatttaatcatactcccctttcttttatattttcattgattaacccaatgctgccgccgaaccgtaagtatggcggcagcaaattatattcataaaacattataaaaaattatgttttaattctttcgttttattataacatatctttttaaataataaaacctaaatatttatgtttcgacaaattttacatacctataacgcttttataactccgcaggctattttttcccctgagtttccactgggctgggaatggaagtcatcaggcttaagatgaataaccacagttctgccaataatttcggtcgcagtaaaacggttggttaaaaatgacatatacgcatacccatcattttcaaataaaggcggcaaatctcccgcatggtacggatgcggacactcccccggattatagtgtcccttagtgtttgaaaacggttcctgtccattgcttccgcagtcttcgccctcgtgtatatgaaagccgaaaacaccggaatcacatcctgtttctcccgtaggcagaccatatatatctgccgtgaccagcacgccgttcttctgctgtctgaatattacgcgccctcttatccccggatagttttcgccgcctgatatatcggcagcagaatttggtttataatttgctttgaacattttatattgcacctcctgttaaatgtatgccaaatacatcaaaaccagcacaataataattaatatagaaacaaaacaattctgacggatataatccgtcagaaccgtaaaattataataaaacttttatccgctaatattattaataaaattatataattaatgaagacatttcacttaaaacgagcagtttgtatatatatttacattattaatttatatgctttaaaaagcacagcctagagacaataatattgatatataaaacaaatcccggctaatgcatcagcattagccgggtaataacaaaatctgattttgcttatttcttaggttttatcttctgtgcacaatgctcagaactttatctatctttgagcgccaaaacgacttatcaacaatcaagctgaaaaatctcagcaccgggtcggcaaccagcgcaaacactgccaataacattatgcactgaacactcattgctgttataccaaacaatggtcttaagaaaattacacagcctatccagcctgctatcatagcgataatcaaaagccagtgccgccaattcataggttttgatatacgatacagtatcataaacccaacaacggatataagcactgtgcaggcggttgaaacgctttcctcatctatattaaacatactgcagaacacaactaaagcactgaccactaaaaagtcggttataccggccggagcagccttggtaaaaacattcgttaaaaaccgaccttttatcaagctcttgtttggttccagtgataagaaaaacgcaggtattccaatcgtaaacattgccaccagcgaaacctgcgatggttccatggggtaaccattcaccgcaatcattgaaaacaatgaaagcagcaatgaaaatatatttttaaccaaaaacaaactggctgttctctctatgttgtttacaacacgccttccctctccaacaactgacggcattttagaaaaatccgaatccaccaaaacaagctgagacacctgagaagccgcttcacttccggatgccattgctatactgcaattcgcctccttgagcgccaaaacgtcattgactccgtctcctgtcattccaaccgtttttccctgagctttgagcgctttcacaaactgtctcttctgctcgggaacaacacgtccaaatacgttatatttaagacaggcgtcatatatgtcctggtcagttgtaagactagtcgcatcaacatacttatccgcttccttaattccggcctcctccgcaactctggacactgtgaccggattatcaccggatataacttttacatcaactccttgttcagcgaaatactgaaaagtctcctttgcagttgaacgtatcggattcgaaagcagaacaaaacccaaaagctcaacattatccgttaaggctttgcctgtcatttctccaagatatttaacaaacgctaaaactctatagccttcctcagaatattcgtatacctcctcggcataattgtcaaattgctctctgagcacaaactcaggcgcacccaaaacatagttctgaccgcccaaaatacatccgctgtacttatactgagaagaaaacgaaaacactttttcaggttcagctttcgtagtctttgtaaaaaattccttcatggcttccatagtaatattatcgctgctcatagcggaaaccatattgcttaaaagcgcagtaatacaatctaagtcctttccctctgccggcaccaagcggctgactttcatagtattctcggttatagtccctgtcttgtccacacacaaaacgtcaactctcgccaaagtttcaatacacttcatatttcgaaccaaaactttttttctcgcaaggcgcataatgcttacaaccattgctacacttgccaaaagatataatccctcaggtatcatacctatcacggcggctaccattccggttatactgtcgctgaatgtcgcccccgcaaaaaacatctgctgaataaacaaagtcagacctatcggaataattataatgcctacaatcttaacaagcttatccaaagagcgaataagctcagattcttcctcacgcttatcttttgtcgcctttagcgtcaacttagaaacataagattcttttccgactttcagaagcctgcccctgcattcgccggaaaccacaaaactgcccgacagcagttcatctccggcttttttcgctatctcctcagattctccagtgataagagattcattaacctgaacgtttcccgagaccaccaccgcgtcagccggtatctgacaccctgccgaaaatatcactaaatcatcaagaacaagattttctacaggtatcgtttcctgcacaccgcctcttattacggtggctttcgggtcgcttattattttcaaactgtcaagcgcctttttagagcgaaattcctgggctattcctatcactgtattaaaaaatataacgcccaaaaacgtcatatccttgaaagagcctacaataagaagcaatagagccaaaataacaaatatcagattaaaataagtaaatacgttacttttaacaatctccccatatgttctggtagatgaatccacagattcattcaccgctcccttccccactctctcccttacctgctgaggactcagaccattttctgaatcatactcctcatctttccaggcaggatcaaatacatcggaattctccatactaacctccaaaaaatattttctgcaaccaataaatattataattattaatgtaattcatttctcaaaatcattaaaacgttacacccgtcctactaaaatttcaagcgtcttataaacctcctcaggttttatcggctttgataaatgcgcattcatccctgcattaattgagttctctatatcagtatcaaacgcgtttgccgtcatagcaattataggcactgtttttgcgtcgcttctgtttagactccgaattttttcagcagcttcaagcccatccatattcggcatccttatatccatcaaaacagcgtcataataacccggtttggattttttaaacatatctacagcaatcactccatcttctgcatgctcaacaaccattccgcgtttttccaaaagcttaacggttatctctgtatttatcggatgatcctccgcaagcaaaactcttctgccgcttaaatcacaagtattctttgaatctctctttaaatcaataaattctcttatttcttccgctcccggctctgaaaccggtatctccacagtaaaagtgcttccttgatttataacgcttgcaacttctatggttccgcccattaagctgaccaaatttttcgatatcgccagtcctaatccggtaccttcctgagacgaagaaaatttattttgttcctgttcaaacggattaaaaacacggctcaaaaagtctttgctcatacccacgccgtaatcacggataataaacttattatattccttaccgcctctattcaaagataacgcggtaaattctatcctgtcgccgttatcagaaaattttatagcgttgtttaagagatttattaatatttgctgtgtacgcataacatcaatttttgcatattttcttttaaattctgacctgtcaaacacaaagtcaatattctttgcttggtataatggttttataatagacataatagtggaaaaaaacttatccagctctgctatttcgggattcagcttaactttttgacgttcaatcctagacatatctaaaatatcattaatcagtcccaatagatatttcccggaatcatttatcttcttaaaatactcagtcatttcaggatctttagaatcctcagcgcctaaacttgccaaacttaaaacagcattcatcggagttcttatctcatggctcatccttgataaaaagtcgctcttggcagcattagcttgctttgcctgtctaagtgcgtcttgaagcagccggtttttttcctgttcctgattaaaaacatcagttatatcgctgcgtacaaaaactattatatcacgccgctcattcagataataaatcctatgtttcacacgtctcttttcattaggattcctcttattgtaaactgaatgaattatagaaaactcatctttgtttataagctctttttttatgttttcaacgtcgaaggctttaaaacattcctcctgttcctccggcggaatcatagcgggtatatttaccatattgctttccgtataatctcgtggttcagttcccggaagagctacggcgtcttttttataattcagcattttaacaatattagttttcaaatttaagtatgaaataaagtctacttcttcctcaattgcactctcaataacttccttttttaatatatcatcggttacatcatgagtataaacaaaagcataaatctccttagacctggggtcttcagccatactgatatccgctgaataatatttaattctatctttcccatccggcggcgtaatgcaataaacaacctcatattttctgcaatcattataataattattgagcatagtcgtttgattaaactcttttttgcatatttctatgtccttatctgacgccataaattcatacatacctgacactgcgtcgcttaatctgcaattctgcttaattatattgcggtgaccgttattggtaaccgcctcagctatagtatccttagaaacattatatgtaatactggatacagaatcagcctcaagggcgctctttcttgcaagctcctcttcgaaccttttttcagcttctttttgcttggtaatatctatagctgtgacaataacttttgtccgctcttctcctttgcccgggattgatgtaaaattcagcctctcccagcggtaaccgtctttaaatttattctttatctcacaggatccttcggtttttccagccttagcttcattataaaaacgttttaaatcctcaacgctctcgggcgcggtaatgttcatttcaatccacgagtcaggataattttccataagattctccgcgtcaaaatcattttcaaacggagaagtccaaacaacgcagcctgtctccgggaaatactcccataattttatttctgaatgtcttattgcctcattcagcatcttttcactgagttcaagattcttatatgcttcattaagcttaatactggctttctttgattcatcaacatctgaaaaagaaacgtaaaagacttttttatccccgtctttttcagacaaggttccgcgcatattaatccattttaaaacgcccggttcgcttgtctcaacacgaaccgtacattctcctatctgtccgcattcatttaaagaagctatttcacttaaaattttctttttgtcatcaggataaatatagtttagactatgatttttctcaacactcatagaatcttccatattccgtcccagcattttataatagccttcattgagaaaagataccctgaacttgccgtcttccatctcgcatattccggcgccgcccggaaaattattaatcaggtcattacgctttttataagcaaaaaaactttctgtatcctcgcttatgtattcaatatacgcaggaataccgttccaatctatgagtctggcactgttgcagtaatgccttgtcatatccctgttaaacaattcgcataccagcagagagttataactcaaattttctttccggcagaactcacagcgttctctgcggccaaagaaaacctcatagcaatttctgcctaaaatctcaccgctgtcacacagtcctaatctatacatggcgctgttggcatagagtatttcatcattacttaccgatgctacaaaaacgccggtcggagaatcatcgattattttccgatacattttagcttcatcagaaccctccgaaaaaagtgcggcaaataccggataaccgttctcctcacgtattctaaacgcattgaggtgtatccaagtatgaacattatttttcgtatttaatcgaaaatttatattcatattaggatatttattatttaacactctttcatacattctcataaaccggggcaaatcccccttatatacacacttttcaattaagtctccgtctgatacccaattgtcatattcatctttggtcatatccaaaagctttggcactccgtcgctgtaatacaaagtttctattccgtcaggcataatcttatacacaacagtatttacaagaccgtttaaaatcttttcattttccatattcttattaattatttttttcgttttaagaagtttgtttactagaaacactaaacatattaacaagattaaaatgatgcagcacatcaccgttattaacatcaggttttggctgtacaaattctgccgccctgcgccgttaatcattgcataacaaaacgaaccgttaagcggaaacaaaaataaaacactaaacataagtgcttttagaataactttttttatggaacaaattgactttttcatttgccgttctccaaaattgccgacaggatatgctttaaaatataaccatcagcctttattttctatcaagcattatacattatccaaacctgaaaatcaaggaatttaataaatgtttccagttccttaataattaaatccaaacactatttatttcttatttaggtttggaattattttatttttaatttatatctgaattttatctatattatattttcctcttgtcttgatttcctgaatatgctataatcttttttacatgtagtttaacgaccggttacagtaacgttacaaaaaataatattaccatattttttcataccgaaattttattaattgacaatattttagtagtttcaattaaaattgtgttacaaagagccaatagtttttatagaagtgccgttatataacgctttattgatgttacaaaaaagtcatgaaataagacaaaaaaagccattgtatttttttacaacatatgttattatactatatgttgtgttagtgaatttacatttaacgcaaaatgttgtgattcgagaaaaattcccgaaatttcagttttaagtaataaagcattagagatttaaatatattgccaaatacatatatttaaacaacaattttacgttacagtttttccgcacaaaaaggtttaccggacttaaatccgcacaatagtataatttaggagtgttttgtatgattaaaattattaagaaagacggaacagaagaagattacaacgtaaagaaagtagttgtcgcagtaaaaaaatcagctaaccgcgccttagttgagtttactgatgaagacatacacaaaatttgtgccttcgtagacagcagggttcttaatatgcaaaaggataaaatccatatcgccgaaatgcacaacatagttgagggcgcgcttgatatggtcaatcctgtggtagccaaaagttacagagactacagaaactacaaacaggattttgttcatatgctggacgaagtctatcaaaagagtcaggcaattatgtacataggagacaaagaaaattcaaactcggattcagctttagtttccactaaacgatcactcatttttaaccagctcaacaaagaactttatcaaaagttctttatgactgttgaggaactccaggcctgccgcgacggctatatttacgtacacgatatgtccgcaaggcgagacactatgaactgttgcctgtttgatgttaaaactgttttaagcggcggttttgaaatgggcaacctttggtataacgaacccaaaactttagcggttgcttttgatgttataggcgacattgtattgtcagcagcaagtcagcaatacggaggttttacagttcctgaagtagacaaacttttggctccgtatgctgaaaaaacatatgcccaaaataaagcccgctatttagaaatgggtttgtctgaggaaacagctgaacgtgaaactataaaagatgtgcagagagactatgaacagggctttcagggctgggaatataagtttaacactgttgcctccagccgcggcgattatccgtttataacggttaccgcaggtctcggaacaaaacgctttgaaaaaatggcaaccatctcactcttaaaagttcacaagaacggtcagggtaaaaaggaatgcaagaaacctgtattattccctaaaatcgtatttctttatgatgagaatcttcacggaccgggcaaagagcttgaagacgtgttcaaggccggagttgaatgctccgctaaaactatgtatcctgattggctgtctcttacaggcgacggatatgttgccggtatatacaagaaatataacaaagtcgtatctcctatgggatgccgtgcattcttgtcaccgtggtacgaaaaaggcggtatgaatcccgctgacgataatgataaaccggtatatgtaggaagatttaacgtaggcgcagtaagcttaaaccttccaatgatatacgctaaggccgaaaaagaaaacaaagatttctatgaggtccttgactattatttggagcttataagaaagttacatatacgcacttatgaatatctaggagaaatgcgggcttccaccaatcctctcgcttattgtgaaggcggattttacggaggacatttgggtattcacgacaagataaagccgctgttaaagacggctaccgcctcttttggaataactgctctaaatgaactgcagcagcttcacaataaaaaatctttggttgaagacggacagtttgctatagaagtcatggaacacattaataaaaaggtagctcagtttaaagaagaagacggaaacctttatgcactttacggaacgcccgctgaaaacttgtgcggtctgcaggtaaaacaattcaggaaaaagtatggcataatagaaaacgtttccgaccgggaatatgtcagcaacagttttcactgtcatgtttcagaagatatttctcctatcagaaaacaagatttggaaaaaagattttgggaccttatgaacggcggaaaaattcaatatgtaaaatatcctattgactataataaaaaagcaatagagacattgattcaccgggctatggatatgggcttttatgaaggagttaatctctcgttggcatactgcgacgactgcggtcacagcgagcttgaaatggacgtatgtcctaagtgcggaagcaaaaacctcactaaaatcgaccgtatgaacggatatttgtcatattcgcgcgttaagggagacacccggcttaacgatgcgaaaatggctgaaattaaagacaggagaagtatgtaagatatgcgatatcataatataaccaaagacgacatgctgaatggagacggtctgagagtggtgttatgggtagcaggctgtgagcacaaatgcgaaggctgtcataacccaataacctgggatcctgacggaggactgcctttcggagaagatgaaaagtcagaaatttttacagaacttgacaaaccacatatatccggtataacatttacaggcggtgatccattatatcaatctaatataaatggggttgaaacgctggcaaaagaaataaaagaaaaatatccggacaaaactatttggctctacaccggatacaattgggaagacataaaagacttgacggttataagatacatagatatacttattgacggaaaatttgtgaaagacaaactggatccaaaactacattggcgcggaagcaccaaccaaagagttatagatgttaaacaaagccgcgatgatatagttttgtatacaaaagcataaaatcaacataaaggagacgattatgacaggtatagcaaaatttgaaaaagtcagtatagaacagtttaccgaaggatggaataactgcttcggcagtactgatatagataaaattaaaaaaacttatgaaagtataaaactcccaaaacgcgcaacagcaggaagtgccggttatgatttttattcgactttggattttgaactaaagccaaatgaaacaataatgatacctaccggaataagaacaaaaatagacaacagctgggtcttatgcctttaccccagaagcgggcttggttttaaatttagacttcagctaaataatactgtcggaataattgacagcgactactataattctgataacgagggtcatatctttataaaaataacaaacgacacaaatacaggaaaaactgtttcgctaaaccagggggacgctttcgcacagggtatatttgttcaatacggcatcaccgttgacgatgatgcgacaggtgtaagaaacggcggctttggaagcaccggaaaataaaattcaggagacaaacaaaaacaagttattatgaaatccaatacaaaagaatttatagaaaacagatactctcaaggtgtgagagatggaataccgataggtttaggatacctgtcggtatcctttacgttcgggataatggcggcaatgggaggacttcctgtgtgggcggcgcttcttatttcaatgacaaatcttacctctgcaggacaatttgccgggctttcccttatgcttggcggagcttcttatctcgaagttgcaatgacgcaggttgtaatcaatatgagatacgctcttatgtcagtctcggtatctcaaaagctattcggcggcatcggaggattaaaccgtatgggaatagcttttggcataactgatgaaatttttgcagtatccacaactaagccggctcaattgggacccaaatatatgtacggacttatgacaataccatatataggctgggctctaggaacacttgttggagcagccgccggtatgcttctgcctgaatcaatcagaagcgcgcttggtatcgccatatacggaatgtttatagccattgttgttcctccggcaaaagataataaggctgttttatatgtattattaggagctgtgcttctcagctcgtgctttaagtggtttcctgttcttaatatggtatctaatggttttgtaataataatctgtgcacttgtatgtgccggtctgggcgcttatttcgccccaattgatacagatgaaactaatgggaaggatggcatcgatggacaaccttaaaattttaatatatatagctgttatggccgttcctacttacttaatacgaatgataccattaacaataataagaaaaaagattaaaaaccgttttctgttatcctttcttttttatatgccatatgcagttttaggcgccatgatattcccggctatactctattcaacctctagcatatattctgctgttataggctttgcagcagcaatagcgctatcatatatgcaaaagagcctaataactgttgccttattatcaagcctggcagtgtttataaccgaagctgtaattatgtagaaaaaaagtcatataaaaattaaaaaatttttaaaaaaagtgttgacaaacctttctagtatatggtatacttatcaagtcgcgacgtgataggtttgtcctaaaagtcgtataatacggagaggtgtccgagcggtttaaggagctagtcttgaaaactagtgatgcgaaagcacccagagttcgaatctctgcctctccgccattcctttttataaaggcgctatggcacaggataaacttctgtgtcgtttttttcaaatttaatacagagcggtttagctaaaactaactgcagcgaattcggagatgtactcaagttggctgaagaggtgcccctgctaagggtataggtcgttaacgcggcgcgagagttcaaatctctccatctccgccaaaaaaaccattgcttaaagcaatggttttttattatttaatccaatatgattctcatccataaaactaataaattatttaataaactttataaaaaaagcttctgtcaaatttaattataaataatcattttactaattctaattttatacaactttacaatctataataatataaatattagtatgataaaggcattgatattggtattatctcatcagtatttttccataaaaatgctttcagtgatatatttggttcttcactatttatataatccataaaatcataagttcctgttccgttaatctctttcatatcagtctttaacaaaatgtcagaaccattgtataaagctaagataagttttgcctctccttcaccctctactgatacctcaacattatttgcatttctattaatactaactattgaatacttaaaatcatcaacttccggataaaccaattgctcaaacgataaagtaacatcttttatcgtatatacttcttgtgttcccaaattattatacgcaataaggttaagctttgatctatctgcgtcagccggaaaacctgtaaaaataaagtcactagaaccaacagacgattttgttccttgtgtaattgtttgattctcataatcaattagaagcgagatttgatattctatagttccatcttgaaactttccgccaatatttaatttttggtgcccttctatatccttagaaccgctgcagttagccaaagttccatcaatcatatcaagctgattccatcttttgtatattctcaaacgtgtatatctcgaactgtccgaacttgcctgatactcaacaggaatatctcctcccagtatatctataaatgcagtattactaatgttttccggagatactacaaccgtgtaatttaatcttatcgtctttgaatttttaaaatcctgacgttctttatcagtcattttttcaagaaaatcaattactgtaatattatcagttggactaatgctttcacacgctttaatatttgtatacaccatttgtgcagctaatacatttaaactcgtttcattatccggaataatactaacttcttgtgacgactcctttactctcataacatcactcgtaggcgtaaattttactatataatctccgttcgggataccacttatagattcactgtatatattaacatttgaaggaacagatacagaagaactctttactaaagcgccctttttatagaactttataacaaaagtttcggcatctttatatttattgtcaagataaaaattacacttaacacttccggaaccatcggtattaatataaggactgatattaaattttacagttgatgttaaactatatccggtaatttcattataggctgttacctttacacttgactcaacacttgcttctccatacgccggcctaataacagtaatggctcctccatcattcacatatgaatatttgtcgttggtatttgtcttccattcaaacttatacccatccacagttggcagtggaattgtatcagattttccatcatcttcaaactttaaagattttattgtctcctcaatctcctggtaatatggttcagcgtctacaacctctatatctattttctttttaagaccgcttgcagattgaaccgtcacctgtgctttacctattttaacacctaccatttttccaaatttatttactgtaacaatagaatcatcatctgaaacatatattaaatcatcatcagattctgatggtaatatttgggcatttatatattccgctctattttcacctatttcatacttgtctttagcagtcaatatttcatttgcaggaacatcagaaattgacggctttacagtaacagcaaatgttttttcacagcttccgctctgagaaaaaaccgtaattgtcgcagaccctacagctcttgcacgcataattcctctatgtacagtaactatactatcatctgatgacttccataacaatacatcatttgtttctgcaggctcagtattaaaatttagatttttaacctcaccgtattccagtgttaaactatcaggcagtccgcttatatcagttattttattaatttgaggattttcaattatatctgtcagatttacatcatttaaattcaactcggaaggctcaatataatgtcccctcatcatactatcggtaatattcttccatatcggtttattattgactctgtcccatatagaaaagtctcctcctgttccattgtcccacacacaaggaacagcaccacaaactttgcttcctttcgttactatttcatcatagtatcctcgctgtatatcatttgcccccgaaggattaccttgaaactcgtgatatctatttccatattcagctaatataatcggataatcagaaaactttttacatatttttttcaaaacattaataacttcataagcttcatcatatttccaagatacagcagtattgtttttataaatatgggttgtaaacatcaatctattatcaatattatatgtatcctcaggcataatgaaattatcctcagttcccccatttgcataatgggatgcaaccgacaaatagcgataaagattgtttgatccggttgagcgaaccacatttacaaagatttgatttaagttaacaattataggtatatcataggctttagcctgactggaatttttcatatccccttccatacatgtcagttcatttattgactcaaagattaaatgctcatcatagtttttaaaatatgaagcaatacttctccacgttccttcaaatttttcatatacactatctatgtcgtctgccgcaacgcgaagccatccgtattgttcagcgccgtcatgatgtatatttattattgcatacatatccaaatcaatacagtagtcaactatatcctgaactcttgaaatccaatccgggtttatagaatacccatcttcatcatcaatcattgttccccacgtaatcggaatacgaattgtattaaaaccagcatcatgaatagatttaatcatttctttagtagtcacattgggttgccagcctgtttcgcacggaatcatatatccgtcgctccaatcgttgctcgttccatccatagtgtttccaagattccagcctactcccatttcattcacaacttcattcttatctaataaacgaaaacttaatggatcttcaggctcatcagactgcacaaattttaatcttgatttctctttttccagacttcctcttgctgtagtcatgtccacttcagaagctccggaattattatatatcttccatgcgttttctaacgcttcattaaacacatcccatgtttcatttatatatttactttgatccatactgctgcagtaatctaaagatagtttcaacaattctcttgctgaaagcttactgggatattctgcgcaaacaggtgtaaccgctaatgccatcaccatacacattactgctaaaacacaaaacaatcttcttatcatcttaaattctcctttcaatttaaaaattaatttttagatgatttcaaccggtttatctaaagtcaatataacatatccgtattttattaacaagacaaaaaaggagcagtttcagacaaagattgtcaactttttatttaaccatttgtattcaatttttgtcttattcatctctgtttttgtcttgttttaatctttcttgtgtgttaaaattaaaataaagaatatttaaaggcggtgttataatgtcaaacgagccatattatgaactcaatacaaaagatattcgtattattcataacaaacgcgaagttaaatttctgcctcatatccataattcagttgaaataatatacttattcagcggtatacaacatttaattataaacgaacagacatatattctaaataccggagaagctgtactcatacctcctggatatgtgcacagctgctttcgaatagattctgaggaaaacaacaaatataataaaaacgccgaatttgttagtatcatttttaaatcacagcgtatacaagaatttaaagagtttttcgataactacacctttaatcaatacaaaatatataaaaatcaaatagatgatttcatgtcacaaattttcaaatacatgatagaagatttttctgaaattcgtcagtttttctactgtacaatagcagtaaaaaaactcattaatcaacttgagccaatcccaattaataataataatataaaaatcagcaatgaatataaaataatatcatatatcgaggaacactaccgtgaaaatataactcttgacacactatcaaaagaattatatattaataaattcactgtttctaaaattttttctgagcaaatcggagttaatttcagaacttacctaggcataataagaagcaatattgctgcaaaattaatccgaagtaccaacgactcactcgaaaacatcagtaccatgtctggttttagcagtgtacgcacctttgaccgaacattttataataatttcagaataactcccagagaataccgtaaaaaactgattataaaataatataaaatattgtatttataatatggggtgtaaaatatgaattcagattttaaacttataaacggtcttaacatttataaattaaataactctataaatactaaaggacatattcatgaacagcttgaaatttgtcaagtcattgagggtagtcaaaaaattaaaattaaagacaatgaatatattcttaatacaggtgatacagctataatatttccggaataccttcatagttattctacatgcgataacataaaatcaaaaattttaattttaaaatatgaacccgagatatataaacaagtttgtccaaatatacatatactgaaacaaaaaaactataaaatttcccaaaatacagcaggtgataaatcaaagatgatatttgaccaaatcttagcacagacagataatattatattattaagctgcagtatgatattgttatccgacttaatagaaagtatagatttggttcaaacaaataaactgggttctcttaatctaacgtgcaaaatattaaaatatatagaaacaagttttaataacgacattactctcaaagatatatctcataaatttggtgtaaatcctcatataataacaaatatattttctgataaactaaacactagctttaacatttatattggtatgcttagatctgaacatgctgcaaagttaattcgctcaacacaactgcctcttactgttatcggtgaattgtcgggtttcggaagctcccgcacatttaacagagtattcaagaaaaatttcaatataacaccaaaagaatatcgtactctacataaaaaaacgtcagccatgtaaacagccttaatttgtacagtccgtacagattagggctgttttgccgctattttattttcctctgcaataaaattaatcaaaaatcagaattaaataatatcttgcttttatatttaatacgtgttataataaacgttaacaaaatatggtgcagctattacatatacataaaattgttatttaggcacaaaaatttaaaattgttttagaaacttgtatatatataaattatataacaagttggtttgtgttgtatttttttaattaataaaatattaccatatgtacaatcaaaataaaaagggagatattttgaacacttgtatatataatttttaaatgtccaaatttaatgttttttctattaaaaattatgatcgaaaaataacctgccttaaatcatctaatagcgaaaatattctcggggggacaaaggagtatatgttaatgagtaagcaaaaaagaaaaaacaaactcaaaaaagtagtaatgtttataatttgtgcattttctatatttctatccacattcagcattttttctacttatcagcttcatcaaacagcttcaatgatttataaccacccttacactgtctcaaatgagtctcgtgcaatgcggtcacgtttgctggacatgaaaagttttctgttaaatattgtcgcggaaccttcatgggagatagataatgttcagcaattattaaacggccgttataatatgcaatataatgcaattgaaattattaccaaccaatatcttggaccgagtgaagacaccatccaactgcttaatgcaatgaatgacctaaaaaacactcaaaatgattcactgcctcttattttaccaatgactaaagaagaaacagctttatatgtagagcaaaatatatatcctaaatatgacgctgtagacgcagcgctgacaaaaatcattgcgtttgcggatcaaaaaattaaaggtttagaaaaacattccgctaatacagcaaccacagctatcctttcttctttattactcactatcttcctgccggcttactttttatttgctttttggcgtgaaagaaaaaacattcgcgagattcaataccgcgaacacttgtttgatattctttcttccaacgtagatgaagtttttttaatctataacaaagagcatgcagaattagagtatgtcagcaataactgtcagcgtgttctcggcataaaagaacgctctatatttaaagaaacagattctttgttgaatctgattatcaatgaagataaaactgattttatggagtttattaagccaactggaacaacgtcaagcaaaagcgttgaattcagaatgaagaacccatccggacaagtacgctggtttttggcgcaaagcttccctcaaatcagtcaagacaaaatagttcgctatattgtttctctttctgatcgaactgaaaaaattattaaagaacaggctttaaaagacgccctgataaacgctcagaatgccaacgctgcaaagcaaaactttctttctagaatgagccatgaaattcggacaccaatgaatgcgataattggaatgactactatcgcgggcgcctacatagaagacaggaagcgcgtagaagactgtttggaaaaaatcggatactcatctaagcatctcatgacacttattaacgacgttcttgatatgtcaaaaattgatgaaggaaaaatgactatcgcccacgagatttttaacctggaaagcgtggctgaatcaatcacatcaatcatatatccgcaggctgcagaaaagggtataacattttcaatgcctttgatagacctaaccgatacaatattaattggagactcgcttagactaaaccaaattctgattaatttgctatccaatgcaataaaatttacgccgcctggcggctcaatccgcatggaaatacggcagatacaaaagaaaaacggacgtatacgtctgcgttttacagtaagtgacaccggtataggcatgagtgaagaatttgtaaaacgtatattccttccttttgagcaggaaaacacttccgcaagcaatcaatttggaggcacaggtctcggaatgtctatctgcaaaaatttagttacgcttatggacgggactatctcggttaacagcgaattagagaaaggcagcacttttaaagtcgaattagactttgatactgcagaatctaaagaagaaaagtcttcatacaatcatcgagtactggaagcattaaaagttcttgtcgctgatgatgatcgtgattgttgtatccatactacattgcttcttgagaatcttggaatcaaatcgaagtgggtaatgaccggagcagaatgtgttgatgaggttctgtcagcacacaaggttggagaagaatacgacgtatgtcttatagactggaaaatgccggacatggatggtattgaagtgacacgccgtgttcgtgaatttgtaggtcctaatacaacgataattattattactgcttatgattgaagttctattgaacaaaaggctcgagaagccggagccaacgcattcctttcaaaacctatatttgcttccacactttataatacgctgctgactgtaacgggaattgaaagagcaataaaaaacaataaagataatcagccaaatcccgttttaaatggtctcaatgtattgctggcagaagataatgagcttaaccgtgaaattgctgttgaacttttgaaaatgacaggtatgaaaattgactgtgtaagcgacggaaaagaagctgtagaacgcttcacaacaaacggtgacgattatgacataattcttatggacgtgcaaatgccttatatgaatggatatcaagcaacagaagctattcgaaaatccggacatcccaaagctaaaacaattcctattattgcaatgacagcagacgcatttcatgaagatatggtaaaagcaggcgaagctggaatgaatgggcatttagctaaaccaatagactctgaacagctttataaaatgatagaatcttctgtctcggcaaagagttagttacatataaatcattgtttaaataattaaataaaaaacgttacgatctaaattttcgtaacgtttttatttattatttaaacaagtgaaatattttattcttataagtaacagctctatttctgttaatgaaatacataaatatatcaacatatagcagtcttctttaaactgctatattcatccgtcttactgacttatatcatttttatcaacttaatatgaaaaattgttttacggattttaatataaacatttaaataatttaaacaatactagatttaccatagcttaacaacacaaaaaaattgatttaactaatttataaataaaccaattaaatattttactttaaagaattattaaatatctgtataatacagttttatatttaatatacagcttgttcttcttgcctacaatttatcaatttgttaagatgtaatttgaatatacttattttgtcaaaattatagtattactgctttcttcatattctactttatatcctattgcttcacagaattctcttactgacacatatgtattatctatatcatttccaaaatatttttcatatctttcaatatcatatttttctactattttgctaaattcggtcttgctcatgtcataaagaaaacaattttttagaccaaaataacttattataattttgtcattttctaaataataaggaaatacaggttcgctatacttatttccatttatacataagtataagtctttttttctcgcttcgaatcccccattattaattatatattctttataagtttttccgatgttttctttatcgcacttagcttcaacaggataggattcactatcaataaagtgtaaattcatttcacaattcagtaaatttgatataatatttttatatacatctacattaataggagagtaaaaagtgtatttatcacttaaattaattccatctattaatccatattccattgatttttgccataactcttgttctgtaaatatgtatttccagtaattacattcacatttgttttcagatttttctaaacaacgaatacacaaagtcaaaacttcgccaatagtagccttatcatatggtcttaaataatatcctcttccttttatatctgtctctagttgtatcattcctattctcaacgcatattctatatagtcataatcataaatatgcagccctctttctttgtaatctaaaaagttattctctattcccattattattccatttttatcaatttttttctcattcaaacctataattttcattatgttaacaatgcaatcttctcttgtaaaactatcattttcataattttcatacaatattaattgttctgttagttcatcagtatttatttcttttctctcttctgcatatgtttttattgagtaaccttgaaacattatgcctgttattaaaataaaaactattattttacttatatttttattcattttataactccttttttaagtgtagcatgatatactcttgcacctaccattgttattttctcaaaatattttcacttatttgattcggatcaggcaaaataagttatcttaacaatattttatcttctataatttgtctaatttacttacgcataaaaaattgaacggagctatatgtatttcttaaccatttaaaaagaagtatttaatggatttttatttcaaatagttaattaattttatatattcaaaaactttccggtgtttttactccatttcagttatttatgcgtatgcttgtccaacttttttggtttaccggagggcgtaaccaatacaccctccgcaacaattttagtttgaataaatgtctactctctgcaattcttcgtcccattccacctgacagccaaatgcttccgatattgctcttaatggtactaatgttctgctgtctcctactaatcttgcaggtacatccaactctatttcttctccattttttagcatcctattactgtcaattgtcactgacactgttattccctcctttgttgctgttgccgtttgggtttcattttcccactctacttctgctcccagcgcttcaaatattgctctcattggtactaatgttctgtctttttctgttataggatatatatcaaaatttaactgcttattgtttatatatactgtaatttgattatttttcaaaggttcctttatcttttgtaaatcaactagatcaacttttttctgtattttttcatcaatgacaaaatataacttatcagcactcatattatacatccatgaattcgtattttcagtcaaactaatcggtaagaatgtaaatatatctttataaccataagtaatgatatcatcaaaattttcatcaaaatataattcacctaacaatttcaaattcatgtcataaatgtcattataatatgttattatatatttatttccaaaactaaaagctccgtttatattaaacggaatatctgttccgtttgtattttcaacaaccttaccgtcctccgttaatagataatttatgcaatttagatttgaatcttttgcacatattattgcactcctattatataaacacacccctgatgtataataagtatatttttgatctatagtttttgtacaaattatttccccactaatatcaaacaaagtataggtatttgttgttggattatatcccaaaatagcattattgtttctattaattacacgacggtctgaattagactttcgtataaaaatataataaccactcatttcactaatataatttatatttaaatctagatcaatgcttgcataattccttgtaccatcattatccacccaactcattaatgcgtatccattatcaaattgataaattgtattctgggaactatatttaatttgaccatttacatctattatgtaatacatattatttctttgtgctatcccatatccattattaaaagattccatataatcatatatcggcggcactatccattcataatttttatttatataaccgaatttattttcaatctctataaccgctatatcgtctttgaataatattggatttttgtatatatttcctttataatcaataaaaacattatagttcttattatcttcttttctaatagccaacataactccatattcgtccatatttataatctcaatatctagaatatccgactcctttaattcatccggcaatataaacatttgattattactatcatctattttatatttattataattttcttttgccattacatttatgtaaccaataaataaaaaacaaacacatattaaaataacaatttttcttaaatacttcatagtttttctccatttctataaataaactaatttttaaggtttacttatctacttatatttctccaattaggataatacttttccaatataaatggatgcgttgtataatgaaatggccgaccatttaaaaaatttattgaatatattacatattctaaatccatttgttgtgcttgtgttggcgtttggaaagcttcgttcataattgattttactttactaggcaattgtacatattcaggaattcctttctttctatagtgatcccctatattaaaaaccctatgtcctatttcatgagctatagctttttctattgcgtcaacatacgttggcgtttccgcatacaaaggtattgtgtccgttaacatcaattcattgccgttttctgaacaatatatacaaacagaacttccttgattatcagattgatcaattagtccctttcttatttctattttaactacttgatatatattgggatctgaaaaaactaaattagtagtcatattatatccattcacatttccactccaatacttatttacaccggattttaatatactatctacactactccgtcataagttttattagacatttcgccaaataagtaagcatttatggttatattataatttttcccgattggacaatagtaatagcatcaagtttcttttcttcctttatggttccaccattgagtacaacattttttaacatatcctcataggacaaaactccatcttgataagcatgaattgcgctattaatatttattctttcggacttgttgtgttttgggttaagcttcgtcaaagaggctatactcgttctattacaggtctttaccgcatactccgcaaacagggacaaatgcctgttaaaccacccaatcccaaatacttttactccgtttcaattttttatgcgtactcttgtccaacttttttgttttaccggagggcgtaaatgatttacgccctcaaaatttacttactgaacattattttttaaagttatcttaatttattgttttattaggaacctttattctctatagccttttttccaatcatctatgtaatattgattaatatatcctccatatatgacgtaaacggaaacaggaaaaattatacacaaaaagcaggaacaaatacaatactgacagggtcatatacatatgacatattggacagactgacagaagtagattacggaacagtaagcgcgggatatatgtataatgcgaatggaagactgacaaaggagacaagggggaatataacaagcgagtatacatataacaaagccggattggtgacagagatgaaaaacagttcaggtcagagttatacatacagctataacttggcaggaaatcaaactgtaaaagaatcgggacaggagataacaaattatggatatgatggaataggacagctgataactgaaaatgtagtttcgcccaaagaagatgaatgggattataataatacatattatcagtatgatgtgatattatggtgatataactataacacaatttatgagttttccgtattctttttttctatttgtaacacatctattgtaatcctacacttataaaatataaataaattaaaaaaacacttgacaatatgatttaacagtgatataatttaaaagctgtgtaagtagtcacgccggagtggcggaactggcagacgcccgggacttaaaatcccgtgggaagtaattcccgtaccggttcgattccggtctccggcaccacacagtaacaatatatcgcggggtggagcagtctggtagctcgtcgggctcataacccgaaggtcgttggttcaaatccggcccccgcaaccactaagaacacgcttaccaataaaggtaggcgtttttttataatttaccaaattaatttgaatatatctttttccataaaattaaaataagcttcacatgtatttataatataaatgttgttattatataatcaataaaaaaggaatataaaatttatgaattttgatagatttaaaacagatgagaaaagagtaaaatatttatatgatcaggtgaataatattacacctcttaacgaatgtcgcctatataaagaagagcaacttcaaaaaactgatgatgtgctgttattgcgtaattgtattgaatggatcattagagctaataccataattttaaacataaagtatgcgttgtctcaaagccttgccaatgtcaaaaagatgaaatgttctttagaagaaacagataatcgtgtgaaatattcttattatttagaagatgctgtatatcgtgacattgctttatgggacatctataaacagttattaaatgaattttatcaatgtggatattcgaaagatgatatatataacatttttatatttttaaaacacaaaaaatttgagggacgcaccccaaacaatatattgaaatatttagaaacagaaaatcatcaaatagtgcgacaaacattaagaaactcatttgcacattcgaccgactctacatccacatatatttttcattcaaagtctaacggaacagttaaaccagaacttaaatactttttacttaatcatccttttgagaatttaaatataattatcgaagatatacataagttactaggttttatgaacaataccattaaaataattaataattttcgagaagctaaaattttgctttataatgtatctacgactatgccttgtggagaaatactcgaagataaagacttatggaatttatatatattgcaagataattttgaaaaaataattataccttgtgaacattattgcaaaaaggcacacaaatataataatacttatgtatgtaaacctattagtatttactatcgtagaattaatgaatcagaacataaatatgacggtaccttcattccaaaactatcttttgatgatattgtaaaagattaaaaatattaaaaacctatagaattaattctataggtttttaatattataacaaatatatttttaattactgtattatttgaaacaataatttgttgtattccacacataattatatattttttatttttataaaataatccttatgatctaatatattaatttatattaacaaaagtcacaccagatattattccatgaaattaaggatattctctgagcatatatctgcggcggcatactgtttgtcataataccgtcaaattcaatacgaacaaaatttccaggtctaaaccggcgtgctctgcgcgttatcacaacaactctctgacggttttctatgtctaatacaaacaaacggtcgttttgtacgcctattactatagcccgcataatcaattttaacacctcctttgcccataatataattatgctgcttgaaggcttattgaaccatgtccttaaatatattagataaatatgattttttatatataaaacaaacttaatatttttattctctgttattagattctatttataattatttatataaaaataaagatatttatttatgaaacaagactcaaaagactataaaaatataaaacctaaataaatgtatttaaagcatggctttttgaaggggctaaatttttaagaaaatatgaattgccaaaaatagagacatgtgataaaataccatcaaaattaatttctttcgataaaacaaaaaacaataaattttatagtaaatggggtacatttttatttacatgattataaatatgaatgtttatggaataatccaaaagtatatttaaatcatcttcaataaaaagaaaaattatatatgaaaaataaacaatatattgaattattatttgtatttaatcattattttaaacatattatcgaatggagtaatggacttaaagtcaaatgcagatcttttacaggtatatttgagactgatactgagcctgaagatgataattacattggtgagtatgctgccgccgttcacgaagttaagatattgcataaaggaaacgataactctgttaaaatatataataactgtatagaaataacattaaaaaatattcctgaaaaaatttctaatgaaaatggcacaattatttggaatagaccttccgaactaaagtctctttaatagattaagcaaataatttgctgattactattgattgagttttaaaaaaccgcaccaaatttatttaattataaaattatttattttttaatggtatgcttagcataaaagtatatccactgttaattccttgttttatattaacattaccatctaatttttttaaagaatcttttataaaatttaaccattcataatttttattgtaattcttatttttattacttgtttctataccttttattataaaatagatttcatctttattagttgtaaacttatttacaccaatactaaaaacaagatattccgcttcttttaaatattttacagctcctacaaaaaatttaataagcacatgttccagttctttttcattccctatataaaagtcattaatctctgaagaaacttctattttataaaaatttttttgttcttcagatataatttttataagatttttaagtcgcagaataagtttttgcatatcaaacaaattttcttttatttcaagtttattaacctctaaatcttttttctcttcaaaattcataatatccatccctttatacttttaaataatataactacataattttgattatgttgtatatgcaacaatttgttataatacctttatatttatcttttccgcgactgcgcgccttacgcggcagattacatctgccctaccgatgcttgctattccactttttatatataactttttattttaaaatattttcttatatgctaagttttgttagtgaacttcgggaggacgcgcttgcgcgtctcgttaggcgagccatcatctcacgcgcagcgtgaacatacttgcaacagtttgttataatccttttaatatttgacatttccgtcttatcttattgtagtatttctttgcctttttaatgaatatcggaaggcttaaatattgccttccgatatttatttaccttacacgctttcttatataaatataagaatatcaaaattttattattctatattataactaaaatggttccgcacaacgagcgggcggaaccatgactgctaattctgcttatttatctgctgtccttttatcaaaggatatgagactaaatccttactttccaaatcctcgttatacatatttacagctgagatttggctgttttcatacgttgtataataatatattcctttatccatattgcagcaggagctgtatattgtgatttcatattttccctcctgcatacatacacatcccctctgctgtgcaacagacccgagaatgtgaaaaaactgactgatactttcagattccgaccagcctgatattgagtttaattttgtaaacgctgctttcacaaaacgggaaactgacgataaatccccaggaagaccaatccctcccataccgctgcaatactcctttaacttcaccttatttgaaaactcatttgttggctcttttttggaaactttcatatagttatttaaattaaacatctgaaaatcaaatgtgggattgtttgttaaaactcccacggaattgtcgtaaacttttatcccctcttttacacactccactgtaattgagcagtccttatcagcgataagccaatgcagcggcgtggaaatcagcttcttattaaaatttacattccatatatttacatttttcagaagtttctttgtttcttcaactgtttcacactgccctaaaatccatggaataagctcatatggagcgacgttgtccttcccctccgcaaaatctttatattcggcgttatccgggaaattcagccccgctatgctcaggcctttttcattggttgcatcataataaagcggataatcatcaaccacatatgccatgccgattatagcatagtgagattccatatttttaacgctttggaatgaaaatggatagttccgcggagttattgttactgtttcagtataagaaaaataataatcaaggtttctgccaaaatagctgtcaactgttttataagttattgccgtgcacatcttatgccgcctttcgagatttattttctcttcagatttttattcaaattatatatctattatgtcttaaacagcgtattgataatcgttttaagcagtatcgtacttaaatatattaatctgattaatctgcggccccgctctgttcaaacacttaaaaactccgcttcaaatgtcattgctttataatcataagccggcgccggtacggcatttttgagtgtatttttttaaatatataaaataattttgtgtattttaaccttgaaatttctcctatcaagcagtataataacaaatactgcagaaaaaacatatatataccaatttaaaggagaagtaatatggtcacccttgataaaatataccacgcgtcacacgtcttaaaagaaatcatcagaccgaccgagcttataaaagctccgaaaatctgtcctgactgcaatctttacataaagacagaaaatcttcaggtcacaggttcctttaaggtcagaggcgcttattataaaatctctcagctctcagatgaggaaaagaagaaaggcgtaatcgcctgctcagccggaaaccacgctcagggcgttgctcttgccgcagccaaaaacggcattaaggcaaaaatatgtattcctgacggcgccccaatatccaaagttgaggcaaccaaaagctatggcgccgaagtctgccttgtaaaaggtgtgtatgacgacgcttacgaaaaagctgtatctttggttgaagaaacaggagccacttttatacacccatttgatgatgaaatggttattgccggccaaggttcaatagggcttgagattattgaacagctgccaaaagttgacgccgtaattgttccgataggcggaggcggtctcatcagcggcgttgggtttgccctaaaatcactggacccggatattaaaatttacggcgttcaggctgagggcgccgcttcaatggtaaaatccataaaagatgatgaaatagaaactctggaagacgttcataccatcgcagacggaatcgcggtcaagacgcccggagtcaacacttttgaaatttgcagaaaatatgtagacgacattgtaaccgtaagtgatgacgaaatatctacagctattctcgaacttattgagcgtgaaaaaatgatagcagaaggcgccggcgccacatctgttgccgccgctatgttcaacaagcttcctattaaaggaaagaatgttgtttgtcttgtttcaggcggcaacatagacgttactatactttcaagagttataaacagaggtctccaaaaagccggacgtttggctgagctggtagtagaactcactgacaaaccgggtcagctattgggagtttcagaaattatttcatcctacggtgcgaacgttgtttctttggagcataaccgttcggatgaaagacttgatataaacgactgcgtgctcagaatatccatagagacaagaaaccaggaacatttggatgaaataaaagacgcccttgtaaacggcggatttaaaattaaataaatcattattcaaagataaatattacaggaggtataatgatgaacaaaatacacacaaataacgcaccggaagctataggaccttactcacaggcagttgaatgcggagggctcatatatacgtccggacagattgctataaatcccgaaagcggacagattgaaagcaatgacataaaaggtcagacaacgcaggttatgaagaatctgactgcagtgcttgaagcggccggaagctcagtagacaaggcgataaaaacagtttgctttttagcggacatgaatgattttgcctcattcaatgagatttacggagaatatttcacatccaagcctgcacgctcctgcgtagctgttaagcagcttcccaaaaatgcgcttgtagaagtggaagttatagccgaaaaataataaaacaaattatagttaaagtctatgctgaataatttaaataatgtgaactgttcagattcaacatgcaataaaatatcataatacatttatagcatatttaattttaagcatattaaagacatccagtggcaatattgccactggatgtctttatcttgtataattaattaataaaactatatctacagaaaccgcacataacgtctgccttactcctatatagaaaattaaaagccaaatacttttactgcatttcaaatgcgcctttgggacaaaacttcatacattttccgcacagtatgcacaagtcataatttatctgcggtaatgaatgactgtctttttgggtaattgcattcttagggcagacttttattgacgggcatttgtggttttgcggacacttatctttatttataattactttcatagctatgtatctcctttttattatttttaccgcaaacattaacctgccgcggatttacagcattaatatactattattcagagggcttgtcaattattgatacacaattacatttatttaccactcctttttgacttcttcctctttaattaaatatgttcaaagaatttaaaggttctataaaaaactctgacattcacaacagaaccattataatttttatttttagtcttataaatactgcacattcaggattttgttttaatgtataacgttttttataattattaaaaactacctcctctctttccttatataattaactttaaatcaatctaaattataaattgatttataaaattagtactgaagatatgctgtataaaatgtctatatttattttttattcaatatttactattttttacatcagtaataaaattatatatattttttcattaattcaacatatttattgtacaagttaaataaatatttttcgacaaactattgctatttctcatataatatattataatataaaaatatattagattaacaggagggagagaatatgaaaataaaaagaaccttttgcacatatattttattcttttccttattttttgcggtcacatttgcatgtacggctgtctgttctgctgaaaacaacagaacaataaaggtaggatatcctatacaaagtttaatgaccgattttgatgaaaatggaaattatactggatatacctacgaatatcttgaagaaatagcccaatataccggatggagttatgaatttgttgaagttccgggcacagccggcgaacaggtctccgctcttatggaaatgctgaaaaatggagaaatagacctgatgggaacaacgctttatgacgaaagcataaaccgggaatttgcctataccggtcatagttatggttctgttgagacggttctgcaaactttaatcggtcaaagtaatgataccgccgttgactcaattgttatacaaaatatgcgtatagccgttacgtcagatacagatgaacaacatatacgcgaatttaatgaatactgtgatatgaatctgattacacctgagtttgttgtctgcgcaaattatgaagaccaaatagacgcactgaaaacaggccgtgccgacgctatgctcagcaccagtttgagtgcttctgatgaacttaaaacaatagcaagttttgctcctaagcaattttattttatattatcaaaaaataacgcatatagcagtcttatggctgaactaaatgaggcaatgcttgatattgaagccgcagacccatactttacgggaaagctttataataaatattttgtttcagacgataaaaaaataaaactttcagatgaggaacttgaatatatcaaggtagccggtccaatacgggtaggagttgatacaagccgtccgccgtttgaatacaaaaataaaaataccggagaactgaaaggtatctctatagagttattgaattatatatcagaaaaaacaaatcttcattttatatttaaagaagcaaaaaatcaggacgaattatataaaatggtcaaagacggcactgtcgacataatagcagaaatgaattatgactatgataccgccagagaaaacgggctcgcaatgtcgcgtccttatacctcaagtcagtatcttctgattatgggagataatcagagtcaggaaaatattgtaggaaaacggcttgcgcttcctaaatattctttatacaagggagagaccattggaaaagttacgtggtatgattctgtttatgactgcctgattgcggtaaaaaacggcagagaagactacacttatataaactctctgaccgccgaatattatctcagccagcccggatatgaaaacttgaatatgatacctcaaacatatacgcctgcagtttcttgttttggatttcataaacccgtaaacaaaaccctgctgagcataatgaataaattaatactgacaatatctgaaaacgagcttcaggccataataaatattaacacaatacagcaaagagattataactttgaatattatatttcaaaatatcctatacagataatttccggtatagccggtatagccggtatatttttaattataatgcttctgttgataataatactggttcagcgcaacagacgaaataaagaaatgcagatagaccttcaaaagcacctcagcttatattcagtttctaacgactatttttttgaatatgactttaagaaaaacaaaatggtattcaacaatcctgatttaagcagacaagatgattcaaaactgatagaatacatttttaatgacgcagaccatgagatgtcagagaaaaaaatggaaggccgagacgcttttctaaatataatacaaagcggcaaagacggagttattgaagcgcaaatatattgctttgacgagaacctgcactggctgcgcataacaatggaaaccatacgcgacgataatggaatgcctctctatgctgtaggcagaatcaatataatcgacgaagagaaaaatgcagaagaaagtttgcttgaccaagcacagcgcgacagcctgactcatatctataacaacgaaacaagccgaagactgatttctaaaagtttgaccgaactaaccgaagccgatatgagcgccctgctgattttagatcttgacaattttaaaaatatcaatgacacatacggtcatctatggggagataaaatgcttcgcgcagttgccgatttactgaaaaacagttttcgttccaacgatatagtcgcacgtcccggcggagatgaatttttggtttacatgagcaagataagggatacaaaatcacttgctgaaaaatgcgcttccctgtgcagttcagttcacaatataaaacttgatgacagcaatcacttaaccataagcatgggtgtagcggtcgcaagagccggaatgtattatgacgttttatatcagactgccgaccaggcactttacaggtcaaaaaattcaggacgggataaatttgaaatagtggagtagcgcacatattagacgcgatgtaaataacacaagcatttgttcaaaattaaattttaacttgattataaatgagttcggtaatataccgggctcattccttttattttaataatattctattgctttattttataatattcttcatgtctgccacatctatttaccgcccaaatatcatatctacatattggacagaaataataaagtcaagtaaaataaataaattctatagtaaacagtatttttagtgaactgcggcagggcaaactttgtttgccgcgttaggtgagccatcatctcacgcaaagcgtgaacatacttggaaaagattgtattaatccttttttattacatgttttcacatgactgcgcgcctaacgcggcgtacttcgtacgtattgcgtattcatattattgacattgtaggtaaatcaaaacaagttattttgtatcacacccaccatactggtggggtcacagacattgtaggttatcaaaacatgttactttgaataacatccaccttttcaggtggagtcatacctaccgatgcttgctacaccgcattttatataactttttatttaaaatattttcatatgctgagtttttagtgaacatcggtaggtgtgaccacactttttttaaaagtgtgtgtaatacatactaacttgttttgccattacatgcaatgtcattagtatgtatactcaatgcagacaacgtctgcttcgttaggtgagccaccatctcacgcgtagcgtgaacatacttggaaaagattgtattaatcctttttgattacaaatttctccgtggctgcgcgcctaacgcggcagagtgtaaccacagccctaccatagttcgccatgtgaaaaccttaacagttctgttcattatattgtgacctctacataaatgactatataatttattactttattaaaaaaatataaataactcttgacaagcttaactgtaactgttataatcacagtataatctgtaattaatttagttacagattaaattttaggaggtgctttatatgaaatatgacgctgtaattatcggattcggcaaaggcggtaaaacacttgccgggaaactcgccaaaacaggaaagagtgttgctcttattgagaaagatccaaacatgtacggcggaacatgtataaacgttggatgtattccatccaaatccctaatacacagtgccgcttctgccaatccatatggagacgcagctgaaaaagcaaaaaaataccgtgaagctatagaagaaaaacgaagattgaccaaaatgcttagaacaaaaaattatgataaattggcttcctctcctaacataacaatttataacggcacagcccgatttgcagaaagatctaagattgaagttaaaaccggcggcaaatctattatcattgagggagataaaatatttatcaataccggttcaacgccgcgcatacctcctataagcggcctatcaacaacatccggaatatacacgagcgcggaacttatggatttagatacatttcctgaaaagctcactataatcggcggcggatacataggggtggaatttgcctctatgttcagcaattttggaagcgatgtcactgtgattcaagacggtgaaacattcttgccccttgaggacgatgatatagccggagaaataaaagctattcttgaaaagagcggcgtaacattcagacttggagccaaaattaaatatgttgatgaaggacccaaagtggtttttgaatggaataaacaagaatacagtctcgaatccgacgcagttcttgcagcaaccggacgtattcccaacacttccgaactcaactgtcaggcggcgggcatagagttaacctccaaacaagctgtcaaggtcgaccaaaatcttcgtactacagcagaaaacgtttgggctatgggagacgtgaccggcggacttcagcacacatatatatcccttgatgattcaagaatagtatggtctcaattgtcaggctcaggaaattatacagctgacagcagaaggaatgttccatacagcgtatttttatcaactccgtattcaagagttggtatgaacgaaaaagaagcgcaaaaatccggcatagattatatcaccgcagcacttccggtttcagctattccaaaagctcaggttctcaaatccactgacggtatactaaaagcgctgatagataaaaatacaaataagatattgggagctatgctgttatgcgctgaatcctatgaggttataaacattatcaaactggctatggatatggacgcggattacaccgttctgcgggaccgtatatttacgcacccaactatggcagaagctttaaacgaccttttcactttatgacaaaataaagaattgactaatccgcagtatctataaaccgtatatcaacgtctcttaaagagatgtaaaatactataattttattataagaggaggtaaaacatgaaacgtaaaataataatttgtttcattttaacagctataactcttctatcctcatgcgccgcaaaaagtgtaggcattattccttcctctgaaactcctgattctgccgccggagcgtaccacaaaatctcatccgaagaagcgaaaatcatgatggagagcggcggagttactgttgttgatgtaagaagaccggaagaatacgcagaaaaacatatccccggagcaatacttgtgtcaaatgaaactattgcagaaaaatcagacgaaatgctccctgacaaagaggcggttctgcttatatactgccacacaggagtgagaagcaaacaggcctctgataaactgataaaactaggttataaaaatatttatgactttggcggtatagcagactggcaatacgaaacggaaagcggtgtgacagaatgaacagtgaatttattgtagcagtacacgcaatggtatttcttcatcataaagcggacactttgtccagcgaaacacttgccgaaaacgtctgcacaaaccctgtgagaatacgtcgagtgcttgcgaaactgaaaaaggccggactagttgaaactcgcgaaggcagaacagccggtggatattcatatcaaaagactaggcaagtaaccttgggtcaaatagcaaaggctttaaacgtaaagtttgccgacactacctggcacagcggcaacaaggaaatgaactgtcaggtagcgtccggtatggcaggatatatcgacaatctctattcaagtctgaatcatctctgcgacgaatatttagatacgataaccattgcggacgtggaaagagaattatttaaaaaggaataatttgaaggcatgatatttatatttttcactttgcctatatgtgatataaaataaatgcagactcaaaaaactatttagaaaattaccggcagactgttttatttataccatgatgatagtctaaggtatataaaaaaatattttaaaaaaataaattataaaaatacggtttagtaagcatcggagggcaaacgcagtttgccgcgttaggcgcgcagtcgcggaaaagacaaatataaaaagaattataacaaactgttccaaatatgttcacgctacgcgtgagatgtctgctcacctaacgagacgcgcaagcgcgtccttccgatgttcactaaaaaactccgcatataagaaaaccatttgagcagaacatatactgaacctctgttccgataaaatcatcacttattgcaaacgttcccgcctgctcattctgtctgcctttcgaaaaatcttcagctatataactcagctgtttcacaaacttaaccgcatataaatccggcagccatgttgaactgtttgtaaatgttaaagatccttctgtcaaatcctgcggcagtgtaaatgttataaataattaactatttaaaataaaaatccattaaatacttcctttttaaatagttaagaaatacatataactccgtttcagttttttatgcgtaagtaagtatattaaaaacaattaagtgtagaagtaacaaagtcaaaaataaaaagttatatagaaaaacaatatggagaagcgtttgcaatgacaatagaagacgcttttagagctgaaaagtcttatgaaacaagaatggaaagctcccattgactacatcaactcttttatcaatttcggtgaactcttttaatcttttttgtaacacatcattgacaaacctacaaaaatggggaataaatctttaataagtttaatattgactaaatcagcaaaataaaaactcggctgagaatgtttttttattaccaatgttcttattgtacagtaatatgaattatgagatagttatagaacacctgattaacggatgattttgtttgaaatttatataaattttgcatattaatctgttttttataacataactttactttgctcacgaaagagttttcataaataaaataatataattataatactctatttaaaactgtaaaattattttattgataacaaataagtgactggacatttaaaatagataatgctataattttatctgaaacattaacaataacagataggggataaaaaatgataatagatatacacgcacatgtgtttccgaataaaattgcggaaaaagcgtcacagggaatagaagatttttataatatagacgtgcctaataatgggacaatagaaagactgctggaattgtcagacaaagccggagtgaataaagttgttattcattctcctgcaacaactcctcatcaggttcaatcagtgaataattttatatatgactgtacccaaaaatatcccgacagggttataggatttatgactttgcatccagactttgagaatataaatgatgaagttgagcgatgtatctctatgggattaaaaggcgttaagctgcatccggattttcaaaggtttcatatcgacgaccataaagcattttgtatatacgaagcaatttcaggacgattgcctcttttagtgcatacgggtgattttagataccaatggagcaaacctgaaagaatggcaaaagtgatggatgaatttccggcaatgacagtgataggagcacattttggcggctggtctgaatgggacgacgcagcaagagtttttaaaggaaaaaatatttatgttgatacgtccagcactatgtatagtgtgcctcctgaacatattaatgagttgataagacagtatggaacggatcatgtactcttcggttccgattatccgatgtgggatgctggaaccgaacttgaatacatagagaaacttgatttaacaaatgaagaaagagaacttatacttcataaaaacactgaaagaattttaggtatttaaaatattatattaaacagtctcaaaagtcctaaagttataagtattattccgggtattgcagtgagaaacttatcatttatctttggaaattttttgactgttccgcctaaaaagattccgaggctaagcataagatactgcatacaaaatattgctacaggaaaccagaacgaagcgtttgtgccaagtccaagcccagttgccgatgaatccatagaaaccgcgattcctatgcacagagcttcttttctgtcaatatcaagtgaattatccgtgtcgccgaagctaagatcagatttgttcagcgacaaaagcatataaattccaataacaaaaaatattatggctccaattaagtcggagacaaatggcgaaaatattactgaaatagccaaacgggacaccgctgtggatataaaggataatgtgaaagacgctaagcttattatcagacggattgtcttaggtacatatatattttttacaccataggcaactccaatgcccagggaatcgaaactaagtataaacgcaagcaaaaaacaaaacagcatatcatgatacctcccaacaaaaagttctgctgttagtatcaggatatgccgaattttggttttagtgtgttttgtcttaaaaatgtgattaagtaaatttaatttatattctttttaagcagccgaaaggtatttttatcaaaatctattaacccgtcttgtttcatctttgaaagttctcttgaaagagcgcttctgtcagcacagagataatcagcgagatcagaacggttcatatcagttttaaaatagcttccggagttatttgcaataattgatagataggttagaatcttttcacgcaaagtttttttagatattatctcaagtttttgaacaagctcaatatttttagacgccataagttttacagcgttttctattaaccggtggtgaaattcgcacgcagctgagcaggaatttaatacttttgcaaatgggagaaacaagacttcgcagtcagtttcactgtagaatgagatagaatcagaaaatttgtttgagcacagactgttttcaccaaaaaagtcgcctttataaagtacgcttattagagtgtgattgccattaatatcacacattgtcatatgtattgtgccgcttaaaactgttacaagacaagcgttatcaacctgagccattataatattgtccttcttaaaagtctttttatatgctcctacacagactaaaaccgaacttatttcatctttttttattccttcaaacagtggaagctcagttgtgtattgagtgatttccataaaatcgtcctccgttaattaaactataaatatattaacacagtttattatttgttgcaatcgcaacatacatacatttaaaaaaatgatatagtttgaatacgaaataaattaaaatatgtttgaaattcaatgataatctttttatatgtagaattattcaaaaaatataggaggaagatataatgataaggaatattgtaaaaattgatgaagataaatgtaatggctgcggactttgtgtttcagcatgtcatgagggagctatagaactgattaatggtaaagctagattaatacgtgatgactattgcgatggtttaggtgattgtctgcctgcatgtccggttgacgcgataacaattgagaagagagaagcggcagaatataatgaagaattggttaaaaagaacatggaaaagccggtacatacaggcggatgtccgggcagcgcattaaaagaatttgcgcgcagtgagagtaattattccgaatctgattatgagtccaaattaaagcagtggcctgtacaaattaaattagttccggtcaacgcaccatattttgataatgctgaaattttagttgccgcagactgcgccgcatatgcacatgcaaattttaatcaggaatttatgggagataaggtgacattaataggctgtcctaagcttgatatgactgaatactccgaaaagcttggcgagatttttaaagcgaatcaaataaagagtgtaactgtggtaagaatggaggtaccatgctgcggaggattggagaatgctgttaaggtagctttgtcaaactccaataaagatatatctttaaaagttattacaatttcggttgacggacatgtgatgtaaaacgtcttatacaataaaatgtgacgtaaaaaaactgaagggttttgtccttcagtttttttatttattattatttatacagtcttcttcactgctactattatacgtatccgtccgccgtttgagggcaatttgtcatagtatgcatacagtgtataattgtcactgcctataatgtcgctgattggcttcagcctatataaagtagaagaggagtattccttttcatatacttgaacgtcagcagatatatcatagctctttccgtcggctgtaaggcttccggcgcttgtaactgttactgtgccctttacttcgctcagcggtgacattattgacggattgcttgcggatgaaagccttactccctgaccgctgttcactgaatatattgttgacggacttgtaaatgaataactgctgccgtttactatatatgaatatgagccgctgacagatgttccgaagctcatattctgtgctgaggtcattactccaaacgtataagaatctccggttacatcatttaaaataagtttatctatttctccgcttgaatttttgtggcaatatagaattttgtttgaattaatattcacattattaagacgggtaggataaatctttttatataatgacgggtcatttttatttgttgttcccacgtccaaaatttctacatcgcttgccaaataatcgtcgccgaaacgttttgtgtcccaacggaaataaccgctgacctttgcgctgtccgttctggaaattttagctattccttcatttatactaacagtgactacagaatttttatagtcctcataattttggctgcacgtataatcgtaggtttcaccgtttgccgctgctactttgatataataatttgaataatcctttaggtcctctgatgtataagttttggttcctgtttcaaagatatatcccactatttccgaatcagttactgttgaggtaaccacgtctgcaacctcgttagtttttcccaatagcaaagttatcgtttctccaagtgcgagattaccgcttgaagacagtttattgaaagcatttgaaccctcaactttatatgttacgcctgagacaacaatttctgtagggttatctttattcgggtttgctttgtcatatacacctgtgactttggtagtataggcaaaggccatatttagttcaggtatatagtagagtatgtcgtaggtttttatatctgaaattgtgcaagcaactccgcctctcatgatagtagtagatgaattaattccgagagtttcagcccagttattctctgagtttattgtgtaaggaccttgcatattacctttttcgtatactacgtaatctatatttccattagtctttttaatattaagaacatctcccatttcaaaagatgtttttatagctccgtaggtggttctggttgttccgtcataagcgacggtgccggcaggaatatccaaagttgtcatattgccgcctttgtataccactatgttgtcacttagtacggagtataccacatatttttcattaggagaactgtccgcctttggaaagaagcctataacagttttgttgtcctttaaagctatatctcctttcattccaacatatgaataattaaaatcagaccttattttatatgtgccgttgtcggtgaagacctcatcgccggggatagaactgtcctcttttgaagttgaaatcagcgtcacatcttcaacaaaagcgacatcgaaaatagatataagttttgaggatgaatctttctttttggttcttaatgtattatatactaatgtagaaacgtcttttcttgtcatgttggaaccgatactgatatctgttaggttatctgtcatatcaagactgtcagccattcctatttgaccgcttggccaggctacgccaaaatcgctgtccgaatatcctaaaaccctgagcataattgttacagcctcttcaaaagtaactatatcatcaggcttaaaagaagcgtcagggtatcctgatacaagattgtttgtaactccaacacgaacgtatggagcagaccagtttgaatatggaacatcataaaacggagaaattgcaaggtttgatgctacgctgttgcggtaatcagaagacgctacagctatttttgtgaattccgctcttgttacaaagtcatccagtctaaagttcccgtcagggtcgccgttcataattttaagttcagataataatcccaaaacatcctgctgagaattatcactgccgaaaaccgttattgaaaaagcagaagcagtaaggcatatagctaaaataagtgaaagtataggcctaaaatttttttcagatttatagttcataatttcctccaatctctgtggtttttatcttattcatgtctgagagcgtcaatagggttaagattagcggcatttttagcaggcagataaccgaacatgattccgatacctacagaaacaccgaatgaaactcctattgctgtcagtgatggtagcgcggtcaaacctaagagccgtccaaataaaacggcgaggattgacccgaccacaattccaataagacctccaacaccgcttacggttgcagcttcaataacgaactgagattttatatccctcgatttggcgcccaaagacttacgtataccaatttctcgagttctttcagttacggacacaagcattatattcattattccaataccaccgactaaaagagaaataccggcaatacaaaccaaaagagtactcatagtgcttgtcatggtacttgccatatccattatctgctttatgcttgtaacattatagtaatcgctgtcgccaattttgttagctaaaaactgctttacttttgtcattgcatcatctactatatcaacgctgtttgtctgaacagtgtaggaactgataaatgaactgttggacattgatacagcggtggtataaggtatatagattacctcatcctgtcctccgctggttgaatcgccttcttctgtcagcactcctataacggaaaaagtatctccgtttattttaagcttttgtcccagtccgtttccgcgtccgaacatttctttttcaatatatgtaccgataacgcaaactttttgttttttctctacatctacaaattgtaagaacctgccttgttcaagctccagctgttttatactgcagtagctctcgtcaactcctgttgcggaggtagataaatcatcgcgcccaactttaactttagcggaagcaaccataacgctagggctgacagccttaaaaaactcagggttttggtcaacaaaagtatacatgtcattttcgtcaattgttcggcttccgcccctgtcctgaacgctgacagttattgtgtctgttcccagctttgaaaattgatctgtcatcattcccatcattccgtccatgaggctgataagtataataactgctccaactcctattattataccgagcattgtaaggagtgaacgcattttatcaaacataagattagagaaggcaagcccgaaagattttttaagcgtcattgttgtcgtcctcctcgtcatctccggcatgggctactgttgcaaatttttctatttcaggcgcgccgtcgtatgttatgcgtccgtcctgtatccggataactcgctcggcttgggcggcaattgtattatcatgagtgataagcacgattgtattgccttcgctgtgaatctttttcagaaacttcaatacctctttaccggttttggagtcaagagcgccggtcggctcgtcggccagtattatggacgggtcgccggccagggctcttgcaattgacacacgctgctgctgtcctcctgacagctgctgaggcatatttttagcttttgctttcagcccaaccctgtcaagtgaaatgagagcgcggcgttcctgctctttttcagaaagtccggcatacatcagaggtagctcaacgttttgctgaacattgattttggggataagattatactgctggaatataaatccaagttctttatttcttatttcagcctgttcatcatctttcatggtgctgacgtcagttccacggagaaaatattttcctctgcttggaacgtcaagacatcctataatattcatacatgtagattttccgcttcctgactgacctacgatagcgacaaattcacctttatatattttcatcgaaactccgtcaagagcgtggacttcagaatctcccattatatagattttataaatattttgaaattctataagaggcgtttccattacattccacctccgccgggtctgccgcctgaaccaccgccggcgctgtctttcattctttcgtggctctgctgcatcatttcttccatagaatttccggttcctgccgtggagtatagaatttcaccctcttcaaccccgctgaacacttgtatatattcgccgtcgctggaacctgtggttactgaaacagtcttataaccttcaggagctttatcgttttcttcggttttatcacccttaacatatacagtgtttccacggttaagattgctgacaggtatagccaaaacattgtgaacactggatataataatgttggcttcaacgttcattccggggagaagcgcgtcatcaaagtcgataatatttactttgacagggtatgtggttactccatttgaacctgcagttccgttaacgcttatgttttctacaacgccggtatattctttatctgtaacgtcggtagtgattgtaactttctgaccggttttaacatttttaacatcaagttcatcaacgtttaaagtgcatttaagttcactcatatcataaattaccgccatagctgaactggaagcgctggcagaagtcaactgagaggacgatgaactgcttcccgatgagctgtaagaagaagtagaagatgaaccgcttccgagattgtcgcctttctttttgtttttggtaacaactgttcctgatatcggcgctttaatggtgtagtcttcaagctgtttcagaagcttttcttttgacagaacagcatcatcatacgtcatttttgcagttttaacagcggaattcagtttgtcatcgccgagactggtagttgcgtttgaagtattctgctgaatcttagcgcgttcaagagcctggtttgcgtcatttaaagacaacagtgcggatgaaatttgtgattcaacagagtcagaatccagcatagcaattttttcaccattataaacatgactgttttccgatatgtacagagagcttattttgccgcctgacgaagctgtaatgctatcttcggtaaggttttcaaaagttccggcatcgttacaagctatatctccaaccatagctgtagcagtatctcccgatgatatggctcccggattatctacttcaatagtgacctttttatatgaagtaaaaccgcttccgctttcaactaaagcaccgatttcggtgacaactccgcgtacagacgagccgtttttagttaaagtaagatctgcagcttcgccaacatgcacattatccgcatcagctgtattaaacggaacttttatctttagttttgaattatcaattatatcagcaatttttgtaccggcagcaatggtgtccccctcagagatgtgaatctctgtaactatgcctgtgtggtttgatttgagagacaaatcatcccttgctttcagtgcgtcattatacgcttgctgtgctttatcaacggcaattctggcgctttcaacggaactggcgctggtagctgtatcgcgtacagttttagaattttcatttattgcgtcgtcatagttctttttggctttagctatagctatatcggcgctttgaatactgttttcgatagtactggcgtcaattgtgtacattaaatcgcctttttgaacagtgtcgccttcttcaaaagggtcatccaaaatttcacctgttacatttgctgtgattgaatactcgttattcggttcaacaacagtactgtcatttattttttcttcaatatctcgcttttcaactttaattaaaagattgctgtcttctaattttttccctagcctgaccgtgcttataccaataaataatacaagcgctaatacaatacagatgacagcgctccaaattttatggtttttcatcagtttccataaggcggcaaaaaatattttaagtttgcctccgatgaaaaaagtgaaatctttgattttattacgtactaaaataaatttgttcatgttctgagcctcttaactgaaaatgtctttgtctttttctgaaatattttttataataactatggattcttcaattaattcaagcattgttcggaatttttcttcacccatggtgtctttaactgtgatgcaatttttattaaaataaggatctatttttctagttatgtctttagctttttcggtggtgataagataagttctgcgtctatcgttttcgctgttatacctgagaatatacccttcagattctaaagaagagatatattgtgagaccgccgcgcgtgagacgccgaattgcctgctgatatcactggaagttattttatttccttcagacatactttcgtctattgtttttaagataaaatattctctgttggatatcggcaatacagataaaagacaattaagcgcttcttttatctttaagattaatatctgtgtcttttttacatatgtatcctggcttatttttgggtttgagccaattttagacatatactcctatctccttaaaatttaacagcggcttaatggttaagcaacttaacaaacattatagcagagctaaaaaagggtgtcaatgtaatttatatataaaagccccaaaatatacttgatatttattaacattatgatataatgactgttacatagaaataatttgtaaggagactaaagtatatggataattttatatttgataattatactaaaataatatttggtaaaaagacggaagaaactgtcggcgaagaaatcaagaaatacggcagtaaaattttactccactatgggggcggaagtataaagagaagcggtttgtatgataaaataatttcctctcttaattctgccggcgtagagtatattgaactgggcggagttcagccgaaccccagattaggtcttgtaaaaaaaggagtcgatatttgtaagcgtgaaaatgttgaagcaattttagctgttggtggcggcagtgtaattgactctgcaaaagctatcggattaggtgcgttgtatgacggtgacccttgggactttcatgcgcgtaaggctattcctgaaagaatgcttccggtaggtacagttctgactattccggcggcaggcagcgagtccagcgacggaagcgttataaccaatgaggatgggtggataaagagaggtcttcacagcagttgtatgtatccgacattttcaattatcaatcctgaacttatgtatacattgccgaagacgcagatagcaaacggctgttcagatatattcgcacacttggctgagaggtattttactaatacaaaaggcgttgagtttacggacagaatgattgaagctgcaatgaagacagtgataaataatgcaaaagcaatggttgacggaagcaaagattatgacacatgggcacaggtcgtttgggccggaactattgcacacaataatctattaaacaccggcagagtgggagactggggttcacacaacattgaacatgagctgagcgctcactatgatattgctcacggcgcggggcttgcgattgtatttccggcatggatgaaatatgtgcttaaacatgatgtaagcagatttgttcagtttgcgacaagagtatttaatgttgaaaacgatgtttttaatccgaccaaaactgctatgaacggaatagaagcttatgagagatttttgcagtctttaggtctgccgaaaactttatcggaagtgaatattggagatgaaaagtttgagcttatggcaaaacaagctgttgaaataggcggaggcaaacagggaaattttgttgaattaaaagagaacgatatacttgaaatattaagaatggcgaaataaagacaaagttgtaaggttttagacatatattttaatccagtttgttacatttttgataaatttttaaaaaactattgcaaattgattttgataaggttataataacgtcattatactttaataggaggttaagcaatggacgcaagtcaattacagaacttttatccgtttcttatgacggccttgattcttgttgtgttctatttcattttgattagaccgcagaagaagaaggaaaaggcattgaaggacatgatttcttcattaaaagttggagatgaagttgcatcaatcggcggtatccatggaaagattaacagagttaaagacaatcttttcattttggagacaggcgttggaacaacaaagtcttatgttactattgagaaaagcgctatagcgcgtcttatcagcgaaggaacatccaaggaaagcgatgtcgctcctttggaagaagctgctgatgccgagtagtttttaaaatttgacatttagtattcactctttgcatatagtttaataactttaaattattgcaaagggtgtgtgctgtatgacaagcggtgcttttcaaaaaagcgagaggcagggaggattttctcccgggggatttaagcgtgagcaatccggcggtgaaacgtcaggaggagataaaacaatttcttctctcataaaaagtatctgcataggttttggagcggctttaattttgctgtttctgacttcggttgcggcttcattttatgatattccggaatttgttttaaactatattgttattgctgtatctcttatctgcctatttatggttggctttaaagccgccgggtataatggtaaaaacggtcttttaataggtgtgatagccggtgtagtctatgcggtaatcgtatatttgattggctggctgggatttaaaagtatttcgttttcccccgaggctatcgctaattttgcggtagggggagctgtcagcggtttaggcggagttgttggtataaacagatataccaagaaaaaacgcaaacgctgatacatacaagttataatagtaaattaataattttagtttatataaaggagaggttactaatgaagagaataaagacattaaacagtgcttcactgaaaaacagcgcatgcaagggcggctgcggcgaatgccagacatcttgccaatcagcttgcaagacatcttgtacagttgccaaccaaaaatgcgagaacgataataaataggatataaataggcaagtctagtatttgccgatattctgaattatcaaataaagatagcattgcgggcgtccttgtttaacataggacgtccgatttacgtttatttacaaggagattattatggtacatacttttaaaatgtttgacaaatatatagctcttgatgttaacagcggttgtgttcacgatatggacaaactttcttatgatataattaattttttgaatgtgaagaattttgctccaacttcttcagaagcaaagtttaagctgattgacgacttgaaatatgattacgaccgcggtgaaatcagtgacgcacttgcagatattgctgaattatatgaaaacggtatgctgtgggcaaaggatgattttgaaatcgcttcaaatctaaaagaaaatgcaccggtaaaagcgatgtgtcttcatgtcagccatgactgtaatttaagatgcaaatattgttttgccgacgagggtaaatatcacactgaaaaacgtgaacttatgactgcagagaccggaaaacgcgctatggattatttggttgagcattccgggcaccggaggaatttggaagttgatttttttggcggagagcctttaatgaactttgaggttgtaaaagaggttgtggaatatgccagagaattggagaaaaagtataacaaggttttccgttttacagtaacaactaacggaatacttcttgatgagaaaaaacttgaatatattaatgaaaatatgtcaaacatagtactcagtattgacggaagaaaagaagtaaatgaccgaatgagataccgggctgacggaagcggttcatatgataaaatagttcctatttttcagaaagttgctgaaagcagaaaccaggataattattatgtcagaggaacttttaccagagaaaacctggatttttcaaaagacgtaattcatttagctgacttaggctttaagcagatttctatagaacctgttgtttgtggcgaagagactgattattctttaagagaagaagatttgccgaaaatctttaatgagtatgaaagtttagtaaaagaatatgtaaagagaataaaggaaggaaatggatttaactttttccactttatgattgaccttgaagaaggcccttgtattataaagaggctgtcaggctgtggctgcggctgtgaatacctagctgtggcgccgaacggagatgtttatccctgtcatcagtttgttggcagcgaggaatataagatgggaagtctctacgattccaacgggctaaataaagaactgcgttcgacttttgaaaaatgcaatgtttatacaaaacctgactgtgacagttgttttgctaaatttttctgcagcggaggatgtattgctaacgcttgtttgattaacggtgatatgaataagcctcataaattaagctgtgaaatgatgaaaaagagagttgaatgcagtttatatgctaaggcggcactggcggactgatattaaaataaatttgagaatgaggtgaatgggtgtgtcaggtcaaaatgaaaatataaacaataatctaaagaatatacaggaagaagaacatttgataacgtttcaggatattgttaaggataaagaaataaagacatatcttgaaatgggagataaatatctgggaactttaggatacacaaaccattcactgcttcacgctcaaagagtagcgaagattgcgcatatgatacttatatcgttgaactatgacaggcgcacagctgaacttgcgcgtatagcaggatatatacacgatataggaaatgtaataaaccgtgctgaccatgctcagtcaagcgctatgatggcgtttaatattctcaccagaatgggaatggcgccgcttgagatagcaaaagttataggagccataggaaatcatgacgagggaacagggatacctgttaactcattggcttccgcattaataatagctgataaaaccgatgttagacgcagccgtgtaaaaacaagagataataaagattttgatatccacgacagagttaactatgcggcggtcgtgtcagaagtttcagttgagagcagaagtaaaaattcagttgaaaccaaggttataaaaatggatttaaccatcgatacagatatttgctcagtaaccgattattttgaaatatttttggcgcgtatgataatgtgccgccgcgcggcagaacgtttgggagctaaatttgaactcaatgttaatggaacaaaattaacttaattctgttgaaattttgaaaattattaaactttatttaaaatcagcggctaaaccgctgattttttatttgttataaatctgtttcgttatataaaattttattaacaattttatattttctcttgactaaatcaaaatctaaggctataatagtccggtatgctaatgttgctatgtttatacataggttttgtgtttgtattttgtttgcatacattatattgttgtccggcgaggggtgattatatgttggggagtaagaaaaatatcgcttctgcatcagcagttgttgcggtatttattttgttgtccgcattgttttcatttctgagccaggctttaattgttgaaaaatctaaaactgagcgtattgtttccatttccgattgtgctgatttcggtatatctatgagtgcgcctcctgatatggaaagccatcccggaaacagtgatacgtttattatatccggtaatgttattgatagaaatttaagaacagattcatattttggaacgttttacaatgaacagtctatagcccaaagatgggtagatggtgaaatagcttgtatgataagtgagcgaacatcgtttaatgttggaagcgttgtaatgatttgttaaggacttctatagttttataaaatcgaaaaataattaaaatatatatgagaaaagctcaaatttaaggaggagaagaaattgtccagaagtttagtgaaatttgcggctataattttggttatcgcggcacttttctatgttggattgtatggtcttgattttaccgagaaatatagaattcccggtataatggacagtgatggaatcactcagggcctggatttaaaaggcggtactgttatagtgtttaaggcagatacagacgagccgtctgaagaggatatggataacgttgttaatctgctgagaaaacgtcttgattttcagggttatacagaagccagcgttactatgcagggttcaaacaaggtaagagttgagcttcctgatgttcaggattcagacaaagcggttgaaactctcggagcaacagctcagcttgagtttaaagacgctgacggaaatctgattatgacaggcggcgaggttaaagacgctaagtcggaatatggtcagacagagcagggaatatcaaagagttcatattatattagtatgacatttacagatgaaggtcaaagtaagttctcagctgctacgaagacagcagcggctgcggcatcatcaggtaagaacttcatttcaatagaaatggatggaaacattttgacagcgcctcaggttaagcagcagattgacagtgagacatgtattatcacaggccagtttactgctgaggaagcaaaagctctcgcagctaatattaagtcaggtcagcttcctttctcattgaagacagacgaggttaaggttgtaagcgctacattgggtgaagaagctttatcaaaggcaattacagcgggtattattggtttgatacttgttcttttgtttatgcttattgtatatcgtatcatgggtcttatggcggatattgctttactgttttatctttcaattgtacttattttgcttgcaaacttccacgtaaatcttacgctgcccggtatagcgggtattatacttgcgataggtatggctgttgacgcaaatgtcgttattttcgagcgtgtaaaagaggaattaaagcttggaaagacagtaagaagttctgttgagtcaggatttaacagagcattgtcagcagttatagattcaaatgtaacaactatcatttctgctgttattttgtggtggcttggaacgggaacaattaagggatttggtatgacattgcttatgggtgttatcgtatcaatgttctcggctatatttgtaactaagttcctgctcaaacagatgataggaatgaatgttagaaataactggctctatggtgttagtaaaaagaaaaccgggtcagaaagtgtgaaaggaggagaagcgtaatgtttgatatattaaagaaaaaatggatattctttggtattgctattgttttaagtttaattagtattgtttctctgattttccaaggatttaatcttgatacggatttttcaggcggtatagcattaacatatgaaataaacggagaatttactaccggagatataacatcattggtaaatgacgcaattgaaggcaaaaaggcatcttctattcagaaagccggttcagatgttattgttaaagttggatatgataagaatatgacagatgatgaaagagcagcattttccgcatctgttaaggaaagtcttactaccgctttagaaggtagattcggagccccggttgttgataatgaaaatcagaatacagaggcagccgctgaggcaacagcagctccggaaacaacagctgcaccggatgaggccgcagctgcagaagctacagcgcttccatcagctactccggattctttggaagcaacatcaagaggaacattgacctcaggagttagacttaagagtcttgatgatatttctccttcttcgggtcaggaattggcgcgcagcgctatgtggatggcattgcttgcttgtgcaggcatactggtttatgtaaccatcagatttgagtttacatcaggatgtgttgctataatcgcattagttcacgatgtattgattttgctcggtgtttattcattgttcagaatatcagtaaatattaactttattgcggcggtgctgactgttcttggttactcaattaataatactatagtaatcatggacagaatccgtgagaatacacgtcattccagaaaagaaacatatggcgaaattgctaataacagtatttggcagacaatgactcgttctatcaatactactataacaacattgcttaccattggtatggtttatataatcggtgtttcggctatcaaagctttcgctcttccgattattatcggtattgttgttggtttcttctcttcagtatttgttaccggtccgctttgggctacatggagagattctgctgttaaggctaaaaaagctaattctgcttcgaaagccggagctaagaaatctaagtaatatttgttttattataactgcatcgcaatttaactgcgatgcagtttttttgtaaagtttaaataattaaagtaagtttgtttcggaaacttgtttttggaacctactggaaaataaatcgtctaaataatattaacttttataaaaggagtgaagcagtaatgtttagttgcagaaatttaaataatgggattttaataaagtgttcagtatttataattggtttgattataatatcatgcgttttattcacaaaagtatacgcagccaacggtgatataaaagatactatatacacaactgatattctcacacaggtggatggtaaaaatatacaaagctattcgataaacggggagacacttatagcacttgaggatttagaaaattacggttatacggtctattataatgataatatacggtcggtgtttatcactaaaaccggaactgtcaatccggattataatcccagcattgagcgcggaaaggttgggggaacagcgggatacacatatgagacagatataaacgcctatattaacggcaagttgatacaagcttatgcaatagacggcaaaatggttgctaaggtggaagagatgggaaccagtgaaaaccttagtgaggatgttaatacaaaatatcaaatgagctatacatatgatgactcaaaaagattgctttcactgtttacctcgcttaagaattcagtttcatatgaagaagctgtttctcattatttgagcaaaacattggcgtgggaggaacattacactgaaaatattcacaatgaaaacaactggctgattgagaaaggtattggcggactgcctcacggcggatactataacactatgaatcttatatataaatcaggtcttatagtcgaccttgaatctgtagtaaattcatactatctaagcaacgatattgagtacacctttagtcctgacggttcaaaattgttttttattaatcaggttgatggggtaaatgaatataagcagattgatttgactacattgatgatttctccgtcaaacagcgatgaatatttgagcgctagacatttagctggaatttctgattttaccgctgatgtgaatggggtcaaaatacctgtttattctatcggaggaaatgacgcggtcaaatttactgatttggaattctgcggatatgatatgggccttgatgaaaaattcagatatggatttgccgtgtataacagtgataaaaaattaaatcaggacaagataaaaagtgcaagtataagcggcaatgctaaatatttgaaagcgatgagcagtaatcaaagagattttttaatttatattaataacaaaagtatgataccgtataatgttgatggtgaatattatattttaatatctgatatcaatgattctccgcacttcacatcttatgattatcaaataaacaacaccgaaatgaattataatttagatgattataaaattgaactaaaatatataccttcggcttatgatgatatgaaaataatgtgggacgattatttttatggttcggagctgggaaactgtgtcgccgaatatgagtataaaggaaataagatttatgcttatctttatgagtatgaatatacaggttccggcacaccggagaagaggtacagttatagattgattgaatttacacatgacaatataattgtggaattaactcaaattttaaattcttatatttatgaaaatatagataaggaatatttaaatgtaaataactatgataagttaacttattattttgactttgattctgtcaatggtattttaactattaaaatgtcagatggaagcaaatataacttagatttaaatacatatttaattgcgaaataataataggagtaaatgctatgaacatttgtgtttttggctccgctaaggaatttaattcctcaataatggcagaggcaaggaagcttggaagattaataggaagcatgggatacggattgacatatggcggattcggtgaagggcttttgtcagaagtagccaaaggcgtgaaggaatatggagggtatatcacagctgttgcacctcaaacgcccagacttaataatccattgtttcaggaaattgatgaattgattttgtctgatgataaaagaaaacgtaaagaactgcaggagaaaaattcagatatgtttgttgttctacctacaggaataggggtattggatgaattgtttgaaatacttgttttgaaaagctacggcgaactaaaacaaagaattgttattgtaaatattgaaaatatgtatgataatcttaaagttttgctgcaggatatggacgctatggaatattgtgattttgtagattccgttgacagaatatttatgaacgacaaatcgcagatgattaattaattatattatgtgttatataatacttatctttatctttttatgttcaagaatgtagtttttaatttaaaaacttcatattttttaaattaaaaaagtctgaatttgtgaaataaaatgttgaattttgcaaattataaagagccataacttttgttatggctcttattttctattcagtttctacccattcagtaaccagttcagtaaagaaatggccgtccaaatggtcaatttcatggcagaaagcacgggcgactaaatcctcgcctgtatactcatatacagctccgtttctatcggtagctctgatttttactattctaggccttgttactaagccgtatctgcccggatagcttaaacacccctcggcgtctgtctgttcgccttctgtatatataatttcaggattgataagctctagcacagtatcacctgtatcaacaacggcaactctttttagaacaccaacctgcggtgcggctaaaccgactccatttgcggcttttaaggtttccatcatgtcgtctaaaagacaaattattctgtcgtttatttcttttacctcacggcattttttggtaagtatttcgtctcctagtttaactatgtttcttattgccatattattttcctccgttttaactcatattaattggattgatatcaataatcatagtagtgtttttgtttttttgaatatgggtattattgatttcatggagaatttccagagataaatcagcgtccctgaccttaattaatattctgtatctgtaatcccctttaattctctgaataggcgcaggcataggatgagccaatttaattatattattgtggctgtcatcggaatttttaacaaattcaaaaacagaactgatttcaaattttacaatatcttctgtttttccctgaaccaatatacttattatgtcacaaaacggcggataattcaagcgttttctgaattttatttcattttcataaaaaccaatatagtcatgggttttagcaaactcaattgtagaattctttggctggtatgtctgcacgactgctcggcccgggatatctcctctgccggcacgcccgcaaacttgtgtgagaagagaaaaagtcctttcatttgctctgaagtcatcaactccaagagaggagtctgcggcaagtactccaaccagggtgacatcagaaaaatctaatcctttagttaccatctgtgtgccaagcaaaatatctgcttctccatttttaaatttatttaatatcgcttcatgacttcctttagctgaagtggtgtcacggtccattcttaaaatttttgcctccgggaaaagccgcttcagttcgtcttcaattttttgggttccagtgccaaaaaatttaatatgctttgagccgcattcaggacatacggaaacattcctgatagaatatccgcagtagtgacaaactaaactgtcgctgttcatatgataggtaagaggaatactgcagtttttgcattccattacatatccgcactgtctgcatgaaacaaaggtgttataaccgcgtctgttcagaaaaagtatagtcttttcatttttttcaagatttttacgaatttcaaactccagtctattgcttatcggagacatattatggtaattaaatatttcacttctcatatcaacaatttcaacagacggcagggagttgtcattatatctgttattcatttcaaacagcttgtaatctccaagtgtttttgcatgataaaaactatcgacagaaggggtagcggaagccaaaatcaaaggagctccgtttgccgaagctctgtattcagcaacctcccgtgcatggtatctcggattgatttcagatttatagctgttttcatgttcctcatcaagaattatcattccgatattttcaagaggagcaaatattgcgcttctagcgccgacaacaacgtctacttcattattttttattttgttccattggtcaaatctttctccatacgataatccactgtgtattacagcgactcgtttcccgaaacggctgacgaatctttcaaccatttgaggagtcaaagagatttcaggcacaagcattattgctctttttccatcttcaatacattttcgtattgtttgaagaaaaatttctgttttgccgcttccggtgacgcctctgataagtatcttttcgtgtttgttctcgtctagaagattatctatataatctattataggtttttgttcatcagtgggttcgtattcatttgttacaatataatcagactcgtcatatacttcacgtacctttttttcactgtatatttcaacaaaccctttttcgcttaatgctgcgagagagctgtagttcccgtcagacaatgctattaactccgaagtcgtcagtttttcactgtccgctaaagccaaaagcatattgccttgaacatgcgcatgttttttaaaaagctcatccgcagccgcataagcttcatcagatgatattttaagcttgactattcttattgtaagttctcttattgaatcgcttattttttcagatatagatataacttttttgtctgccaaagaattaagagaccggtgataagcgggggaagaaacaagttcaccaaggtggtcatattccataatcccatcattttgaactagtatatcaactattttcttttgaaattctgatataccggatgtatcagagttttggagacttacccacctgcgtatcacagttttcattttcggcggcactataagcttaaatgcgctgtaaaacggacacaaatacctattttgcatccacacgcagagactaagaagttccttagagcaaaccggcttagtatcaactactgattttattctttttagcctggtaaattggctgctttgcgagataccgacgataagtccttcaacggaattattatatagaccaaacggcaccaggacgcggataccgacttttacagcgtcttctaattcttttggaacaatatagtcaaaagaacggtcgattatatgtttagggcttattaatgcaacctgtactatcatatgccttaccaccaaactattctataatatttgtttgcttttattaattgataaagctttgttaagaattatatttgacagctcaaatttatccattagaggaagttcgcttatatttccatctctatcaattaacgccgccacattagtgtcagtaccaaacccggcgcctgtagtttttaaattatttgcgactatgaagtcaacgtttttatttacgcatttttcagaagcatttttgattaagtcctcggtttccatagcaaatccgacaatcgtttttttatcactgaattttttaccaagttcctttaaaatatccggatttttggataaagctatactcatatcatttagattttttttctttatcttattttctgatacggcagacggtttaaagtctgccacagctgcggccattattattatatctgcactttctgactcattgattatactactcctcatttcatcggcagaggaaacgtcaatagttttgattccagtgataggttcacatgaattatgtccggcaaccagtgtaacttgtccgcctcttagcattgcggctctggcaagagcaaaacccatttttccggtcgagtgatttgttataaatcttacagggtcaattttttcctgagttgcgccggcgctgataacaatctttttgccggttaggtctgcggaatctaaaagcgctaattttgcgatgttttcaaatataacgtcaattccggctaattttccgtttccggtatcgccgcatgccaggcgcccgctttcgggcataacaaaatgatagccatgatacttttcactcaatttttttatattgtcctgcacaattggattttcaaacatatttgtattcatagcaggagctatgagcacaggagcttttgttgccataaccgtagtcgtcagcatatcatcagcgatacctccggcgatttttccgatgatgtttgcagtacacggaactatagcaaaaacatcggcggcttttgccagggatatgtgtcttatttcccatgattttggctcgtcaaatgtatcaattgccaccggattgcctgaaagggactgaaagctcagcggagctacaaattctacagctgattttgtcattataactttgacttgggcgccggactttacaagctttgaagtaagctcaagggctttgtatgccgcaattccaccggtaacacccaatacaacagttttgttatcaagaagcataaatatcacctacataaaataatttataaaaatcaagcccactcggactgccagtgctggttcagccggtgggcggttattcaaataacgtcagtttaaagacttccgatatccggcgttgggatatagttgagcttatcctcataaatttcttcagccgctatagatacctctttgtttgacggaatatcaaccataggctgttttccctctgtcagctgtcttgcgcgtttagcggtttcaatagtcagcaagtatctgctgccggttttttcaaccatttcagtaataggcggttttatcatcataattaatctctccttttatttaatatacttaatatttcatctgatgcgtcttctacaattttatttactacaacataatcatatttatctttttttgtaagctcccattttgcagcatttatccggtcttcaatttcctcaggagtttctgtattcctaccggtcagccgttcgcgaagtacatctatattttcgggagcaataaaaatatatacggctgacggatatttctcttgaagattcaatgcgccctgaacatcaatttccaaaagcacatcttttccttcatccaatttttcattaacatatttaacaggagtgccgtagtagttatcgttatagactgcccactccatgaattcgttattatcaatcatcctcttaaattcatcaacagatttaaaaaagtaagtttcaccctcaatatcgccgtttctaggagctcttgtggtagcagatattgacggaacaatgtctgaattatcagctaacagtttttttagcactgttcctttaccaacaccggatgggcctgaaacaacgattaaaagacctcttttattcatcgtcatcaccgccgtcttcaatgttttcatcaccggatttcggttctgcccttccggcgatagtttctgtttgtatagccgataggataatgtggtcgctgtcagtaacaataactgacctagtgcgtcttccgcaggttgcgtcaatcaccataccgcgttcttttgcttcctgaataattctttttatcggcgcggaatcagggcttacaattgctataacccttgagcctgatacaatgtttccaaatccaacatttataagtttcatattagcctcgcttttattcaatattttgtatctgttctcttatcttttcaattaatgatttcatttctacaacaatttttgataagtctatatcattgcattttgaaccaatagtgttggtttctctgttcatttcctgaactataaagtcaagtttctttcctattggttctgatgaattaagagcgtttttaaattctttgatatggcttttaagtctgacagtttcttcatcaacggcaactttatcagaaaaaattgcgacctcggttaaaattctgctgtcatctgctccgctttccagctcagataatgcgtcgcgcagtcttttttcaagtctttctttatatttagttatagtttcaggagaaagtttttcaactttttcaacttctgacgacagaatatttaaatgttctaaaatgctgttgttgagcctgcttccctcgttaatacgcatgttcaagaaatcttcaagagcagcgtccagcgcggtatttatcatatttaaaattgcttcttcatcaatttctttatattgaacttcaaatatatcagaaagcgagcacatggatgacattgaaatatcatctttaacaccaaagccggataattcacgcaaattatttatgtatgattctgctagaggaagatttattttaacctctttactgtcatcattgattttatttatggaaacatagacttctattttacctcttgaaatattctgagataattttgcacgtatgttttcttcaagaaaactataaattctcggagtttttatagtataatcagcatatctgtggttgacggacttaatttggattttaacttcatataaatcgtcaaatgtcatttcggctcttccaaaaccggtcatactttttatcataattctacctcataacaaattatttttacagcttgatttattaacaagaatatagtataatctaaataaataaaaattatcttgtatattacagtataaattatcattattttgcttatctatcttttaattataccatattttttattgattgccaatagttaagaagtgttgtaacaaaaatgtaatataaaaataatatatatgtaattatagtgtaattaaattgttaatatattattcggattaaattggcaattcacgggaaaataaagcattgttaacaatttgttaacaattttagcaaacgcctgatatgacgttgttatagatgtattaatattcaataaattgggcagtttcttcaattatagcccctaattctattgacagattttcggaaaagcggtataatcgtcacatagtttcaaaagttaaacgcagaaatttggccgtataaatgttatttggccggtcttatttttgttgctttttgaaactgatagtcaaaatttatgcagaaaggggttgtggtttagaatagcgcatagacgtatattcgaaatttttggaggttttttgttttgagttttggaaagagttttagaagaattgttgcaacactattagtattgatgacaatttctacttttataatactacctacatatgccgattacgatgagatcgatgaaccggctcaatactatggtgttgttcaagtctcaacacttaatgttagacaaagcgcatcaatggacgccggtgtaatcaccacgcttccgtatggtacaagagttagagttaattggattgaacccggctgggtttgcgttgcatataataatgatggacttattggttatgtttcagctgactatctttctgtttacgatggaacgatacctgaagcaagtgaaggcggtcaggctgtttgcgatatagcggcacagttccttggggttccatatgtttggggcggtacttcacctaacggatttgactgcagcggattggttcagtatgtatatgcacagttaggatttaaattggctcgtgtagctgacgaccaaatgaaagagggtattcctgtttcaagagaccagttaatgcctggtgatataattggattcagcagttcaggtcttggcggatatgcttctcatatcggaatatatgttggtgacggaatgatgattcacgcgccgcatacaggcgatgttgttaaatataccagtattaattctgattattatgcttcgcgtttcgctggtgcaagaagaattatttattaagtttaatattaagatgagggcgacctaataggccgtcctttttgttcatgaattatattaatataatataagtttatttaggagagtataacatgacgattgaggagttaaacagagcgattaagtcttatactataccgcgggtatttttcttttttggtgaggagacatatttgctggaaaataaaataaaatctataaaggataaaattgtccctaaagatttagtaagttttaatttttcatatttaaactcggataagatgacaccggatgaaataattgaagctgctgaaatttttcctcaggtttcggacaggcgtcttgttgttgtgaaaaacagcggtttgttttctaatctgacgacaggcaattttaaaagtattaaagaatatatattaaatcttccggaatatgtatgcttgatattttgggaggatgggtttgattctaaaaaagttaaatcactgaagtttattgaagaatgcggcggcgggatagtaaattttgaatacttgccggtaaacaaacttgaagtttgggctgagaaacagcttgaaaaagcaaacaaaaggataattgcccgggatttaagttattttgtaagaatatcaggtcagtctttgacaaagttaagcaaggatataaaaaaattgattttgtatttgggtgatgagcgtcataaggtaacaagggatgatatagacgcagtagtcacgaaatctgcagaggttcaggtttatgatatatttaataaaaacattataggcggacgcggagataaagccaaggagcaattgaaacatttaaaaactgataatgtttcacctactatggtaatgagtattattttagaccagttatatgaactgctgatgtgcaagctgttaaaacaggatggtctgacagcaggagaaatgcttgaatactttgacaggcgccctccgatttttgcagtaaataaagctattgataatggtatgagatatagtgaaagttatttgaaaaaaatggtcgataaaggtttgaaatattcaattgatatgaagtcaggcaggatgggacaatgggatgctgtcgagctttttgtatctgaattaataaaaaaagattaaagtctatgtatttaataatataaatatattggctgcgggtgaatataatggaaaatggcgttataatgcagtattttgaatggtatcttccgcctgacggaaaccattggaatagattaaagaatgatgcaaaacatctgtctgacataggaataactgccgtgtggcttcctccggcttataagggagctaacggaatatttgatgttggatacagtgtttacgatatgtatgatttaggggagtttgaccaaaaggggtcggtttccactaagtatgggactaataaggaatatattgaagctgtagatgagcttcataaatatggtattgatgtttatgcggatattgttttcaatcaaagaataggtgctgacggaacagagattgtccgggctattgaggataacccgcaaaacagagaacagcagacatcaggtattgaagaaattgaagcatggacgagattcgattttttaggaagaaataatacatattcggattttaaattggattggaagtgttttcacggcgtagattatgatgagagaacaaaaagaagttcaatatttttgtttgagggtaaacactgggacgaaaatgttgacagagaattgggtaactatgattatttgatgggggctgacaccgattttgattatcagccgcttaaacaaagtttatttgattggattgattggtatgtcgatacagcaaatattgacggttttagaattgacgcagtaaaacatataaaatttgaattttttaaggagtggctgtcttatataagaaacagtaagaaaagagaattttttgcagtaggtgaatattggagtaaggatttagccaggcttcaaaactatctcggaatttgtgagaatgctatgtctctgtttgatgttccgcttcattttaaattttttgaggcttcagccagcgacggaaatatggatatgtcaaagcttttagatggaactttagtgtcgtctgagccgacaaaagctgtaacttttgtagaaaatcatgatacccaggagggtcaggcgctccagtctgcggttttaaattggtttaaaccttcagcatatgctgtcacattgctgcgtaatgaaggttatccctgtatattttatggagattactatggtgttccatcccataatgaaaaaccattcatggatattttggataagcttttgtggttaagaaaagaaaaagcttttggttctcaaaacgactattttgacgactttgatgtggttggatggacaagggaaggcgacgacgaacatataggagccggacttgcggttttgattactgataagcggggcggtgttaagaaaatgtatataggaaaaagacatgcgggaaagattttttatgattgtataggaaattgtgctgatactgtaacaattgataaagaaggttatggtgtttttgaagtttctgacggttccgtttcggtttggatattaaaaaatgaataatatactaaaaaatctttgttaattttgttcataatatttgacaaaactcttataatgtgttattctaagtagcggtataagcggatacggtttaaaccgtttaattggaggtgagggtttggcggacgaactaaagctgattaaaaaagcgcaaaaaggtgacgttgaagcttttgagaagattattactgagtatcagtctattatatataatatagcttttagatttgccggaaatgctgaggatgcggccgatatgtcgcaggaagtttttctgaaaatgtttagaaatataaactcgtttcaatttaagtcaaagctctcaacctggatttatagagttgcaacaaacacttgcctggatcaagtgaagagaaaaaatcggaataatcctgcttattcattagatgacgggtttgaggacggcgacggaagctttttctcaaatgaaattgcagatgattctcccacacctgatgaagttattgaacaggctgaaatgaaagacgttataaaccaggcaatatcagaattgcctgatgattatagaactgttattatattaagagatatacaagggctttcctatgatgagattgcagagataattgaatgttctgttggtaccgttaaatcaaggattagcagaggaagaagaaatttaagagaaattttatctaaagacagggaactttttgataagtatttcgtctaacaaaatgtagacggatatatgtctgaatatacaatatgttggattttattaattgaatatttctgtgtatatttttgtgtattcgttcaattttactataatgtatataggaaggaggggtataatgtcagattacgaaaaggatgatgagcttcgccgtaagtacggtgaggttatggacagtattgcggacgatattcgtcagataaatgtaaacaaatctgaaaagattgttcttgacgaaaaagctgatgatatttccgaaaataccggagatattttaagcggatttgaatctgccggcggaagcgatgctattgaaaacaacgatgtgaaacatgattattctgacaataaatttttggagagtataagcagaatcgattttgacaatccagacgaagtattgcggagtattgattctggaaatgatgaatttaaaaatttatcagactttaacgaaccggattttgatgccccgcattacagtgtccctaatcttgataataatgtgtcaggagttttggagtctaatgatgaatttgatattcctgaggattatcctgatactttgagttgtgatgaatgtgtggatttattgtatgactatttgtctgactcaactgatgatgttgaaaacatgtctataaaagctcaccttagaaattgtgagatgtgcagggttgagcttgatgatataagagatatgattggcgttatgagcagttcgccgaggttgactcctccggctgacttgatatcaagtattcatagtgaactggtatctgcggctccggaagtcaagtacgaatatgaagttattaaagcaagcggagttttaggcgccggtccgattgataaattaacagcggcatttgaaacagcgcggcataaagttgaccattttataagacatgcaaattggaggattcttgctccggcggcacttagtgctgttttggttgtaggcgtggcttcaagcggcttatatcaagtaatgaagtcttctgatgaagtatatgatttttctgataatgccgctatagagagtgcaaaagctactgctaaacccagcgccagcgggcttgacgagtatgttggaggaagagcgtcagaatcttcgccaagaaccacatcggcgcccagagcgtcttctgttcccggaaattcaacttcaccgagaactacagctagaccatcagccggaagttcttcagggctgaacattggttcaagtactccgagcagcagttcttcaaataaatctacatcgtctagcacatctggcagcggaagtacaaataaaaatacgactaaaagtaattctaacagcggtagttcaaataagtcaaatacttccagctctacaaataaaaacaacacaagcagctcaagcaataaaaataatacggctgcggcaactccggctcctaaagcttatgttactccgaagataattttgccggatattacgtcagctatgacacaaggaacacgctcaggacaggataataatttagttatacctgaaaatccggcgcctgaaaagtttgaatatactcccagtgacgattcaggaagtcaggaggaagcaaatcagcctcagactcagaatgagtccaacgatacaaatattccgaatactccagccgctgtaacatcaggcggaggaggcggcggaagcgcagcggaatcaacagcaactccggaccctactgagaacccaaaacctacgcctgagcctactcccggtgcgtcggctccagtagcgacaccttctattactgcagaaccaaaactgggcagaaatagtaagggagaaactaaagcatttgcagataaatcagaaaatatggacgatgcctctgtagtgagctgtgagattaaagataaagcggtatatgacgttcttatgagttcagcgcttgctaactgttcaaagattgatgagaacggcgaggtaacattatactttactggagctgaatatattgcgtttactgacttcttaaaagccaacggcttagaatatactttagttgttcttggtaataatgatgatgtaaaagtgcttgtcacaggagtaaacgtgacagaataatatggtttataaaggaatggtcatttgtgccattccttttttattggatttttttgttaatatataatttacaaaaagtttttgtctgttaaatagatttttatatttttattgggtataattataataataaaatatattaaaattttggaggcggataaagtgggaaatattatatcttacgtaaaagaaaacggttttctaacttttgacgctatggactttaatgaggttgacagccttgttttgtcacaactttcatatctttgctttgatagctttatagaaagtgttcctaaatttgatataacatttaaggatttagcggaaaaagaaaataggaaagagttatttaaaaatattcgtactccgaaacaaaatcatagactgcttgacgcagttgcggagagtgagcggtttggaaacattggtattggaatttatgtcaatgaaatagaaaaagaaatagaaaaacaattttccgctgtaactttcaaattatcatcagagaaatattatatagcatttcgcggcacggataaaagcctgattggctggaaagaggattttaatatgtcttatcttaaaaacgttccggctcaggattccgctctctgttattttaaatctgctgctgaagagcttgacggcgtgttcatattgggcgggcattctaaagggggaaatttatccgtctatgcggcggctaatgctgatgaagacgaatttttgagaatagaaaaaatatataatcatgatgggccgggattcagagataatactttaagccaagaaaaaaggtctaaactttcggatatagttttgaaaacggtacctaaagcttctgttgttggtctcatgcttgaaagtgattcaaaatataaagtagtattcagcaagtccttagcctgcaatcagcataatccgtttacatggtcggttaaagctgatagttttgtattcataaaagaaacggatatgttttcgagattttctaaaactgctgttgataaatggcttgagaataatgatgatgaaactgtgagcggtctgattaattatgtatatgatttgattaaggcgacaggaagtgatactgtggctcagttaataaaaaattggaataaaaatataagacttatttataatgaaataaaaatttcggatccggagcttaaaaagttagcagtcaaggctctgcatgattttatagtaatttttaaggatattttaaaagggaaaagaaaatatagtgatgcgaaaacttgttctgaagtcagtatatcaagcaaataaattcaggggcgtttaattcatatttgaattagacgcttcgtttttatattaactattataatatgcttgtggttcgcagtcaatgaataaaatttatgtattaaaagttagtttatttgtgtgtatacgactttatttattgtttattataaaatatcttattattgtttttctaaaaacatactttttgtattagtttacataagcattcaatttgcatcccgttatgttacgtttatagcacaatttgttattattgcttatttttgattgaaattttagttaaaaatgtcagcgtataatatatctattttaatgctgcaaaaataattcaagaaaaactgcgtataagattgacaaaagataaatttatgtttaaaatactatatgtatgtaaaattataaaatattatgacaattctgctgaaaaggagcttttgtatgagtataaagagactgtttgtagaaaagaaaaaaggtttcgatatagaggccgaagagcttaaatctgaccttgttgaaaatttaggtctgagcggccttaccggtgttcgtgttataaaccgttatgatattgacggtatcagcgatgaagaacttcaaaaggtgcttcccagtgtttatgcggaaccgcaggtagacaatgttgaatttgaaaatatagaaataccaagcggtgataaatattttgtttcagaatacctgccgggtcagttcgaccaaagagccgacagtgcggcacaatgtactcagataatgacagaaggtgaaaaaccggttgtcagaaccgctagaattgttattttgtcaggtgatattagtgatgatgagttaaaggctgttcaggaatattgtatcaaccctgttgagtcgcgtttggcgtctatggaaaagccggataccttagccgacaaccttgaagagccggctgacgttatgattgttgacggttttatagatatgaatgataaagagcttgaacagatgattgcagatttgggtctagcaatggactatgatgatataaaattctgtcaggactattttaaaaatactgaaaaaagaaatccgagtttgacagagatacgtatgatagacacatattggtctgaccattgccgtcatactacattttctacaaaacttaataatgttaaaattaaaaatgagtttattaagtgtgtatataacgattacctggaatcaagaaagttcgtatatggtgaacgcaaaaagaatatctgtcttatggatgttgctactattgccgctaaagagttaaaaaaacgcggtatactaaccgctcttgatgagagtgaagaaataaacgcctgctcaattgaagttgaagtaaagatgactgacggtaccagtgaagactggctggttatgtttaagaatgagacgcataatcacccgactgaaattgagccgttcggcggagctgcaacctgtctcggaggcgctatccgtgacccgctgtcaggccgttcatatgtctatcaggcaatgagggttacaggtgcgggcgacccgagaaaaacattaaaagaaacaatggagggtaagcttcctcagcgcaaactggttattggagctactgagggctatagctcgtatggaaaccaaataggtcttgctacaggcggagtaaccgaaatatatgacgagggatatgttgctaagcgtatggaaatcggcgctgtaattgctgccgctccaaagaaaaatgttatacgtgaagttcctgaacctggagatgtggtgattttacttggcggaatgacaggccgtgacggctgcggaggagctaccggctcgtcaaaagcccatgacagttcgtctttagagacctgcggcgctgaagtacagaagggtaatccgccggttgagagaaagctgcagagattattcagaaagaatgaagttaccacactgataagacggtgtaatgactttggtgccggaggcgtttcggttgccattggcgagttggctgacggacttaatataaaccttgataaggtgcctaaaaaatatgagggtcttgacggaacagagcttgctatttctgagtctcaggagcgtatggctgttgttgtaagagctaaagacgctgaaaagtttattgatgaagctgataaagaaaatcttgaagctgtagtagttgctgaggttactgaatcgccccgcctggttatgaactggcgcggtgatgttatatgtgatatttcaagggagttcttgaataccaacggcgctgaaaaaaatgctgatgttgagattgcggttgataatttctcgtccgatatgtttgaatttgaaacaaagggaaatgactataaagagaagattttaaatttaatgagcgacctgaacgtatgctcgcaaaagggtcttgttgagagatttgacagcactattggaggaaactccgtgtttatgccgtatggaggaaagtatcagcttacgccgcagcagaatatggttgcaaagattccagtgctgggaaatgaaaccaatactgcaactgttatgtcttatggttataatccgaaaatatcaaaagcaaatccttttatgggcgctgtttatgcggttgtggattcggttactaaagccgtgtgtgccggtgcggattataaggatatttatttaacgttccaggagtattttgaaaaacttggaaacgatccaaagagatggggaaaacctcttgcggcgcttcttggcggttattatgcccaggagagtttgtctatggcggcaataggaggaaaggactcaatgtcgggttcttttaatgatattgacgttccgcctacactcgcgtcatttgcagttgcgccgcttgacgcttcaaaggctgtatccagtgaatttaaaaatgccggaaacttggtatttttggttaagcctaagtatgacgaaaataatctgcctgatttcgatagtttaaaacagctctatgatatgttatacatgatgatttcagacagtaaaattaatctgataaagagtgtttatgctgttggatacggcggtgttatggaagccgtttgtaagatggcgatgggaaataaactaggatttgaatttaccgagtgctgcgataaatctgaattgtttaaggctttatacggaagtgtaattattgaagttgacggattaaaggcaaacggttctttgggcagtatgcttgaaactgttaagctgggtcatacaacagacgacggcgtcataaagattgaaaatgaaagtataagtattgatgagattgtttcagcatggcagaaacctcttgaaagcgtttatccaacaaagtcaaaatatgaggatgttggaatgaaaaagtttgactgttcagagagaaatatttctgtgccggctgtaaaggttgctagaccaaaagtgtttattccggcttttccgggaacgaattgtgagtatgattccgcccgtgcttttgaaagagcaggagcggaagctgatgttcagattttcagaaatctgaagcagtcacatgttgaagaatctatcgaaagatttgtgaaatctgtcaatgaagcgcagattataatgattcccggcggtttcagcggcggagacgagcctgatggttcaggcaagtttattaaagcggcttttgaaaatgagaagttaaaagaagcggttatggagcttttgaataatagagacggattgattcttggtatttgtaacggttttcaggcgcttataaagttagggcttgttccgtttggtgagataagaaagatagacgatacctgtcctacactgacatttaatactataggcaggcatgtatctcaaattgtgtcgactagaatttcgtctgtaaaatctccgtggctgtctggagttaatttgggcgagatacaccagattgcagtatcccatggtgagggcagatttgttgccagcccggaaataatcgcggaaatggaaaagaatggtcagattgctacacagtatgttgattttaacggtgaaccgacttatgagatgccgtataatccgaacggttcttattatgctatagaaggtattacaagtcctgacggaagagtgtttggtaagatgggtcattctgagcgtatcggggaaaatgtttataaaaatataaccggtaatatagaccaaaaaatatttgaaagcggagttaaatattttaaatagtataaggagaaaaccatgtcatattatgaagcgtccgaattccttaaaacaaagactaatataagacctaaaacggcggtagttctagggtcgggtttgtcagaactgattgatatggcagaagtagatacaatcataccatattctgaaatacccgggtttcctgagttaaataatacttatcataaatgccgggctgtttttggaaaactttcaggaaaagatatattgattatgcagggaagaatccactattatgagggattttcaatgcaggaattagtttttcctatacgaatgatgaagtatctcggtatagagacggttattttgactaatgccagcggagctataaatactgattttgttcctggtgatttagttatgattgaagaccatattaaactaggttttgattctcctcttcgcggcaaaaatcccgatgagtttggagaaagattttttgatatgtcaaacgcatatacatccggtcttaaagaattggctctaagcgctgctgagaaagaaaacattaatcttaaaacaggtgtttacggatatatgaccggacctcagtttgagactcctgctgaaattagaatgctgaggatagcgggcgctgatattgttggtatgtcaacggttcctgaggttatcgccgcttgtcattgcggtatcaaagtcctgggattatcgggagtatcaaatatggcggcgggaattgagaacggcgggttcaatacagaagtaattgaaaatgccgaaccggtgtttagtgataaagttaaaaggctgattgagagaattatttgtgatataaattaggagatgatgatatggacagaattgcaagtttcagcgttgaccatagaaaaataaaaccatgcgtatatatatctagaatagacggagatataacaacatatgatatgcgtatgagaaagccgaatactggagaccttttaagcaattcagcgctgcattcactggaacatatgttcgctactcttatcagaaattcggaaatcagcggcgacgttatatattttgggcctatgggctgccaaaccggattttatctgcttattagaaacgctgataatcagcaggtcattgatataataaaagaaactttaagaaatataattatatatgacggagagatgccgggcgccagtgagatagaatgcggtaactatagaaatttagatatgaatctggcgaaagttgaagctgagaaatatttagaagctattaaagatataggcgttgacgatttggtatatgaaacctgaggagaaattataatgggaaatattttgattaaaaatattactgctgtaacaatgtcagacagctcaggagtgattgagaacgcttatattgttataaacggaaatctgatagagtatataggaaaagaaaagcctgagacagaagatttcgattatgtgatagacggagagaataaagttgttatgccgggtcttgtaaacacacatactcatttagctatgactttgcttagaagctatgctgatgacatgaatttgcaggattggctgttcaacaagatttttccgtttgaagataagctcacggcagacgatattttaaagggcagtgaaataggcgttgatgaaatgctcgccggaggaaccacttgtttcaacgatatgtatatgtttcaggctgaaacgggcagagttgcgctgaaaaagggaatacgagcagttttgagcgactgcgtgaattttgacggctacgatagaaaagttaaactaatggaagcaatggctgaagagtttaagaatgaggatttaataagcttcactttttcacctcatgctatctatacatgtagttttgacgtgcttaaaaagtgttcggattatgcgaaatctcatgatatgagtattcatactcatttggcggagacccagacggagtttgacgactgtgttaaagagcacggtatgacgccaactgaatatatggaaacaacgggtatttttgacagccctactattgcggctcattgtgtgtgtatgacggataatgatttggaaatattaaaaaaacataatgtaagcgttgtgcataacccaataagcaatttaaagcttgcttcaggagtcgctcctataactaagatgattgatatggggataaatgtggctctggggactgacggagcgtccagcaataatagtttggatatgtttgaagaaatgaaagttgctgctattttgcataagggtatcaccctagacccaactgttatgaatgcctggacagttttgaagatggttacggtaaacggcgctaaggcgctggggtttgataatttgggagttttaaaacaaggatatttggctgatatgattatacttgattttaactctcctcatcttatgccgaataataatactgtttcaaatttagtttacgcagcaaaatcaagtgacgttgagtatactattgtaaatggaaaattagtatataaccgtcaaacaaaagacagataaatattttttataaatcaggaggaattaggtatggcacaagtagcaattgttatgggaagtaattcggatttgccggtagttcagggagcgattgaccagcttaaaagctttggggttgattttgaggctcatgttatttcagcccacagaacacctcagcgtgctgaggaatttgctaaatcagcaaaagaaaacggtgttaaggttataatcgcagctgccggaaaagcggcgcacttgggcggtgtaatcgctgcttatactactttgccggttatagcgcttccaataaagtcttcgtttatggacgggcttgattcacttttatcaatggttcagatgccaacaggtattcctgtagcgactgtaggagtgaatggtgcggataatgcaggtatacttgcagttcagatgctggctgtttcagattcagcgcttgcagaaaagcttgacaagtttaaggcggatatggctaaagcggtagaggagaaggataaaaagcttcaagacgaacttttaaacaaagcataataaattattttacttaaagataaaaatctatttggaggatatgtgatgagcgaagcatataaaaatgcaggggtagatgttgaggcagggtataggtctgttgaacttatcaaagaacatgtaaagagaacaaatattccgggtgtattatccggtataggcggatttggcggtctgtttgagttgggcggcgaatataaaaatccggtattggtatcaggaaccgacggagttggaacaaaactgaaactggcttttattatggataaacatgacactgtaggtcaagattgtgtagctatgtgtgttaatgatattgtctgcggaggagcaaagcctttgtttttcctggattatattgcggtaggaaaaaatattcctgaaaaaatcgccgatattgtaaagggcgtttctgatggttgcgttgccgcaggatgtgcgttggtaggcggtgaaaccgctgaaatgccgggattttatgacccgagtgaatatgatttggccggattttctgttggtatagtcgataaagaaaaaattattgatggagaaaatattaaaccgggcgatgtaatcatcggtattcagtcttccggggttcatagcaacggctattctcttatcagaaaagtatttaatatagatgacagttctgaatgcgccgaggctttaaaagcttatgatgatgagttaggctgctctgtcggtgaagctcttctggctcctacaaaaatttatgttaagccaatgcttgcggctattgacgctgttgatgtcaaagcggtttcacatatcactggcggcggtttttatgagaatatacctagaatgttgaaagacggcactagagcaaaagtatataaggaaaagtttgaagtattgcctatattcaagaaaattcaggagatgggcggaatatcagagcatgatatgtacaatacttataatatgggtattggcatgatgtttgttgtacctgaaagtcaggccgaagaagctgttaatgctgttaatgcagcaggcgaaaaagcttttgtaatcggagaaattactgaaggcgaaaagggtgtagatatatgctgagaataggtgttttggtttcaggaggcggcacaaatctacaggcgattatcgacgcaatatcaaacggtaaaataacaaatgcggaaattgttaccgtggttggttcgagacccggaatatacgcgcttgaaagagcaaaattaaacaatataccttctattgttatttcaagaaaagcatttaattcattgcaggagcatgatactgcgatttgtgaacatatgaagtattgtgatgttgacttgattgtcatggcgggttatttgagcattgtcggtgacaagctcataaacgaatttaataataaaataataaatattcatccgtctcttatcccatcgttctgcggtccgggattttatggccttaaagttcacgaagccgcacttgaacgcggcgttaagataaccggtgctactgttcatatcgtaaatgaagtatgcgacggtggtccgatattgcttcaaaaagctgtagaggttaaacccggcgatactccggaagtgctgcagaagagagtaatggaagaagctgagtgggaaatattacctaaggctatagatttgattgcgaacggaaaaatataaattttggaggctaatctgattatgaaaattattgatttatcccaagaattaaaagaaaatacatatcccggcaggggaattattgtcggtaaatctcaggatggaaagagtgcggtttgcgcttactttataatgggcaggagcgctaacagccgtaatcgtatatttgttgaagatggaaacggaatccgtacaaaagcttttgacgaatcaaaactggaagacccgtcccttataatctatgcccctgtaagggtgctgggcaataagacaattgtcacaaacggcgaccagactgatacaatatatgaacttatgaataaacagatgacctttgaacaggcgcttagaacaagggagtttgaacctgattctccaaactatacccctaggatttcaagtgtaatgaaagtgagcgacggggattataactatgctatatccatattaaaaagtgcagacggcgacccttcttcatgtcagagatacagctttgcttattcaaatcctataaatggaatcggtcattttatccatacgtataaatgtgatggaaacccgcttccaagttttgagggagaacctaaaaaagtggaaatacctaattgcattgatgagttttcaaatatgatttgggagagccttaatgaagataacaaagtttctttatttgttagatatattgatataaaaagcggcaaaaccgagtcgaggataataaataaaaacgtataactgtatacgtgaaagattttagcaaactttgtattcaattttaggaggaagataaagtatgaaagaaatggaactaaagtatgggtgtaatcctaatcaaaagccttcgcgcgtatatatggaagacggcagtgagcttccgattacagttctgtgcggaaagccgggctatataaatcttttggacgctctaaacggatggcagcttgtaaaggaacttaaaaaggctacagggcttccggcggctacatcgtttaagcatgtgtcaccggcaggagccgcagttgggcttgagctttccgatacgcttaaaaagatttattttgttgatgatactattcaaatgactcctttggctaatgcttatgcgagggcgagaggtgcggacagaatgtcttcgtttggagattttattgcgctttctgatatttgtgataaggctaccgctcaattgatcgcaaaagaagtgtcggacggtgtaatcgctcccggatatgatgacgacgctttggaaattttgaaaggcaagaaaaaaggaaattataatataattcaaatagataaagattatattccatgcccgatcgaaaagaaacaggtttatggagttacttttgagcaaggcagaaacgagcttgacattaataaggaacttttgtcaaacgttgtcacagagaataaaaatatttcagaatcacagcttcgtgatttgatgatttcacttattactttaaaatatacacaatctaacagcgtatgttatgttaaagacggacaggcaatcggtataggcgcaggtcagcagtctagagttcactgcacaaggcttgccggaaacaaagccgacgtatggtggctgagacaggctcctcaggttttaaatttagagtttgttgacggtctgaaaagggctgatagagataatgcgattgacgtttatatttctgacgagtatatggatgttttatctgacggcgtatgggaaacccgatttaaaacaaaacctccggtatttacaaaagaagaaaagacagaatggctgaaaaagaatacagacgtttcactcggaagcgatgcgtttttcccatttggagataatatagaaagagcgcataaatcaggtgttacggctattgcacagccgggtggttctatcagagatgacaatgttatagaaacctgtaataaatatggtatggctatggcgtttacaggtatacgcttgttccaccattaatattaataaataattagttgtttagaaattgttaaaagcatttgtacaatgtattgagtgttaaaggttgtacgaaaaatatttattatctttcgaaaaaattggagcattacttatattaatgttttgtttagaagtttgttgtatataattgtttttaacagtgtattaaaaaattttgtatttagtgatttacggcatagtcaaaagcggctatgccttttattttttataaattataattaaagagtgaggtataatgatttttgaaacagaacgtttaaaacttagagaactaaatatggacgattttaaagatttggctgaaatattacaggataaaaatgttgtatatgcgtatgagcatgacttttctgacagggatgtgcatgaatggatggagcgtcagtttaacagatatttaaagtatggttttggattgtgggcagttgagttaaagggaagcggtgagatgataggacaagccggtttgaccattcagccatataatgattctgaggtgttggaaattggttacttattaaagaaaaagttttggcataaggggtatgcgacagaatcggcaatgggatgtaaagaatatgcttttgaagttttgaaagcggataaagtatattctattataaaatctgataactatccttcaatacgagttgctatgtctattgggatgagtaaagaaagtgaattttatactcagtattatggtacaaaaagtttacactatttattttatgtaagtaaaaaataaaatacatattatactgagtttatatagtaaaaatccatctgaaattatttaaataatttggtgaaaaaagccttttaattggataagtgttatgttataatattgggcaagctattaaaatgaggtgtattatgctagatataaagaaagttcaaatgtatacagacggagcatgcagcggaaacccggggccgggcggttatggaacaattctaaggtatggggaatttgagaaaaaattgtccggcggcgaggctcagaccactaataaccgtatggagcttatggctgttattgtcggtcttaaagctcttaatcaaaaatgctgtgttgatatatacagtgattccaaatattttattgacgcaattgataaaggctgggcaaaaaagtggaaaagcaacggatggatgcggaataaaaaagaaaaagctttaaatccggacctttgggaagaggttttaagtcttcttgaaaagcatgacgttactcttcattgggtcaagggtcacaacggacacccggaaaacgaggagtgcgaccgaatggcagttgaacaatctaaaaaatttagctgatacaattattttaaaagcaaataaattacggtaaatctacttttcatagattgagcgtataaaaagaaaggtaggaaagagtatgagaatttatgtggacaatgcggctactactaaaatgaatgccgcagtcgcagaggaaatgattccgtttatgacggaattttacggaaacccatccagtatttatttggagggcagggaggcaaaaagggctgttgaaaagtcgagagaacaagttgcaaaggctatttcagcggaacccaaagaaatatatttcacgggaagcggtacagaagcagataattgggctgttcgcagtgccgcgtcagcttattctaataaaggaaaacatattataacaagcagtgtggaacatcatgcggttctccatacttgtcaggacctggagaaacaaggatatgaagtgacctatttgccggttgataaatatggcagagtttctgtggaggatttaagaaattcaattagacctgatacgatactggtttcaatcatgtttgccaataacgagattgggactataatgcctgtaaaagaaataggcgctgtgtgccgtgaaaacggggtattgtttcatactgacgcggttcaggcaataggaatgtgtgaaattgatgtagaagaattaaatatagatatgctttctttgacggcgcataagtttcatgggccaaagggagcaggggctttatatgtgaggcaaggagttaaactgacgccttttattaccggaggagcacaggaacgcggcaaacgcgctgcaactgaaaatgttcccggaattgtagggctgggcaaagcgatagagctggctgcagagaatattcctgagagacagaaaaaattatcggaactcagagattattatatagaaaaggttttgaataaaataccatattcaagacttaacggtcatccaaaggacagacttccgggaaatgcaaacatcagttttcagtttattgaaggtgaaggaatgctgcttcgtcttgacatgaaagggatatcggcgtcaagcggaagcgcttgcacttctggttctttagacccgtctcatgtgcttttggctatcgggttaaaacatgaagaagctcatggttcgctcagagtttcttttgatgaaacaaacacgaaagaacaggtagattatattgttgatgaattggctgatataatagaacttctcagaaatatgtcgcctttgtatgaagattttatcaaaaataattagtcaaaggaggaaaatatatgtatagtgaaaaagttatggatcatttttcaaatcccagaaatgtgggcgagatatctgacgccaatgctgttggacaagttggaaacccaaaatgcggggatataatgaaaatatatatgaaaataaatgatgacacaaaagtgatagaggatgtaaaatttaagacattcggatgcggagcggcaatagccacttcaagcatggccactgaacttgttaaaggtaaaactattgatgaagcattggagttaactaatcaggcggttgcagacgctttagacggtttgcctcctataaaaatgcactgttctaatcttgcagaggaagcagttcatgctgctcttgcggactattatgaaagacatggaatggatacatctgaaataccgcagtgcacaggctgttgttcttcgtgcagtattgagcatgaaggcggcgaggattaagctatgtcagaaaagattgtgataggaatgtcaggcggcgttgacagcagtgtagccgcggcgcttctaaaagagcagggatatgaggttataggcttaaccatgcgcctgtgggacggagaaacagtaggtgatgtctttagagacggaacctgctgttctttgtcagcggtggaggacgctagacgagttgcatacaaattaggaatagaatatcatgttttagactttcgaaaagagtttgagaaatatgttattgactattttgtgaatgaatatcaaaatgccaggacgccaaatccttgtatagcatgcaataaatttctgaaatttgacgctatgttaaaaaaagccaaattgcttggtgcagagctgattgccacaggccactatgcaaaagtctcctatgattcttcatacggcagatatcttttgcgccattcaatggcttccgaaaaggatcagacatacgctttatattctttaaatcaggaacagttaaagtctataagaatgccgctgggagaaattgacggtaaggcccgggttcgcaaaatagcagaaaggttggatttgccgactgcttcaaaacctgacagtcaggaaatttgctttgtgcctgataatgattatgtgtcttttatagagcgcaggactgatagaaagcctgaacccggaaactttattgacgagtatggtaatgtgctcggcatacacagcggtataacccactatactataggtcagcgaaaaggacttggaatagcttttggaaagccaatgtttgtgacgaaaatcaatcctcttactaatgaaattacattgggcgaaaaaggcagtgagttttctgaaagtttgattgctgacaatttaaatttcatttcatttgaaagttttaatgagccttttgaagccttggctaaaatcagatacagtgctgttccgtcttcctgcatagtttatccttatgagaatgatatggcaagggttgtttttgataaaccgcagagagcggtaacgccgggtcaggctgttgtattttatgagaaagacagtgatatagtaattggcggcggtacaataaaagaggggtgattaaaatagattttcttagtttgagacgaagtataattgataaagagtataagaacctgaatgaaagacaaaaagaagctgtgtttacgactgagggtcctatattagtgcttgccggggcaggaagcggaaagaccactgttataatacataagattgctcatctgattaaatatggaaaagcatatatgagccagcatatcccggataatataactgagcaggaaattgaatttttggaatggtatttaaacggtgaactggacgagctcactcctgagatagagaattatctgtcagaggagccggttaagccttacaatattttggcaataacatttactaataaagctgctggagaacttaaagcaaggttggaaaaaagccttggagcggttggaaatgacgtttttgcaagcacgtttcattctatgtgcgttaggtttttgagacgtgatattgataagataggatacgaaaaggcgtttacaatatatgacagcgccgaccagcagacagttgttaaagagtgcttaaaagagcttgaaattgatgataaaaagtacccgccgagaaaagttttaagcttaatcagcggagctaaggataagctgatagacgctgatgaatatatggacggctgtcaaagcgactattatttaaaaaaggttgctgatatatacaagctgtatcagagaaagctcaagagcaacaacgctttggattttgatgatttgatagtgctgacagtaagactgtttgaagagtgtcctgaagtgcttcagtattatcagaataagtttaaatatattttggtggatgagtatcaggatactaaccatgctcagtatagactggtaagccttcttgcaaataatcataaaaatttgtgtgttgtgggagacgatgaccagagtatatataagttcagaggagccgatatacaaaatattttgggatttgagcaggaattttctaactgcaaagtgataaagcttgaggaaaattatcgttctacacagcatattttagacgctgcaaacagtgttataaaacataacgatggaagaaaaggcaaagagctttggacttcaaacggcgaaggtgaaaaaatcagcttatacattgctgacaatgaacatagcgaggcgcagtctatagtagaaaatatattaaatttaaatgcaaatttgaatgatacggttatattatacagacttaatgcgcagtcccgtattatagaggatacactattgagaaatgctattccctataaagttctagggggcttgaggttctatgatcgtaaggaaatcaaggacataagctcatatttgaggctgattgtaaataccaatgatgatattgccttaagaagggtaataaatgagccgaagagagggattggaaataccactttggaaagagtgcattcagtatcggtgcagaacgctttaagcatgtttgaagtttgtgagagagctgacgagtttgacgaattcaattcatcagcgtctgccaaacttaaaaagttttcagaacttataaataattttaagcgtgacctagatgatggcatggggcttgagctttttgttaaacttgttatgaaaggttcgggtatggttgaggcgttaagcactgaaaagacagttgaaaaccaaactagacttgaaaacttggacgagtttatttcaatggttcaggaagcggtccgtgaagatgaaacaataactttagaccagcttttagaaaatatctcactggtttcggatatagataactatgatgaggcacaggaatgtgtgacgctgatgacgcttcacagcgcaaaaggactggagtttccgaacgtgtttttaataggcatggaggagagtgtttttccgagcgcgaggtcgtttggagttctggaggaattagaggaagaacggcgtctatgctacgttgggataactagagcaaaaaagagactgtttttatcagctgcaagacaaagaactttatttggacaaacaaagtataatatgccgtcgagattccttgaagaaatccctgaagagcttgttgataagaaaatagatactccgtcatactctgcaggcagtacagagtcttcgtacaaatatgctggtgagactaaaaatacatacggcggttttggagacagcggtttcttaaagaaggcgccggagaaaacattgcaggatgaaacttcatatattgttggggataaggttaaacacagaaagttcggtattggtatagttgtatcagctcagcagatgggaaaagactgtttggtagtcgtagattttgaaagcgtcggtcagaagaagatgatggccgcttatgcaaactttgagagagtggaatagtatatgtacaatgatttttcgctgatttatgataggtttcaggagatagattatagggaatttataaatttttatatagaggtatttaaccgaaataattatgagccgcattcgattatcgatctaggatgcggctcaggagaaataacggttttgctcggcaaaaaaggctatagtgtaacaggtattgacatatcaagcgatatgctttctatagctcaaaataaggcctttgacaacggcgttgatataacgtttttaaatcaggatatgactgaatttagtgttttagataaagcggacgcagttatatcttcgcttgattgtattaattatttgccgtgtctgaatgatgtgaaagaaacttttagctgtgtttatgagagcctcaaaccaaatggaatatttatttttgacatcaactcagaatataaattaagcaatatattaggcaataatacttttgtatatcaagatgatgaagcatattgtgtttgggaatgcggttattttcctgaagacaaagttacgagttttgagctgaacttttttgtgaaagacaattcaggaaaatacgacagatactttgaatatcaggaagaaaaattgtattctttacgagagcttcaaagtatagcagaagaggcaggattcaaaaaaacagaagttttttctgacttaaattttgaaaaacctaaacaaaacagtgaaagaatcttttttgttctgcggaaatagatagtggctataataaatttagatatggagtaacttttatattataaaagttcagactgttgataaagtatgaaggtgtttgataacattggacaatgctttaaatccactcgttcgaagagtaaacaatcatctttacgtctcaagtagagcatatagtgttttataatcacattctttacttcagttatttttcaggcagcttcctcatctgagtcagctgcctttgtttgtatacttttctcaaaatcactttttctatatgctgacattctaaactatattaatttgaaatgtgtgagggaatattagagcattaggattttttcttatcttctaggttggataatcttagttttatatattagaatttaaaatatagtttttataatatgacgcgcggttgtcatatttaatatgataatatataaaaaaggatggtgtttatagtggcttttgattttaaaaaagaatataaagaattttatatgccgaaagataagcctgaaattgtgacagttccgtctgctaattatatagctgtccgcggaaagggcaatcccaacgatgaaggaggagaatataagaaggctgttggtattctgtacgctgtggcttatacaataaagatgagttataagggaacttataaaatcgacggtttttttgaatatgttgtacctccgcttgaaggtttttggtggcaggaaaatgttgaaggcattgattattcggataagagcagttttaactggattagtgtaatcagattgccggattttgtaaagaaggaggattttgattgggctgttcaggaagcgtcgcgaaaaaagaagcttgactgctcggctgcagaatatttgactataaatgagggcttatgcgtccaaattatgcacattggcgaatatgacaatgaacctgcttccgttgctgtaatggatgaatatatttctgcgaaaggttatgaaaataatttcaatgacagccgtcttcaccatgaaatatatctttctgacccaaggaaaaccgagccggcaagatggaaaacggtgattagacatccaataaagattaaatgaatttaagatactgaaataagatatttagtttataaacaagtaatgtggtttatgcaaaagacagtaacaggttaatttaagatatttcatatttgattgataagttttttaatattagcgtgttttgataacaaatttaatactactgaaaaaggcatatattcgctttagaatatatgctttttctgaaataatgtaagaaaaataaattgaatttatatgaatttataacctataatttacttatttaccgtcggcttttaaggttccacaccatataattaattcttaaatatttttaaatatgtataatctgttatataggaaatgtggactattactccgcttctttattagcggttttaatgttcttaatcgcatacataagtcttacatattgggttatttgaataactttactgcataggaaatgctgaattggatactatttatgtgtcttgaatcattcgttttatcttttacgtctactgttatatttttgtgtaatatctcagtgtatattctttattttccacgactttaatatatttatgtcagatacgattattagattcttcaacttttacaattgtttgtatgtaaatatttgctgagataattctgtaatttattttccataattatttattgaaattatttctttacaaataatttcaagagtattttttatctaaatattcttgtacctaaaagatttaataagaattataatgctgttcctttcttaggcacaaaaaagtttgatatatctgccttttcaagagaaagcagttttatctttttatcaataccgcctgcatatcctgtcaggcttccgtttgagccaactactctgtgacatggcacaataatagaaatcggattatgacctaccgctccgccgaccgcttgggcagacattttagaaagacctttttgtttggctattatatcagagatttctccataagtcatagtgtgtccgtaaggaatagtttttaaaatttcccaaaccattttccgaaatggcgttgttttaaataataacggaggtgtaaaatccggttttttgccttgaaaataattatcaagccatctctttgtttcattgaaaactgataagtctttttcttcatatttttcaggtaaagtatctccgaaattcttttgtccataaaaccataacccggttaaggcttcaccgttgctcgccagcataattccgcccagcggtgactgatatttaaaggtatatgtcattttattaaacctccgataaaatattaaatcagcagatactttattatttgcaaatgtgtatgtatcaaatattaaataaattttgatatggtacttgattttataaaaatattttgtacccaacaaaatttaatttaaacgtgtttagcatattatattatgtaagaattatttatatataattatgtatacaatgttagtgatttgtcaaatttgattttatagactaaatttgattatactaattgtaatgtcaatatttttttatgtaatcgaacttaatttataaactgctcattattttcagtcgacaaattgatagaaaccaatccgtgtggcagcatagtatcacaatctataaaaactgcactgtttatttcttcatcttcatttaaatagatagaatttataagtcctttatatccgcctaaaaatagtaaatttttacttttatctaattcatttttaattaaaatacttagattatcttttacttttttaatatcattgaccctatctattttttcttttttattatttataattctatttaagtaattaatcattctttctattttttcttttgttacgaaattggcattttctaataaatattcgactgtttccatgctatctgtatatagcttgccggttaatgttcctttatcttgatttcctttgaccatttcaacgcctacgttatcaaagaatggtttcaaaaccgtttttttattggggtcatttatatattgtattttatataaattacgcaatactatcatatcattgttgattttaatatcgtcaaccattaattttatatctttatttgttctctttgcatttggatttgttagtgcgcctttaactgatgtgccaggtatatagtactctgctttttcaggagaatatgaatcatatattccatatcgataaaatggatatattatttttaatttatcataattcaaacatttattattaatatctttaatacatttttcttctatactattatctaagtctctatagaacgctctatcactgcgcggagaaattataaggcttgattttatagtgattttatactcaacttcaatcatttttaacacctccaacttcaggcataggatataaaaacgcattaccaaaaacaatgcttttgctgtcaaatggagattctatagatttaacagcgtcacgacagttatttggaattgaaattacgctgccctctttaataaagcttatgtatcgtctctcaaaatcgctgttccagccgcctgatatttcatacggtcttcgctcagaagtaaataattgtaatgttgatttaacaaaattaatattgtcaggcagcagcatacctgtatttaaaaacatattttctgaattattgattatattgtaatctataattttattaagctgaaaaatatttaatccttgtgatgctcttttacctaatataatattttgttttaaatttacggcattgataatcattttaaaaaattcactgcactcaacactatcatctatttgaagaaaaaagttaaattcagtaataacactgcctggagaattcactgtatcaatttttaccggtgtaatataaggtacagaatataggttgctgtccagggcggctgtgtccaatttaacgctttctatagaggcgcgcagctgttgtctttcaactattttaacatatggataaagttctttattgcataatggattttttaaaattttattgagattatctttctgtaaataatgtcttttctttatatcttttcttactttttttatatccagtttttcattattatcagtattatgtaatttatctacaagatagtctactggggtgggcaggtaatcattaggcagaagattagacagcgccaaaaatatttttttgtctaaaatatctttaacaaatttgttcgctttctctgtaccatattcatctgaaaacatgtaaaccaatgctccgaatatcttttgagaatcgggcatctgagttatcccaccgatagatgtaagtaaaatcttatatgttttcaaagttaagacacctcacaatcatctatagtaacctcaatacgtccatagccgcggcttttggagttccccagacggtatactccgttattaaactgtattaattttttaatgatataattccggcatatattcacagcattttcacccaaaaggtcaaatttataaaagagtatttctccttcaaaaacaagaccgcttcttgccgctttatatgttctgggattagacaatatagtatcgccgctgctttctattgatgtttttgtgtcaatagaaaaacattcagatatattttcaggtacatccttaagatgtaaatcatttattattaacttaggcgaattgttaaatccttctattccaaacagaaattccgccttagcgtcaatattgtaacgttcttcaattctgcgtatcgtttccgcatcataattatttttagaatttttccagttattattcatttcattttctatatatgtttcatataattttgctatctttatggcgtcttgtgttttatcatcatgaaccattccccgaagagtgccttttagacttgaagccggaatatatggcaaaccttcatatgtagtggctgtatattggtcaaccccgccgatttcgaaaggaggaggtgcgcttcctatcattaagtttgattttgtttttattaaaatttttattttttctttcatttttcttcctccttgaatataccattgagttttatattcatttcattatactggtacagcagcattaatgaatcaataaaagttgaattccagctgtttttggctgcttttttaaatttatcttcatcaaaacacatatgactagatgtattttttttattttctttagtaacatttgaatctttattttgacacacctgattttttaacttaatcaattcagcagctttttcaatagaaactttatctgtatctctcaatttaaagaacatagatttttctatatttaaacgtttaaaatatatatcacttgaattattgttttttgggtcatctttattgataaatatattgagtagattactatcatagttatacagcttttcgtataaataatttatagtttctttcaataaaaatttatgagcattttctatttgacttttttcagaatcttcagatgaatgttctatactatttaaattataacgggggtctgttagcaaaattaaaagttgaatataagtttccaaacgatgttttgagttgtcatttaatactattgtatctttatatatctttttatttgcctttttatatttctttttaattttctttttgtcttcatctttatttaatacaacatatagctgctttatgattctgcttttaaataataattctttatttcttatatttgaattgtcaaggtgttttaatcttaggctgtacagcaaaatgttaatatattctaattctttctcaagtgaaattttatcattgttttcactaacatctttatcacaaattttaatacttgagagtttttccagcagtgagtataaaaaacttgtactgcaaatctgctccctcatctccttatcggaattaagtgactgaaaatcttttatatcatttttaaaggatctccaaattggattactgtttaaatccttgttgatagcttcaattttattattaatttcatcatagtccacatcaaagaaagtttggttgttaatagcaattgttgtttgtaaaaattcttgtaatgtttcggggcacacagcatttttagctttatccaattgatcatttaccgcttcaagataatatcgtataggttccctgttaaacgtaatggatacgccaatacccattgatagctttttaatatcacttttattttttatctttgttttattatcttcattttttttaataagagcattattaatggtaataaccatttgtctgcatacgtctattcccttaaaaaggtttgttactgaaacagcgaaaaagatatcgtcacctgccacataaaatggatatatccaagcggcatcattatcctgacatgtattttttgctgcgtcgagaagtccaactaaagaaatattttcttttaaaatatcactaactcttttatattcttcataatcgtttatgcttgcaaacatatttcccatcccatttaaatctgcttttatgacagcaatagggaagtggttagcttcgtatggattttttgtattattttcttcataaggataaagttcattaataccttgaacaaataattcatatttatcttttgaatcagatgaattatctgtttttttggccttttgaaaagaaaataatatatctttattactttcaattattttacttgtacattcggagattttaagttttgatttagccttttgaacatttaatatattatttttattttcatcattataatgattctctgctataaaatatgtatattttaaaaacttttgaccttgagactcactataatagttttgaaatagttgatttagatgtttaataatttcatcttcagtgataccgctgcatttaaaaataactacgccggaacattttaataatatctctttagagatttttttaaaggctttatcaacatcttcaaagaacccattagatatttttttggatgcactttttatttgtcttaatgtaccggtttctttttgcttttcttgttcatgcgaatgaatgacctcgaaaagcaaagtctgcactttatctattgagagcgctataatatactcattaaatttattaaacattttagcatatgctatatgcggaaatagtataggattatttatcatcataagaatctgatttaactgaagattaaatgttagcaaagaaactaatttagtttgttttttaattttatctttataaccgactttataatcttctaattcaacatctttaattttatcaatgttatatgtttttttatcaatttctgctagtcctttagaatgatttaatgattcataccaagaatataaattgcctttactttcatctatctctatatttaaacattcttttttttcattagccctgataacaatatcaaatttatttttacaatattctttataatcatcatttaaacagcacaaaatccgtattggtctggtagatgtttgtgttcgtggtttagtgggattatgctcagagcctatattaactccgttaaacattctaacataagatctctgagaggtttcaagagatttaatactttctacccaattttcaagattctctttagttaatgatgaacttttgcattcgattacaactgctaccgcttcaatcggtataaattttaatttgtcatatttaaaaatatatggtgtatatgtctcatcaaagatagctaaatcaacctcttttgatatatttcctcctgaatctattataaacacagattgttcgataacgaactttttaggtattatttgttcaaacatccctttccaaatctcttctctaaaattgccaatggttgtgccgtgaggagttttaaaaaatagttgattgaccaaagtcttttcgctttgaatataattttcaataatagcttttatagctttgtttttaatttctttatcttcacttttttctttactttctgtaggaatttcgctcatactaaaacactccttttatattttaaataaactcaacatctatgcgccccatgccaaatgtggtgtttccgccaatatgtaatatttgcgcggcatacagccagggaacaaataaagataaatctccatgaaaagacatacttcccattaatcctccaaaatccattttttcatttgttctgtttgaatatcgctccatattaaccaattctatatctttttttgttgtgataatctttgacgacaatttctgaatatgctctatcttttctgtatcaacccatccgccgtaacgtccggtaagagatttaatcctatatgttatatttctaataatcgaggaaaagtcaacgtctttaagcaattcattgttacgccgcattcgcagaggagttagaaacttaattgtcacactttctacattatccaatgttttatagactaaaggtatttttcgcattgccgcttgataaaatgttctattctgccaaatgactctttggtctgttttatgaacagccttatcaaatatgaatttatttctccgcactccgagacgcagaccgccttgactgtttaatgcgtcaataacatttttagcatatttggcgccgtcacctaaaaacattatatcaaaattaagaatatcatttttatagaataattttttaccaatcatcggtggaacaataatataaggatttaaaacttcttttcttttcttatccaaacgacggttgtcatataaataatgacaagcttcagtgtcgtttctaagaacgtgtccaattgcaccgcgaagcgtggagccgaggtatggcggcaatattgatttatcttgagctataattgagaagttgataggtaaatattctaaataaaattctgtattttcgatcataacacattgcttacctttcctttatagaaaatagacaaaaaatgttttattttgtattattttatcatatatttaaaagtaatacaagtgtaaataatatatttttgaaaattattatatttgcacataaaaaataataaataaaataataactgataaaaatattttattatttatgtattaaactttgattaataggaaaaatataagagaaatttaattatgtatgaatacaatataggcatctgtaacttttttattaaattgttaagactaaaaatgtataaattttttaattatagagttaagtttaaagctctttatagcaatcaactgaataaaaattaaatatatacatttttaaaatttaaaattaaaaaatatgtcgaaaaagataacataaaaaatttaaaaaattttaaaaaatgtaggtttgtcaatgatgtgttacaaaaaagattaaaagagttcaccgaaattgataaaagagttgatgtagtcaattggagctttccaattattattcacggtagttcaaaaagtcaacgggaaagtaacaaggctttttcatcttgaagcgcagattcaagatgaaattagcgggggcgagcgccctttggagccgcaggcgacctaagcgagcaagcactttttctttggtgaagcgtttctttttcttgcgagaaaaagaaatggttcaaacacctattaatatcctcataggacaaaactccatcttgataagcatgaattgcgctattaatatttattctttcctgtccaacaacttgaccttgatttgaacagtaatcctgtataggatcttgatcctcaacatttaccagcccgcttggatcaacaaagtttacgggattattaccacagtacgcataccagttcagtccgtccattaccgggtcttcctgtgtgaatcttccattcgcattatacatatatcctgcgcttactgttccgtaatctacttctgtaagtctgtccaatatgtcatatgtatatgaccctgtcagtattgtatttgttcctgctttttgtgtataatttttcctgtttccgtttacgtcataagaatagctgctgtgctcctcaaaagcttctaaataccggaaacgtgaatattcgtcaatagctgtatactgatagaactttttaccattagcttcaccgacaatgcaagcttcaggaacaaacttaacgtctatctgtactctctgaccgggatagagcatttgctcgtaaggctttggtaagaatagctgctgtgctcctcaaaagcttctaaataccggaaacgtgaatattcgtcaatagctgtatactgatagaactttttaccattagctttaccgacaatgcaagcttcaggaacaaacttaacgtctatctgtactctctgaccgggatagagcatttgctcgtaaggctttggtatgtatttggaatacggaaaactcataaattgtgttatagttatatcaccataatatcacatacacaaaggagccttccgtatatgaacactataacacaaactaggagatttaggcaagtattaattgaatattcttttaaacacggcgtgacaaaggctgccattcgctataaggtaaatcgtcagtatgtctatcgctctttttgaggccggaatagaagcaaaagacgctcaagaattaatgggacacaaagacataaaattaactcaagatatctacacgcacattagacaagaacgaaaatccgaaacagcggaaaagttaaattcattcagtttttaaagtcaattatcagtcgatattcttaaatatacgtatatagcgttgtttgttccaggttcaaatcctgtcacctcgaccatccaatatgtcatatgtatatgaccctgtcagtattgtatttgttcctgctttttgtgtataatttttcctgtttccgtttacgtcataactatatacattctgaatattcccttggctttctgttttcatatagccatagtcgtcataggtatattttatctcttcctttccttgtttggttgatataagaagattattcttgctgtatgtattgattatatcttcatctcctgtcaccttgctcgtcagaacgcttccatacgcattatacgtatttactgtttcatttccatttttgtccgtttgtttggtcggcagtccttaaaggtgcataaccgtaactacaataaattcccgatgcgtccgcttaattggaaagctccaattgactacatcaactcttttatcaatttcggtgaactcttttaatcttttttgtaacacatcattgacaaacctacaatggggtcatatacatagtagatatatattatttttaataaacaaaatattatatatcaaatttatatattgaacactgcgtgttcagatgatagttcacctaacgtggcgcataaatgcgccctgctgaagttcactgaaaaacccacttttttagttaattaaatcaatattaactcggaatatctttattcacggtagttcacaaagtcaacgggaaagttacaaggctttttcttttgtgcgtggagcgcaaaagaaattagcgggggcgagcgccccttggagccgataggcgacctaagcgagcagcactttttcttttatttgagtattcataataatgacattgtaggttatttaaaacaagtaactttttattacacacacctttcaggtgtggtcacatgtaggtttattaatacaaagtgatttgtatcacacacactttaaaaaagtgtggtcacagccctccgaagcttgctaaatcacattttttataataaatttttagaaattaatatcttcaaaacagtattttttggttaacatcggtagggtgtgcgtaagcacaccgcgttaggtgagcaaccatctcacacgaagcgtgactcttgcgagtttcttaccttgtgcaattgtcgtaataagtacatctaaatgtatctttattaccgctttttcactatttatttttcaaacatccgcttagctctcaaacaaatctctttgtcagaaaacttcatcgctgcaccgcagcaactttattagtataccatgtttgtttttacttgtcaagactgacggtacattctgaaccggaggcgctgcgggcgcctgagcagccggagccgctgtagccggacttattgttggagcttcagtagcgacaacggtacattctgaaccggaggcgctgcgggcgcctgagcagccggagccgctgtagccggacttattgttggagcttcagtagcgacaacggaagtctgaacgcactcaatagggaatttaaaggcttttacaaggtgttcgaggaataccgcagaagaatagctgctgtgctcctcaaaagcttctaaataccggaaacgtgaatattcgtcaatagctgtatactgatagaactttttaccattagcttccgccgtctttggttccgtactctgttctgtatgtataaccttttccttcgcttttggctttcggtgttttggtgttcagcttgtttcccatataatcgtatgtatattccgtctcgcttatgtccgttccctctcctgttgtttctttgacagtgtttccatacttgtctgtgtatactgcgcttactgtctttccggctccgcttccttttattgtctcggccttggacaggtctccgtctacatcgtcatatacatagttctcctcatatgtcaagctgcccgctgcgtcttttacttccattttcgtcttgcggttcttcttgtcatactgatagttatagctgtttccgtttccgtctattattttgcttattcttcctacagtatcatactcataagcggtctgtgtttggtttgtttcacagttgaacacggttgttatctttcccaagccgtcatatatatactttgttttgtttcctcttccgtcttttgttattacagaattctccaatatctgtccggctgatgaggctttcggatattcaaccgttactgttgttccgtcaggattccttgtggatatctgtctgcccaaattgtcatattccgcatatgtcacatttccccgccgtctttggttccgtactctgttctgtatgtataaccttttccttcgcttttggctttcggtgttttggtgttcagcttgtttcccatatagtcgtatgtatattctgtctcgcttatgtccgttccctctcctgttgtttctttgacagtgtttccatacttgtctgtgtatgctgcgcttactgtcttcccggctccgcttccttttatcgtttccgccttggacaggtctccgtctacatcatcatatacatagctctcttcatatgccaagcttcccgctgcgtcttttacttccattttcgtcttgcggctcttcttgtcatactgatagttatagctgtttccgtttccgtctattattttgcttattcttcctaccgtatcatactcataggccgtctgtgtttggtttgtttcacaattgaacacagttgttatctttcccaaaccgtcatatatatactttgttttgtttcctcttccgtcctttgttattacggaattctccaatatctgtccggatgatgaagctttcggatattcaaccgttactgttgttccgtcaggattccttgtggatatctgtctgcccaaattgtcatattccgcatatgtcacatttccaaatatcataactatatcgtatatatattgtacttaataaaaatatcataactatatcgtatatatattgtacttaataaaaatatcataactatgtcgtatatatattgtacttaataaaaatatcataactatatcgtatatataatgtaaatagttgttagcattgaaatactttttaaattattatatttactataagtatcttaacataaaaagaaataaaagattacatttataaatgtaactttttatttttatagtgataatatgaaaatgttgtaaataccgaattataaatattttaaattgataatggggtttagccaataatttaatgagacaaagttaatggcagaggttctcccaatattaaggacaactattttaaagtcacttttaacttaaattatgaagatgttgtgctggctccgaactcgcagtaagtaaaatggcgaatatgtgctggaatctgatacgcctgatgggttttcattaatatgctggtttgaggagttcaattttactgacaagtttgattttctccagaaaccgttaattcaagttttctatttatgccggttgttttaatgatagggatattcagctatagatgttaattataaaaaaataatttaattacaaatttcaaaatctcgccacaggaggatataaatgatttttaaattcaaacgttttattttgtgtttatttgttttgatagtttcattgttttgtgtttatccgacttatgcaagcgtaagcggtgatgctgtaaaaattaatggtgagacatataggattacatctagtaaaaatataaatgtatatatagaaagaagcaagataaattttgatgttgaaccaataattattgagaacagaacaatggtgcctctgcgctttttagcgaatgccatagggattagagataataaaattatttatgatgagaccgagcaaagcgtgatattagagtataatggcaaaacaataaaattgattgtcggagataaaaatgccttaattgatattgatgaagttgaacttgatgttccggccgttgaacttaacaacagagtattagttccccttcgttttgtctgtgagacgttcggatataatgttgattatggcgagacagaaaccagtatgaacatttttatgaaaaaaagaaacagccccactaatttgtaaaaatactaaaagcgccttgaaaccgattcaccggtttcaagggcgttttttatttaaaccggcatttgttttaatcattatatccattaaaaattattataccggaaataagtcttgactttataattattatatcataatatagacaatgcgtataattttatataattacatatgggggtaaatatggtagttggttttgctttattgtttgctgccggaatttttcagggaagctttggtttggggtataaaaattacaaaccgttttcttgggcggcattttgggggatatattgtctgctgtgtatggtgacagtaataggagttgcatggattcaggtgccgtctttgccggagtttataaaatattataaaatactgcctgtattttgcggtatgctgtggggaatttcagctgttggattttctaaagctattgataaaatcggaatgtctatggtatatggaatatctatggggatttcaacaatcgttgggtctgttatgccgatgatattaaattctgcactccctgttggaagcgatgcggttaaactgtatatcggccttattttgactgttatcggagtaattattattactgttgcaggtgtaaagcgggacggaggggcaaaaggatctgccttaggatacctgctttccattctttccggcttaggttccggagcgatgaatatagggtttaacggatctgaggttttgggatatgagttaatggctttagattattcccagttagctatttcagcggtgaaatggctgcctgtgcttgtcggcggatgtattatggggatgatttggtgtatctgtgaattatttataagaaaggaatggtataccgttaaactaaaaggctccgccgttaggtcggcaaaattgtttattgtgagtatgatatggtatgcagcattgttattatatgggctttctataataattttgggagaaaaatacagctctgttggatggattctgtttaacgctttagcattaataatttctactgcctgggggctgaaaaccggggaatggagaaatcactccaagaagctgctgtttataggatgcgctgttttaattgcggcgtggatgtttatataaaagtcaatttataataatttacgatttgataattgtttgtttaatcacaggcaattatcaattttatatataattgcgggcagtataataccgagcggattaaaacatcaaagaatatagctgtatgttattgtttatattaatttaaatatttaaatatatccggtttctttatcaatgtgacatatgtgcaggattttaatacatatgttttattatattatatggtcagtatataaacatataatattttaaaacagccgaaatacttttaaagtttaattatagttttttattttattttttcaaatgtgatatttatcattgtcttccagtctattcgtgtgttataataatattattgcatagatattttaattttatagtattaatatgaaataaatatgttgttggggcaaaattttatatatattaagttataaaataagacatgaggtgtattatgattaatgaaataaatgaactgtctttatcccaaaacggtagtttaagcgcaaaagatttacgattatttttactaaaaaattttcataataagaaatacattttatcatgcgattcgagaaagagtgtgtttgaaaatgatattgaatacattattaaactgatagaagataatacatatatgattagggatatgataaattctgttataaaatatgaagaactgaaacctgaaagcctggatattctacacaaggtcaatgcatcaatgggaactacttatctcaggctgagaaacctatgcgagctgctgatgagtaaaaatgaggctgctctttataaaaaaactaaggtaagcctggtaaaatatatgaatgagtttataaacaccgttcataataatctgcctgtaactgtgagcaagaatattcatcttagaaataatatgaggagcgaggcgctagtaagcgttgatataacgcggcttacacatatacttgttaatttgctggtaaattcaatagttcacagtcactcagaaaacggtcgggtggatattatcgtaaataatttctcaaatgaaaataccgttgctgtttctgtagtggattacggtattggagttgatatagaaaaaatcaaatcatttttaaaccgtgacaatataagtattttcggaaagaataacggattgctcagatcttataaaggttatggcttaatagtgtgtcaaaaacttgccagcagtatgaacggtaaaatattggtatcaaacataaaggaaggcggttcggtatttagtttaattctcaaaactgatataggtgaggacaaagatggagttgttcctcttcgagatgttctgagctatggaaaagatttagtggatacaagcttgattgcgttatcattatttggtgcctttaaaaatgaaactgtttatctgtcataaaaaaactgcggcaagacgatttatatagataaagatataagaaaattagttattaatacaaacgcttgaatttcggtattattcagccgatttcaggcgttttttcttaaaatattatttttatatttttcaactcagtttttttatttaataattttaaaatacctcttgacaaattatactatgcgtgatatagtatcaggtgaaaggaggtatttcaggtggatgtacaattaaagcgcggaatattagagatttgtgtgttagcgtctgtcaaaggtgaagattcatatggatacagaattataaaggatatacagccatatatggagatttctgaatctactttgtatccaatacttaagcgccttgaaagttcgggatgtcttactcattattcggttgagcataacggaagactgagaaagtattaccaaataactaaagaggggattgagcgtattaatgtatttatatatgaatggccaaatgtgacgagagcgtatgattttataaaggaggcggttaaaaatgatgaataaggatgagtttttaaatgatttgcgtcatgctttaaaggggttgccttatgaagaggtaaataagactttggattattattcggaactgattgatgacgctgttgaggacggcgccgacgagaaaacatttatcgcaggtcttgaggacgcggatacaatagcaggacggattactgacgagacgtcaatacgaaagcttgtagcccgggaggttaaggggaagcggtttagtgttcctgcgattatattgattattgtcgggtctccgatatggctttcaatcttgatagcggttgccgcgtcattactggcgctgtatgtatctgtttggtctgttgttgtatcattgttcgccgcagacgttgcgtttgctgcttcagctgttttagccgttattgctatgccttttgtgtttgccgagagtatagcaaaagctttgttttttcttggtacggcaattgcttgtgcaggtttagcgatacttggattttttgcctgtgtatggtgcgctaaaaaactaatacagttcacaatgtttatagtcagaaaaatcaagtataaatttatacgcaaggaggctgagagaatatgaagaagttaatcattacagcgtgtattttatttgtttcgggaataattattgccggcgcgtctattgcgggcggggcttttgaaccggttgacctgaaggcgcaaagcgtagagtttaacgcttcggatataactgctatggatattgattccgcccttgacagagtagaaatatcaggatacagcggtgaaaaggttagagttacttatagtgaagacttaaagcgaagctgcagtgtttcagttgaaaacggagttttgaaagttgactataaatatggttcaaagtggtatgataaccttttcagtattaatatcgcaacatatgttgtaaatatagaggttccgcaggggcagattcagaactttgatattgacgccggtaacagcgatgtaagtttggaaagtttaaacggaagtttaaagtatattggcaaaagcggcagagtaagtatggaggactgcgctttttcggatttcaaactggaaattgacagcggagatatcagtatcttaaattctacagccggtcagagcgggagcagtgctgttattacaagcggatatgggaacatatatattgataattcagtctttccaaatactcaaatcaaaaacacttatggaaatttgaagcttacagaagatagctttgaaaatctttctgttgacgctaaaagtggaaatataaggtttagcagtattaaagtttctgatacaattgaaagcaaacgcgcgtacggaaactttataatggaggacgtttcatgcagagctttaatagacgcaagcgataacggcgatgttaaatttgataatttgacctcagattatattgaccttaaatctaaaaatggaaatataagaggaaatataaatggtgctcagacggagtatataataacatccaacagcaaatacggcaataataatttgggcagcgctgtgaacagcggagataagagacttaacgccgaaactgacagcggaaatattattatagagtttgaaaaataaaccgttttatttagccggttcaaaaatatcagggtgaataaaatggcagccgctttgttaggacagaaaaaatgaaaggtttttaattttctaataaatgaatagaaaaaaataagacttcattataatgaacttacccccaaaaaggtagaccaaaaatataacaatttaaggtcagttcatattgtttgaagtcttatttttatttaatatcataattaatttgagacatttaatagattggctaacaaatttgtttagtaaatacctgttattatcttattattctaatttggtatttgtgtttgcagttttaaagattttttgccggtatgtattataaagtatccatatgctgctgttaaaattcctgcaattatatagcttattgtccaggaaaggttaaacccaatctgagcgttaagaataaagcttgtgataataaacgcgtagaacattccgggaataattgcgagaatatatggctttttgttctgtataaaataaatggcaatcatagcgaatgcaaatattgctattgtttgatttgcccaagcaaaataccgccaaagtatattgaatccgtcagcattcagttttgagaataaaagcagtgccgccacaagcacaaaaattgccagtgataccatcaatctgtttcttttttttgactggtcaatatgcagggcgtctgaaaccattagtcttaaagagcgaagcgcggtgtcacctgatgttataggaaggacaataacgcctattatcgcaatcattccgcctattctgccaagaaggctgttggcaactataccaacaacgttagtcgccggggtgtcagcgttggcaagtccaagattcataactcccattgcagccgcagcccaggtcatagcaataaaaccttcagcaatcatcatattgtaaaaagtcattctgccctctttttcattgcctattgtccttgagataagggtggcttgtgtggaatgaaatccagatactatgccgcaggctacggttacaaaaaagattggaataaaatgcagacctttgggatgtatgccgacaactccagttgaccagatttcattcagcggatagcctttaataaaaagtcccgcaaatacgcctaaagcggacaaaatcagtacagccccaaagatagggtaaactctgcctattattttgtctataggaaacagggttgcaattatgtaataaacaaatattgcaccgtaaacaatccaaataactggatttgaaaatccactgttacctttcaaaatttcggttacaaataagtcgccaggagtatagataaaaacagctccgaccaaaagcattagcatacagacaaatatgttatatacaacataaatatgcttacctaaaaattgctgaataagtgacggcatttgttttccgtcattccttacggaaatcattccgctcatatagtcatgaaacgctccccctattacacaaccgataggtatagtgatgaatgcaataggaccaaataaaattccttgaatcggacctaatataggaccggttccggcaatatttaagagttgtatcaagctgtttttccactttttcataggaacaaaatctactccgtcattcaacattactgccggagttgttctatcatcaggtttaaatattttctcgcagacctttccgtaaacagctccgccggcaataagaataattaatccggctataaaagtaatcatagtcatacctgcctttttataatatatttaaaagtttaataattttagatttattgtaattcgctttgtatcaaatttatataggccgaaagttcgtcaaagaaccgttaatataagcgttaaaatatgaaaaattcaattactgagcgtcgaaatacgtttgaatgaatactataaaataagttaaataaacatggatttaaagctttacttcatcagacaaaaattaatacctaattattatataaaatttgtcttataatgtcaattgctttatagtcaaatgtctgcttgaattttaatataaaataatgtattataatatgatatgatagtaaatcataaaaagaaggatttttgtatctaaatattattgggaaacggataagtgttattatgattaaagtatttttattgggtgattcgatagttaccgcatatggtaaagacagtgaaaattttatagggggctggggcgaccatttaggaagtttttttgatgataaatttgtttcggttatttcatgcgcggaaggcggtaaaagctccagaagttttttaaatgacggcagatttatagataatggactctttactaaagaaatgtttcctcaaggggtaggcccgtgttatgaactaataagagaaggagattttgtatttattcaattttgccataatgatgatgattctgccagacatgaaaaaagagaactaagacacacgccgctcggaacgcctgattctaatggaatttatcccacagttttgccaattggaaacacgccttattcttttgagtgcggagcgacttataagggctatttaaaattttatattgataaaataagaaagcgcggtgcagcgcctgttttgctcacacctcctccaagaggtgtttttaaagatggaaaaatcgcttcagttcccggtaatcacggagggacagacgaattcggagaatatgcctatatcagagcaattcgtcaggttggcgaaacggaagacgtcactgtgctggagttgtttgaaaggtcaaaaaactatattaacagtattggggaagagaatttcaaatacttgcagtcattaaaagacggttcaggaaacaccataggcgaatcaagatacggcaggcctaaagcctggcctcaggactataatgaaataatgcagtcaggagaattcggagagattgacaatacgcatcaaaacagatttggttcttttgtttatgcgggttttattgcagaagagataagagaaaagataccaactctggcaaagtttttgttagaagagccaagcaaaaatgttccgccgccggcagactttagattataaaaataaattaaatttgctgagtttatataatctgatacgttataattttcatatataactttggaactcatataaacggttcatatattaaaaaataaatttgcagtgattataagcatagccaaaactaaaatatgtattaagaattaagttaaaatatatacaaagtctttactggacacacaataaaaatggaaagactacaataaagcggtcagaagtgttagggccatctagcataaaatttttatatttatttttattatatacctcaacttttctatgcactttattgtttcattttcaattatttccgtatatacagtgtttataacaaacttaaccgcatataaatccggcagccatgttgaactgtttgtaaatgttaaagatccttctgtcaaatcctgcggcagtgtaaatgttattgcgctcagccatagttccctggcgcttccgtcctccgttattacaacaggagtctgagttcttgtctctgacaccactgttcccgaaccgcttgctagattcattgttattcccctgttgttgcttcccaggtaatacattgtatatgttccggctgacaagtttactccgctcacatacgggtccccttttgtgctgcttgaacccgagtttccaataaagtccttataaaccttaacgtactcattatcaattgttgtcccgtcagaactgaacaacgtttgtatgcctgtgcctgcataagaggatttcagcgtaaacgttccgctctgctcgttttgtcttccattgacaaagtcctctgcaatatatgtcacctcaccggttacaggagccggttccggcgttgggattaccgcctgtttaacgaatgctgtatacataaccactcctgacggcggtccgtttgttcccagagttaccttatcgccttggttaaagtttttctgatatattttataggtcacatcatttgacgcctgcagtatatagtcgttagctgtccatccactcagccatgacggcagattcgacactcgggtatccaaccctacatacactgtgattgcacttccagcagtgaactcggctacatcagactgaagattctttgaatcgcacgctattcttatccattcagcgcctttgagataattagatacattggtaaaagtattggctctgtcgccgtagattacatcgcctgtctgcagattgtactggattgaccagtccgcagcgttggcagcgtcttttattgtcaatgacttaatcaaatttccattaagaattggcgccgcagttggctttggcgttgccgtcggcgtcagttcgggcgacaatgtaacggttcctttcgggaacgaatcaattgttaaatcatggctgtaatactcaatattgttatatcctttcccctgataatcacctgttgcatcgctggcgctgttaggattaagaccgcgggcaatctcccagctgtcgggcataccgtcgttatcagaatcaacgatctgttttgatgacgacgatggataataagaattataatccatatgtttaatgccatatttagttatagcgtccaaaacagcactgtctgtcactgttgaaaaatcacgtccgcctgtaagtgatccggtgcctgttcttgtctcttcaataacctgcttgtcaatcttaggacgtgacgccgcatttattcccgaacctgcataagcaagcacatttgaataagccgcgtcagcgctttcgggattttgggcaactgatacgttaaccccatttacattaatcggataatgggaattagaacgatagtatgcttcgtcatatccggcgcttccaaaattgaatccgctccagttattgtttgtttgtttactcataactgaattatccggattaaccattttattgcctgttaagtaaaacttataattctcaggcgcggtcccgcttgaaatgttaataaagttatacccgccctttgtggatgggccggcttttaagtaattgtttacatagttctcatgtccgaatgttccatacgcggtctgactgccccagtcatagattacgttattaacaaaatccattgcataagttccgacaaccttgcctctgaagtttcttgacaagctatgacaaatcaagttatgatgccaggaattttcaccctttccaaacataaccccaaatccatgagcgcccttggaatgatatgatacacagtcagaaggcccgataatggtatactgaaccgtttggttcatattattggaatacaatccaaactgctcgtcatttgcccagcctatcgaacagtggtcaataatagaattagagccatttgaaccgccccaggcatcataatcaccgctgcctttttcaccaggtctagatgaaatatagcgaacgataatattatctccgcccataccaatcttgccgtttttcagggttatgcctgctcctccgggagcagtttgtcccaaaatagtgacgttgccttttacaacaacatcgctcttaagcgttattgttccgccaacgtcaaatacaacgattctgtttgatgtaccgacagcatccctaaaagagcctgagccgctgtcatttaaatttgttacatgaaccacctgtccgccacgaccgccggttgcatacataccgcctccctctgcaccagggaaagccggaagagtattagccgcgctaacctcgcttgtatcaaatactgttattaaagagactaacataaacgccgatattaccatacacacaatcttttttaacattattgttttctcctttaactttatattttatttaataccacaaacacaacttataccacaaatacaataatactattttgtactcctcctttactattatattttttctgccctcctttctaattaataattttttattttgtttctttttctttgttaaaaattaaagatgtgcattcaaaataaacgcacagcccgactatgaataaattaggtaagaaacaaatttttgtttcaagttatcaataaaaaatttaaacagctatataataggaaaataaaataaaattatagagtactgactaaaatttttaatgcagccctagggggatagatatctatccccctaattgtttccgtttaacgattatatagactgtaaaaaactttttaacgtcttttatactatcttaaccgcatacaaatccggcagccatgttgatagatttgtaaatgttaatgtaccgtttgccaggtcctgcggcagcgtaaatgttatcttgctcagctgcagctccttctctgctcctgccggagtcaatgttacagggctttctattctctccgctgttgccaccactcctgaaccgtctgacaggctcattgttattcctctgttatacgccccaataaaatatactgtatgggttccggctgacaagtttattccgttcacatatgggtctcccaaagtatttgaagcatttggatttcctataaaattcttatatccttttacatattcattatcaatcgtcgttccatttgagcagaacatatactgaacctctgttccgataaaatcatcacttattgcaaacgttcccgcctgctcattctgtctgcctttcgaaaacatattattgacatcgtaggttattcaaaacaagtaactttttattacacacacctttcaggtgtggtcacaggtgaagcgtttctttttcttgcgagaaaaagaaatggttcaaacaccctattatgtaataataaatttttttatatggggtcatatacaaagttaattataataaatatcttctttatatattgaacactgcgtgttcagatgatagctcacctaacgcgcttgctaacgcaagcctaccgatgttcactgaaaaacccgcttttttagtgtaataattaaatggttcaaacactttattatgtaataataaaattttatatgggtcattacaaagtatagttttaaagagctataagctaagttataaaaaagagtattatgaacccaaagtcaaatgtaagtatacattgactgcaaatatattatatcatattgaataggcaattttattccatgaaaaggagtaaattaacaaatgtatgtcaaataaggaaatgttatagtttttatatgtcataaatagccttacgacaaaataaaaaacaaaaaagggagccatagcggctcccataaaaaattacttctttttatcatacaacccggcgcggtcattgattaccaataacctcatcaaatcctcagttagccccagcttgccttcctcatcaccttttaaaaatcccttatctaccagcttagttattgtaggaattgcccattcaggcatgttctcatcaatataatcataggtcgctagctgtgctttgatataatctatctctttggtgttgttcaaaatatcagcgccgattgcgtcaataactttatcctgactttcgtcctttttctttaactcttcatattcgctgctcaaaagttcgtcaccgctttctaatttatattctactccaaaatagttgcagatacctttataaattcccactgcacatttatattttccgtcgtcgctggctaaaaacctgttgtcgtcataattgtctataaatgcagtctctaccagtatcgccggcatgtttgtgtgttttataaccgcaaagttcgctgactttactcccctgttgcaaagccctgtctcttttgcaagctccggctgtacacagtcagctaatcttctgcccttagagctgccggtataatagtaagtctcgcacccatatgcttttgtgtttgctgagttgcaatggatagaaacaaatatatcagcgtcccagctgttggcggcgttgtatctgcctgcaagactggcgtttaggccctccgctaccgtgtcctttaagctgtttcggctcatcttaacttcaaaaccgtttctttcaagcaaaggttttaattttaatgctatttctacagtaacatcctgctctttgagcccgtaacctacggctcctgtgtcgtttccggttgggttgtgtcccgggtcaataaaaatttttgtcatattacttcacctccttcactcttgttctgctctttgagctgttttaaaacttcgtccgcttttacagcgtttggggtgaaactattgtttttccaccaagcccaaacagacgcgccaattgtgaataataggctgaccgtctgatagatatcattatcagcgatgctaaccgcctgcttgccgctcatggccaatatttggttcagcagcgctaccagcagaacaattgtgcgcgctaccgctccagctgttactttgctcattgtttcacctcctcgtttagttcatcaatccgtttgtgcgcagactttgtggactgctccactgctgtcatgcgttccaccaggtcgttgtgcttctctacttctttttcaagcaaacttatcctgtagcttgtgagcctgtttgctgtaagaactcctgttacagaaccaaacatagttccaaacagtgccaggcccgcaacaactatttcgggtgtgataaagctcattattttgctcctttacaaatgtattggcgaatacatttatagtatagcaaatatcgcctgccatgaagtgccatgtgttttcgcttgacaaagggcttccggtagagtagaattatcgtaaattgcaaataattctgtcataggatgtgattataatggaaaaaacaccaatggcaatgcgtaaacatgttgctattttcggcgatactaatgttggaaaatccacattgtttaataaacttttaggacaggaggcggctattgtttccgatgtcagcggaacaaccaccgaccctgtgaccaaggcgatggagcttatcccttacggacctatcgcgcttattgacacggcaggtttgggggacaagtcagttcttggagaacagagagaagccaaaaccctggaaattattaaacgtactgacctaatattatatgttcaagatgtcagttgtgagaacgttttaaatccacgcccgattgacaaaaatattccgactatatttgtttttacaaaatgcgacttggcaaatgctaagatgctgaacagtgccagcgctaaatatccggattcagtgctgatttttgactataacgagaagagcatggatagtttgagaaataagatggttgaggaactgacaaagcaggaaagggacgatgagacgcttatcggaaagcttctgcctaaggacagcagtcttgttttggtctgccctatagacagcgaggctcctaagggcaggctgatacagcctcaggttcagcttatcagggattgtcttgaccacaatatgaaagcatatgtaacaaatgagattacactggcggacgctcttgaagatttaaagcgtgtagatttggttgtcacagattcacaggcgtttaagacagttgataaaattgttcctaaagaaataaaactaacatcgttttctatgcttttggcgtatcagaaaggtaatttcaggcagcttttagacggcgcgtcagcgattgacaaacttagcgctgattcaaaggtgctggtgcttgagggctgtactcacaatacttcgcatgaggatataggaaaggttaagatacccgctctgataaagaattatctaggcggtgaaacgcccgaatatgagttttacaccgggtataacctgccgggaagtttttcggattatgaccttattatccagtgcggaatgtgtatggtaaacaaaaaggaagttgtcagccgattaaaagaggcggaggaagcaagcgtcccggtgaccaactatgggattgcgctggctaagctaaacggtattttggatagggcatgtgaaatttttgcagaggaagattaatgtgttatgaaatttacaaaaagcgaagctcttgagattataaaacagaataaagaagtcttatcggaggaactcagagaaaaatccctcgccgtgtgcagggagaatttcggtaactcggtatatgtcagagggcttatagagtttactaattattgcaggaacaactgcaagtattgcggcattagagccggcaacagaaatgttcaccgttataggctcacaagagaggaaattttggattgctgccgtgtcggcgcaggtttagggtttaagacatatgttcttcagggaggagaggacccaggattttcggataatgagctttgttcaattgtttcggaaatcaagacggagtttcctgaatcggcggttactctatcagttggcgagcgttcgaaagatgtatatagggagttttttaaggccggggcggacaggtttttactgaggcatgaaacttcggttgacgagcattacagtctgctccatccgtctgatttaagtttaaaaaacagaaaaagatgcctttatgatttaaaagatatagggtttcaggttggggcagggtttatggtaggctcgccgtttcagaaagacgaatatttggctgaggacattatgtttttacaggagcttaagccgcatatggtggggataggtccgtttataccccataaggatacggaatttaaagatttccctcagggaacattaaatatgactttagtaatgctgtgtattacaagattagctctgccgaaagtgctgctgccgtctactactgcgctggggacaatttctccgaccggcagagaagacggtctgcgctgcggcgctaacgttgttatgccgaatttgtcgcctataggcgtaaggcgggattattcgttatatgacggaaagatatgtatgggcgacgaagcggctgagtgtataaaatgtttgggagctagagtggagacagtgggatgcaggctggatttttcacggggcgacagtccgttgatatagggattaaaacaaaatttcagcattatacaagaatagaatgtgcggctgatgttaaaattgatatgacgaaaaaaagacaaaaataaaaaacacctctgcggtgtttttatttttataaaattatgtttgccaaagcctcgcagtgtttataaaagcttcgcaaaacaccggctttgtgaaactttaaattcaagactaaaccgctctgtcaaccttgcctgatcttatgcatctggtacaagcgtaaacttttttaggagtaccatcgacaatagctctgacacgtctaacgtttggtttccaaaccttatttgatctacggtgtgagtgagatactttgataccaaagctaacgccctttccgcaaatttcgcactttgccatatatatacacctccttaatagtttaaaaattaactcaactcgaaatattataacagaaactattttataatgcaagtactttttcaaaaaattttacattttatttatatatttttatatttattactttaaaactctgcctgtgagttcttataattctgcaaaatatcttatgtattaaactttagtaagctgatgacgctatgttatcagcttttattatttaaagttatattgatttacttaatataaacaatgtttataaagttataaagcaaattatttagctgttattttaaacagataaagcgaaaatgttatttttactaaataataaaaatattttaattatatattgtgcaaaacgctaaagtgtgctataataccagtaaggggtttcaggtaaattttaccaataataaagggggagtatttatgaaaagaaaagtggcagtaattattttgtgcgtcgtttttttggttggaacattttacgtttttgccagtgacgcactgattaatcaagaggataaaacagatgttttggaaattgcagaaaccgctgaacctgctgaacctgaatccacaacggaaatagtgatcgaaacatctcctgagccggattcggaaattgctgaaccgactgcttctgcggctgcggaggaagaggatttgagcggtcaggccggagagaatgaaactgagacaacagcgtcacagtatccatcaaatttttatgagttagctcaggttttaaataatagagatataaacactgcaggcgtttgcgatattttaacaagttatttatatctgcgggacgtatacggtctcagtaatcaggagcttgaatacatcgcaggactgattatcggcggcgctgaacctagcaatattatggaagccgcatatttttggctggatacctgcgaggatatatcaattattgaacagatatacaataagaaaagtgaatatgaaggcggtaagttttgggttgaaaacgcttacaacgacgtgactgaatatatacatggcgagctgtctgtggacgacgttaattattatcttgaggcgggtgcagccgctgttgatatacagaatgctaatgttttgagcagaaggggagtttataccattcagcagatactggacagaatcatcggcggcgaaacaatagtagatgttatgaatgacgtttatgggactaatataactcagcctgtcagtttatttgggcttaatgaaaatgaggaagcggatgaaaatattttagacagtaaagaattggccgggcttgaaaataagcagattgaggaatctgccgaagaaatattgtctgacagcggcgtttcggaaagactttctaagaaaagaaatgagaaaaacgcagggcttgtagaacagcttgtaattaacggaatcatctcgggtagaattgatgaggatttgggggtgatttttgatgagtaagctgaaatattttttgtttatttctgtactgattgtaagctgctttagcatttcgtgttatgcttcaacatccgattcgctttatgagcagtctttggttgaaagcatgatagctcaaactggttcgaattattaaagtccgtttatagccacgggcggcaatgtggaattaagcgacggaaatgtcaacgtaaatgaggttgatttgagcctgccggggaaaaatggtatggacgttaatatcaggcgtattcattatgttaacggcaaaccgggcagctactacggagtaagcactagtggaagtgtggcaacaagtccgatgtatttatataattacgttttaaacggagtttcaaaaaccgcatatgtggcctttaataaggaagaaaatttaacagatgagttttatacaacatcttcattgctgagttcaaatatgagcactgatactcatggaacaaaatactacgaatattccagtataaaaagtgtttctggaatattaatgactagggataagaataaaccttcggttcaaaattatcagctgtcgaatgaagtgtttgcgtatatgggcaaaagttccgatgttgaaattggttatggctggtatgtcgcgatgccgcagataagccaagtaaatgtttcggggagcagttatataaaaagatatacctatctgtttgaggatgaaaacggacagacgatgaattttacatatgagtttgaccttgagggaacaaagtgggtgtttgacccggaaagctgcaatgtgtcggcgcctgacagccagtacaatgctcaagtttacagcgataatcagacgcatgctttgggatttcaatacgatgttgttataacagatggagacggaaagtcatattactttttaaaggggataaataaaaattgtcttcctgccgccattatagacaggtacggaaacactgtccgctatgccgcaaacagcagcggtgttgctgtgacagatactttcggcagaaacattcaggtatcgtcatcaggtataaccgttaccaaaggcagttctgtcaaaagcgttgagtatcggatgttaaggtcaaatgacacaaccagggatccatcggggctgctcagctgtttttcaaaatattctttgcaggtgagaaaatataatggctcgggatatgagactacagaatatgtgtcacacaaaagctcaattcaatttataagcaaagaggtttactattatgataaaatcgaaaagataatatatccgacaaacgcttcggtggaatatgagtatgagacaacgccgacagtgaaaaagttctcttcaagcacaggacggtataaaatttcacataaggattatcatattaaaaaagaaattgcttatgaagacgggtcagaaaagtattcaaaaacatacagcttctatcagtacatacaaaatgccgctatggtgccgggtgataaggagcgctatgtgacggttaatgaaacttatgacgacggttcaagtaagagcatgaattataactatgattatgccggaagactatatgagataaaaggaagtattgacggaaaggtgtataacgagcagtatacatattccagtaattccaataaagatttgagcagtcttggttcatcaacgatgcttgcactgagaaaagcgaatatgcaaagcgttataactacctatggcgggaatatcataaatgttacatataataactataataatagaaatcagccgacatattcacttaatggtgagaaagaaacaacttatacttatgacgacagcttcgggcttctgctgacaaagaattataaaaaggatgacagtacgcccataagtatacaaaacagtaaaacctcagacggaaagagtatagcaagctctaaaatttatgaaaataatgcagagaagtcaacgacttcatatacatataacagtgacggtacaatagcaagtcagacagtaactccgtcagtgggggctcaggtgacaaccgtatatagctatacatacaatccggacggctcatatagattaacagcaactgtcaataatgtgtctgatactgacgggaataattcgtcggtgactactgttcagaattatgactggctgggaaatctagtatccgcaaccgaccctaacggaaatactttctcatatcagtatgacggtttggggcgtttagtaaagcagataaaccctgacggaacataccagacagctagctataatatagcagacaacagcgtaacggtaacggacgagaatgggaatataacaactcaggactatactcctcttggatatttggataaaatatatttggataataatcagaataatatagccgccaaatatacatatgacaatcacggaagaaagacgagcgagactgcataccaaagcataggcggaaaaaaggtaactgaaaattatacgtatgaccagtttgacagagtggtatcacaaacaagcaaagaggataatactgcgctggatacagtgggatatgagtatagttatggagacggtttttcaaaaagtgaatctaatattacaataacggttccgtcaagcgcaaaaaaacttttggcggtatttcataacacatcggtatcagcaagttcagcagtcagtgttaaaaacggaagcactgtatactttgccggctcggtttcggcaaaaggagcgcgctcggtattggtggatgtgtcaaatctgtcaactgtatcgcttaataaaatgtacggaaaaatatattataaatatttgactgacgatgatttatcaaagaatataacactgctgggaggagccagccaaacggtaaaggccacatacacaggagacagcacatatgtaaagccgacagttgagacagtgctggacggtttgggcaataaggcgtctgagacgtactataagcatggaacgagtacggtactgaataaaaacacatataagtatgactatatgggaaacgtcctggagacaaaaggcggcagaacctatactgaaaacctgggagactatacgtcgaaagcggaatatgattatatgggaaatccgacaaaaacctacagaaccgacggaagctatatgaccgctgcatatgacggatacggaaatgtattgagccaaactgactatatgggaaacacaaccacaatggaatacgacaggctgggaagagcgataaaggcagcggcgccgtttaatggttcagaaaagagcaaaaccctgacatactatgacggaaacggaaatgttgtaaagaccaaacagcagaacaatgagcccgggaaagcggagagttatgcggtaacggagtatgaatatgatagcagaaacagattggtgacggtaaaacagaatgacggaaccagggatatatatactcaatatgcgtacgacaatgcaggaaatatggtgaagacagtaacaggacagacaagcaaaatagctgatctgtacgggacactgccgggtgcagcggccagccaaacatatgagtatgacagattcggaaacgtgataaaggcaaccgacggactgggaaaaagcagtacggcagcgtataatctaatgggactgccggtgacagagacagacagaaacggaaacgtaaagacaatgacctacaacgcgtacggaagtccgctgacggtgagcgtaacaaatggagagacaataacaaatacatacagcaaaaacaatctgctgataagcgccaaacagggaagcagcatggtgtcgtacacgtatgacgactatggatatgtaaagacggagaacagcaacggtatagtaaacacatacacaaacgatgtagaagaaaatagaaggaactatacccaaaaagagggaacaaatacatatattaatgcgtcatatacatatgacaaactaagcagaatgacgaatgtaaattttggaaacgggataagcgcgggatatacatataacgcaaataatcaggtaacaagcgaaaactgtggagtgattgaaacaacttatggatataacaaagcgggtctaaacacatcagtgtataatacctggggaggagaaaataaagattatgtatacagttacaatttagcaggcaaccaggtaaaaaaatatgaaataaatacagatgaagaaataacaacaacatatacatatgataatttgggacaactgttgaccgagacgtcacctaattactacgcagcatatatgtatgatacgagaggaaatatagaagaaaagaaagaaggagacaactacccgacatattatagatacgataaaaacaataggttagtatattcatataatgaatatgaagcgtggaactatatagatatagcatattcgtatgacggaaacggaaatatgacggaaaagagctggatagattattatgatgacggagatggatatacaaacgaacataaaagatggttggagaaatttgaatataatggctataatcaaatggtgaaatatgaagacacaggagaaggagaagtaaatgcggaatataaatatgacgcaataggaagacgcgcaagtaaaaaagtagatggttatacgacaacgcatcgttgggatggaagcagcatagtaggagacagcggaacaggagcaggaacgtattacagaggaatgaacttaataggacaaaacagaaataatacggtaaattactatgtgaatgatggacacggaaatataaccgcactgacgaatgctgatggaacaacagcaggcaaacgggattatagcgcatatggaaatatgacaacattaggaggagaaatgaacacagtgtttaattactgtggagagtatcaagattcagagagcgggatgatatatttaagaaacagatattatagtatatcaatgtgccgcttcacgcaggaagacccggcaaaagacggactaaattggtacgcatactgcggtaataatcctgtgaactttgttgatccttgaggattaatgattagcgatatattaaactcaaaaaatatttctgaacattattctgatgattatgtgcaatttgctgaaagagtattcacagagtctataatgaaaactgtaactactactaatccaataacaatagttgaaaattctagcagtataataatatatgcatatatatatgtctcaggaccagaagctgatactataattcctggtacgcaaaatgaaaatggaactggcggcattacatatagggaagctacggttaatggaataaaaaaatattggagtggtgaatatgatggaaaaaaagttaaggttattaattgtagatttaaatgatggaaatactcgagatttaaaaattgggcaaaaaagtttaagtgtaacagtaaatagtggaaaaaggaatatcaaatttaactgattggtattcatatgctgatccaggacaaatcaatatgtttcaaggtgataatagaaatggagtaacatattcattagatgattttgaaagaactattgcacatgaatttggtcacgcattaggaatagctgatttgtatgacgatataggtattccgctaatgtttccgtcaataatgaataaccagtgggaggtaaatggagcacaatcggtagattatgctatgatgtttaatgcgtatcgtttaggtgtgtttcaaaggtggagtgaaaataaaagattattagatagaatggggattacttattataaaaagtcttaatctttaaaggagaaaaaatgaaaaataatattgtaaaaattatggttttaatgattgcattaattttatttatgacattaacatatgccagtaatgaacttatagcaaaagtagagcaatataaaataatagtaaatggagaagaaaaaatttttaatatgccaatagtaacaataaatgataggacatatataccgctaagagagacagcagaaactttagatatggatgttagatgggacgatgagaaacaagaaattaatataaataatatgattgaagaggatgaactatatgtattttataaaaacgggttatatggatatatagataaagacttcaatataattatacaacctaaatattattatgcagaagattttagtgaaggtttggctttggtgagaacaagtaattcgcaaaatggacaatatagatatataaataagaaaggggaaatagtgataccagaggcttattcaatggcatatagtttccatgatggaatagcgttggtagatttgggagaagcagctataactgatgatagtttgtttacatatatagataaacaaggaaatagaataacagataaagaatttggactggcaagtagtttttcggaaaaatatgcagttgttttaaaggagggatacggtttcccagtaccaccaagcatgaaagtgaaaaacaaatggtcatatattaacaccttaggagaatatccaacagagcaagtatatgaagaggcgagagatttttccaatggttatgcagcagtaaaaaataatggaaaatggggactgattaatacaaagtttaagttagttatagattatatatatgatgatattcacaaagtttaaatgaaggaataatgccggtaaaattaggaaataaatggggttgtgtagatataaacaataatgtgatagttgagtgtaagtatgacagaattgattcatattcagagggattagcctgctttttgaaaaatgataaatgtggatatcttgatacaaatggaaatgaagttatatcagcagaatttgaaaatgcaggtaatttttcagaaggaatagcaacagtaaaaacaaacggtaaatggggatgtatagataagaaaggggaatttgtaatacaaccccaatattttattttaggtgactgtaaaaatggtcttatggaagtatatgacgaatcttatttgataaaaggctatataaataaggatggcaaggaggtaattttataagtataataatacttaaataacatgagggcacaatgttttgtgccctcaataacaagttcggttaagataagcgtacgcataaaaaactgaaacggagtaaaaaacaccggaaagtttttgtatatataaaaataattaactatttaaaatataatccatcaaacacttccattttgaatggttgagaacacatataactccgtttcagttttttatgcatatatagaaatatatttagaaagtataatacaattttatgagtttatctaaacaataaagaaagatttctataaggctattatttaactacagaagaagtagggttagaagtcaaatacaatatggcgattatcctgatatattaaataaatatgttccgggttggaaatatgaatgagaggagaaaaaatatgaaatataaaaaagtgttttatagtgttatttttatatgtgtaatatcatttatagtgaacgtaaatgttagaggaaacgaaagcagtaacagcggtaatatagatgaaatagacagtagatatgaaataataaatttaactgaaccgataatagacgcaaaagattattggctttatgattgtgataataatggcgtttggataggtgtatataatcataaagatgattgtgtatatgattactttataggatatgatggaaataattatggaatacctactttgtttcatgatggcgttgcaaaagtgagacaaaacgataaatttggatatataaatacaaattatgagtggattttgcctcctgtttatgatagttatagaattagtgagtttgcagatggatatggtgccgcaacaaaagatggtacatacaacagtaaatatatagttgacaataatggcaatataaaacatttcttatgtcctgatagggagcaacagtttatcggagataaagagatagggactcaatatattgttgataaaaatcaaaaagtaaatataattcatacagaggatatggtaaaagatttaaatccggatgattataacagatattggggatatgagcagtttgggggaactacgctttatcaagtaaatattgctgagactgaagattctccaactataaataaagtatattatatgtttggagatgatggtctattaaaatataaatatgaagtaagcttgctcgaaaacaatcctgatatatactccggttattataatccaataatactgaataatgggaatgttatatttcttgataaagataaagaaaataaaaattatacgaaacatatacacatttctagatttggcaatgtaattggagaaaaaagtttaaaatatccaatagttaattttgaaaaccaacttttatacagttacggagaaaacatgctggaataccatggagagtttttaggaatggattttaaaccgttagtttcattaaatcaagaatataatggatacagtcttttaaatacggaagcatatttgccgtcatcggagattaaagataaaatatgggaagataaagaaagagatataatagtatattttttaggcaaaaagcatgaggaaccaaattataataaatctgcagatatatatcaactattggttgtatatacaaatgaaacagaaataaatcacaaacctgttgtagttgatgaaggaaggataccaatatacgagaaacctgaaaaaataacaacatatttaaacaatgaacaacttaactttgatatcctgccgataacagaaaacgatagaacattagtaccaatgagagcaatattcgaagcattgggagcagaagtagaatgggaaaatgaaacccaaacggcaacagcaacctgaaacggagttatatgtatttcttaactatttaaaaaggaagtatttaatggatttttattttaaatagttaattatttttatataagcaaaactttccggtgtttttactccgtttcagttttttatgcgtacgcttgtccaactttttggagttaccggagggcgtaaatcattacgccctccacaacaattttagtttgaataaatgtctaccctttgtaattcttcattccattccacctgacagccaaatgcttctgatattgctcttaatggtaccaatgtcctgctgtcttctactaaccttgctggaacatccaattctatttcttctccatttttttgcatcttattgctgtcaattgtcactgatactgttattccattctttgttgctgttgccgtttgtatatgggaaacaagctgaacaccaaaacaccgaaagccaaaagcgaaggaaaaggttatacatacagaacagagtacggaaccaaagacggcgggacgtatgtgacaacaacggatatagagaataattctaccagagtggaaaagaacatgctgggtcaggaagtaaagacaatagatccaaagaaaaatgagagttcggcaaagtatgacgacttatgtaatctgcctcgttaggcgcgcagtagcaaattttatttatattaaataattaattctaattagttcctaaattacagatggttttatttttacaaatatatactcatataaaaaatattttctgcaagcattggcagcgaagtatctttaggactgctgtcaaccattatttcaaaagtatcatccatatctaacgcatataaaccaatagattttaaaggttccttgccgctcgtttcaaaccgtattgcctgatacgtacagccaaaactattcttaagactaatacttcccatcaagccaacataatcataagaataaatattctcatcagtttcatctgaaaatttatacccggaagccgaaaaacctatagttggatccatataagaaatatactcatatccatcattggcccaatcgcttccccagctgtttcttactatccaagccccattctcataattataatcttttccgtcataagatgaaggtttagttttaaagtttgtgtatgaataattatcatcccagcctatcagcgttactgcgtgattagtaggcgtattaaatttatattttatagaaccgtcattttgataaaagctaactttgttattatcaggagctgttccattaagcaaatcactccagcttccgcaataagctccggttttcgaattataatatccgtcatggctttcattagaaagataggacactgccaccgcgccgtatttcataatcccggcttttatcgcgtttataaccgattcatttttatgatacttaatattctttatagaaccgtcttcataactataatctagaacagaactgccctcgtataaatttgtaatactctcctgcgaaataagctttccggctctgtcgatacccaaaagagatgaataatctgttctgtccccggtatactttgaatatttactattatcaaaatcctttaataatacagaacctccgccggtctccctcgacatatacgcaaccgccatagcagtattaccgccggttttgttatcccatgtaaaagttttatatccctcatcattggtataattcattgcagccgccatgtggtattctgaaagtatttcattatcattcttatagctcttgttgttaagaacaacattagaatattcctgggcagcagtatttgcaaacgcccagcagtcaccgtcaatattttggtcccttaccgcagggaagtctttcttgtcttttcctgcatccgtttcagtattatacttttcaggcataacctcttcaagataagcagaagattcgctttttccaaattccacaggctcaggaatgactgtataagccgatggatttttaaggtaatcctgatatgcgccggtctgttcagctacaatcccgccgctgtaaataacatcagcaccgattgactcagcatatccggatccagttatcacaatagcaaaaacgagcagtaatacgatactttttaactttttcataattacacctctgacagaaatttaatttactttaattaaataaccctccaacctatttcttatgttataaaattataaagcattttatcattataccatgatattcataaaattacaatataagacataaaaaatattatagcatgttatggtattttgaggacgacgttaattaatatggcgttaactaatataataagcaaaatttaaaattctgtaggtttgtcaatgatgtgttacaaaaaagattaaaagagttcaccgaaattgataaaagagttgatgtagtcaattggagctttccaatttcggtaggtgtgaccccacctttggtgggtgtgatacaaagtgacttattttactatagccttcaacgtcaataatatgaatactcaaacgcggcatagccgccgcgtgaggtgagctatcatctgaacacgcagtgttcaatatacaaaccaaattaattcattttctaggaggatataaaatgcgtaaagaagcaggttttgaaaacagagaccgttttgttgaactggggttgatgatttcagctttaagaaaggctaaaggttatactcaacatgaacttgctgagaaagcacatattagccgttcacatttaagttctattgaagcccctaatataacttcttcattttctttagaagttttctttaatattgccgatattttggaggttaaacccggcgacttgcttaatcttaatttgccttctttctattttgatgaagataaacaagatgataaataagaatataaatggagtggtcaaatgtatttaaaaagattaaaatttctgcgtatgaatgctgggttgaaacaaacggaaattgcagatttattaggaatacaacaaactgtatactctcgttgtgagcgaggttttcaaactataccgttacactttttaataaaactagcagacttttacaatacttcaactgattacatattaaatagaactaatgaaataaaaatgtatccggaaagtatttttgaataggaatcaaatataaattatttatataaactttttaaagtttgtattaatataacaataacagaaccggcttactttaaaattggagataatatgagtttggcgtttgacgcagttccatagataatgcttaaagggtcatcagacaaattatagaatgagcaaaaagttaattaaaaatatgcaatacagttggtcatatagtaatcaagatagtagaccattatataaacaaaactaaacaaaactaaacaaaacaaaactaaactaaactaaactatttatatttattaattataaaatttattttttatactttaataaaaaatattatagtgtcgttggtttatagtatgtttgacgaaactcgtagaaatgtttctatcgttttaatcaaaaagttatgtgatggattagatatgactttggaagagtttttttcgtcagaaatatttaataaactcgaacagaagataaaataagtataaatatactatgtattatatggggttatatacaaagttaatttttatgaatattttcttgatatattgaacactgcgtgttcagataatggctcacctaacgcggcggcatagccgcgtttgagtattcatattattgacgttgaaggctatagtaaaataagtcactttgtatcacacccaccaaaggtggggtcacacctaccgatgttcactgaaaaacttgcttttttgtttattaatctagattgaaaacttagcttttttaatgaataaattaatagtaactcgaaatatcaattttcacggtagtttgaaaactagaaaatagatttaaatttttgtatatattgaatactacgtattcagatgatagttcacctaacgaggcgcataaatgcgccctgccgtagttcactgaaaaccctgcttttttgataagtaaatcaatagtaactcggattatctttattcacggtagtacacaaagtcaacgggaaagtagtagggcttttttcatcatgaagcatggcttcatgatgaaatgagcgtgggctagcgccccttggagccgtcaggcgacctaagcgagcagcactttttctttggtgaagcgtttctttttcttgctagaaaaagaaatggttcaaacaccattattatgtaataataaaattttttatatggggtcatatacatagtatataaatatttttttcaaaaagtaaaataataaatattatatggagccacatacaaagtatatagatagtcttctgagtaagcaaaataagccgtatattaattataaaaaataatccctgtctaaaacggacagagattattttttatttgcccaggctttgtcaagccgggttatcgcctgctctatttcagcttccgataattgaccgtatcccattacaaatgtgcttgccggaagtttggggtttggctttatcagaaaggttgtaagaggcaaaagttttacccccattttagcagccgatatttttagttcgttctcagtcattccgttatcaacggaaactataatatgagttccgccgctttggtgatgtatagtaacgtattttgaaaatgaacacgagttgattttgtctttaagatatttcgatttagacaaatatatattatatagcttctcgagatgacgctggtattttccgctttgtatatattgggcgacaacctgctgttcaattcttgatttaagagttgtgtagtatggcatacgttcatcaaaacgttcttttagttttttgggcagtaccaggaaccccgtttttattgacggggctattgacctgtaaaacgagttcagtaaaataaccttttcggaagtatctcttagaaacagcgggtcgagaccgcctttgtcggaaaagtctaagtcaaaatcggcttctattatatagcggtcaggtttttcgtttgcccagtctaaaatttctttttgctgtgccgctgtcatacgataacccgttggaaattgcccgtcgggcgagatgtataatacgtctatatcgcttttatataagtcctctgcatcaaatccatccaaacctacgttaatcagagtagtttgttttccggaatttttgaccggtacataacttcgcgcgtagcacggattttcaaatccaaatactgtgctgctgccaaatatgtgtgatagctgttcaatcaaatagtcgctgccggcgccgattataatttggtctgttgagcatgatattccatgaacttcatataaatagtgcgccactgcttttctgagtgatttttctccatatttatgaccgtattcaaatagctccggcttgtcgtaaattatttcacgatatagttttaccagagtgttttttgggatagacggcaaatctatgccgttttggctcatgttaaaactgattccatgcaggtcataaaaatccggctcaaagatgtcagtgtttataggactttgttttctcgcaaaatatccgcttctgggctgtgagatagcataaccgttatcaattagtttttgataggccaaatctacggtgttttttccgaggcctaaaacttcagtcagtctgcggcgggagggaagacgttcgttatccaaaattctgccggatactatatcgttcttaaacgcgttataaagctgaagatacagtggagtgctaagcgttttgtcaattttgtattttacgtctttcattctctcaccttctttgcttgaattgagttaagatattatgtctatttttacttttttattgtataattataccactttatttttttacagtcaacgcggatatttttctatatacaaactggacctataaaaattttttcatctggacctgttaaatcaaaaattgttgatttataataagtataagtaagcaataaataattggtgttttatattatgactgctgattatttctttgtttatagctgtattaattagtatttaatttaaaaaattaaataaattgatttcttcccaaaaggccgcgtaactgcggcttttaatcttttataaatgggtttagtttaatttgacaataaaatgggatagtgataatatattgttattatgaaagagaaatcaaatcctaaaatttttaagaatattattttctatgcccgcagatattttccgtgggctttggttgccgtgcttgcaactgtttctttttcattccttgaggtaatgaaggcaaatatattaagagcaattgtggatttagctcagagcgggaatgtgaacggcatattgcctgagttcttaaaagccgttttaataattatttgtgttatggtttgtattttcctgagcagatatgcggccggacgtttttcttccagcgtgatgcgtgatgttaagagagacagcgcaagacatatttcgcaaattcctttaagttatatgaactctaataggagcggagagcttctttcaaaaatgagtacggacgccgattcggttcagagctttatggagggggacttcatacagcttattcagcttccttttactattgtgttttatgctatttatcttatttggctgaatccgatattgtttttagcgtgttttgcaactcttccgatcttgattccacttggagccagttttgctataccgtttagagttggttcaaaaaaatacatgaagtatttgggtaaggtgagcaacactgttgccgatatggtcggaggaatttcagttgttaagtcttataatatggagagagctcttgctgacaaataccagtcgggtatagagcgcgcaaccaatatggcgcttaaaaatgataagtgtcagtataaaggttcgtttatttttaatttggcgcgcaatataccaacgttgacctgtctggttttcggaggttatttgtgtttcaaaggcagtttgactttgggcgcactgatagcgttttcatcactgctcggtcagacgctgagcccgcttatgcgtgcgtcttctatgttttttaatcttaaatccgcgtccgcttcagcggagagagttttttcaattataaatgaaccctctgaacaggagggcagcgaagtttctgcttcgcttaacggagacgttccggctatacaatttgaaaatgtaagttttggctacgaagaagataagcccgtattaaaaaaccttaatttatcaattaaaaagggtgagactgtgggattcgccggagccagcggatgcggcaagagcacaattcttggactgatttgcggtttttaccggccttcatcgggaagaattttaatcggcggaatagacatgggcgacagaaatttaaaggctgtcaggtctttgatttcatatgtgtctcaggacgcatacctttttccgttttctatatatgataatattgctatgggaaaatcaggagcaaccaaagaagaagtgatagctgccgcaaaggctgcatatgctcatgactttattatggagaccgaaaatggctatgatactatagtgggtgagcgcggctccagactttcgggagggcagatacagaggatttcgattgctagagcaatgcttaaagacgcgcctatacttttgcttgatgaagccacttcggcgcttgatgtaaaggcggaggcggaggtgcagaaggcattggataatttaagcatcggaagaactgttttagttgtggcacatagactgtctaccattaagggggctgacaggattgcagtgatagataatgggatagtggctgaatgcggcagtcatgatgaactgctgaaaaaagacggcttgtatgcaaagcttcaaaacgtgcatagccagcagggaggtgaagctctgtgaaagttttagacggattaaagagctgtttttctctgatgggaaaacacaagtatgcgtattggataactttgatattggatatatctttaggttattgtgcagacgtaatgctggccttgcttaataaaggtgtaattaattctgtgacaagtctgaattacgccgcttttatttcttctatatggctgggagttgctgcggttatcgtttatttgataaacgttttggaccggtattttaatatgcgttctattaggtatataatgcttgatttaagacatgatttgttcagacatatggaatttttatcggttggatattttgaacaaaatcacagtgctgacagtatattcaggctaaacagcaatgtcgaaaacatgaaaagagcatataccaaccattgtcctaacatatttcagggtattatcggcgggcttggctcgtgtgtttttattctgattatggatgtccgccttggacttatttcattagctgcctgcggacttacagttctgataaacattaagtttgccgagccgctaagaaaaatcggaggcaaaattcagcgttctgaatctgctcttttaagcaggctgtctgatttggtagcaggattcagggttattaagctctatgatacagacggatttattataaataaatatgaggagaccaaccggaaaactgccgggcttagaataaaaaggattgccagagtcggcacgatagacagcataagtcatcttcttaattttataaacacttttgttattattactatcggagctgttatggcggctaaaggctacacagattttggaacagtgtttgctattttgaccgtgcagggaaatgtaagcagtatgcttttgaattttggaagcgcttggggtatgatgcaggagagcgttgccgcgtctgagcttattcatgaggttttgaatactgacaaagaagagcgcaagccggctatagccccggaagacgatacaagcgaccattacatagcgtttgaaaacgtttcgttttcttatgatgacagcggtcctgttcttgacggacttaatctgagtgtaaaggaaggcaccgtagccgcgcttgtaggacccagcggaggagggaagagtactgttattaaacttctgccggagttttatcctattggtaaaggaaagatatattttgccggcagaaacatagattcttattccgcggatgaattgagaaatatgatatcatatgttccgcaggacgcgtatttgtttgacgccagcgtaaaagaaaatataggctatggtaaaacaaatgcgtctgatgaagagattatagacgctgctaaggcggcaaatgcccatgattttattatggaactcagtgacggttatgatactcttgtcggtgaacgcggtgaatctctctcaggcggtcagaggcagaggatagcgattgccagagcgtttttgaaaaacgccccggttctgctgctggacgaggcaacctctgctttggacaatgaaaacgaagcgatagtgcagcaaagtatagaaagcctgatgaagaacagaacggttattgttgttgcacacaggctgtctacaatagaaaatgcggatataatttatgttattgagcatggcagagtagtgcagctgggaacacatgaggacttaaaacagcaggacggagtttatgcggagttagtaaaactgagcaatgcgtttaaataatcgaattatcttaatataaacattggcggccaatttccggccgctttttttatagcatttatttaaactggtatttaaaattataaaaataatttaattacaaatataaatgatttaagttatcaaagtttatatgtttaattatactattaaaaagttatgttaatataattaattaaatttttataataaaaacgtttcgaaaacaaaataataataatttatactgtgaatttggttttgacatatttgcatatttatggcaatatttatgttttatgacaataaaactgtaacacgtgttgttatgttgcaaactggtatttaaaaatatttgttaactggctattgatattgatttccggtttgatataataatatcataaaatataaattatagttttgaggaggagaaacggaatgaaacaaagacggtgggtaagtttggttgtgtcagtagtgatgcttttgacaatgatgccaggaatcacagtgttatctgcaaatcagacagatgaacaggtgaatacggcggcgtctgagaaatataaaacatctgattttgatttgggaaatgcaaatgtaaaatctgctgatataaatggttattataacgcaaacgcggatgtttcggcggagtatgtatatcctacatctgatccgaatggatatatatatgatatattatcggcatattttggaaatgatggaaaactgaatgtagtgttaagatataatggaaatgaagcgaatccaacaggaaagttgttcgttggtacatatgacgaggcggacagcgaaataatgctggacgcaaagagttatgatataaagggaacgacggttgaaggtcttgattatatcaagcctggaaaaggaaccgttagactatatatttgggacggtgttgattccttgaaccctctatccggagtattaaagccgggggatactcctccgccgacttttgctccgacctcaacaccggaaccgacagcaaaacctactgctgtaccgacagcaacaccaacagccgcgcctacagcaactccaaccatggttccatacgataaaaaggcggcagttatgcaaaataatactgttgtcggtgagtatgatacaataaggggagcagttgctagggctaaggaaattaatcctaaatcggaagcagaaagggttacaattaacgtaaaccctggggattatgaagaacaggttaagtttgacggcgttaattatgtaacgctgcagcaaatgccggaaacaactgggaaggtaacacttcactggtattactgcacaggatactgcgcttcaaactgtgaccttgcaggaaactataatcctgatattgactggtcacttgatgaaacctggaacggttataaggccggagacgaaaagtttacaaagtatgagataggtgaagttattacaggtaagactatttcatattatgataaaaatggtgtggctcataaaaatgttaaaccaaatgcaaacaatcttggttctaccagaacatatgaccaaatgggtgttcttattgtaaactctaatgcaagcaatattattgtaaaagatttgaatgttgtaaacagtgttcctgttatggtgacgcagggtgagaaggatgctcatttgacgccgcagcttgacagaattgcaggtgttgcaacaagctatgttctcccatatcgtgataatcttgcaatatgcgatgagaacactcctgaagacgctacaacaagagttaaaaatgctcttgccataaaagatgagaatggaaatgcttcaaagagaatacaggctcttcagaatttgactaatttaacagcgggcgagagcgcatatttagcaaagtctgcttcatataatgagcgcggtcacgctcttgcgctccacggtgataaggttatattagagaatgttcgcgcaagaggaaatcaggattcagtatatattacaaatggaagaatgtatttcaaaaactgcgatttgataggaggaacagactatatatacggagacgcaacggcagtatttgacaattgtaagctgggcgctgagggtatgtcaaatgcaacgtcgggggcaacaataacggccgctaacaccagggctgaaaacccttacggttatctcttctggaactgtgagatttataacatgcgttccaatacaacgtcaaattcaaattatggaagaccatggaacgattttcctcaggttacttattataatacaactcttgatgactcggcttcaacgggcaagagtaaagtaactatcagtgctgacggatggaatgatatgacaataaagaaagaccaggcacgtttctttgaatatggaactaaaaataagagcggaaaaaacgtagacctttcaaagcgtgttaaaaatgcggcagacaaagcagggatgggtacagtccttaatgactggcagattcttgaattcaatccaagaaattattttaccaacagttttagaagcgacgcgtgggatccgatgaattttagtgagaacttaaagaacgttgacgctgcaatagccggagcaacagttgtaattcctgagaatgaggaaacaacaattactcttccgacggctccaaccggagtttcatttaaatgggaatcatcgtctgaaaatgccactgtaagcagtgacggaactaagctgactgttgtccgtcctgctgcaggcgaaaatagtattgagtccagcgttgtgctatatgcaagggataataacaatggttatggcgataagaagacaatacctgttataattacacctactactaacacaaaagatgtatacaccgtttccggtaatattgaactttctcaagcatcagaaagtgatgttacggtaacaatcaagtttatgagcggagcggcacaaataaagaaggttgatgtaattgttccggcaggtgcaaaaactcaggcttatacagtcgaaaacctaccagtaggaacatatattgcgtatatgtctataggtgatcctttatacaacatagcaacagaatctcagaaagtcgatggtactataggaagcattgtttcattaaatattgatgctaaaaaaatgcaggagataattgtcagcagccctgattttgacggcaaaggctatattccgacaattaactcagcgtcaggcttcagcggcggtatttataccgttaccggaaaggaatcagctaatttaggcgaggccggcaataaggttctgaaacttactaagaatgaaggaagtaaagtagctgcaaaaaccggtgcaagttttaacctgacttcaatgcttccgagcggttcatcgctggcaaatactaagacaatcaaattcagctatgatttcttaatggaaagcacagattatttcccgaataaccaatcaggttttgaccttgcaacaagcacaaagaacggcggcaacggaagagccgaagatcagactagatttgttcgctggggagtttataaaggctggagccagtttaatatatacacagcaaataataccagaataaacggtgataatactcagttcaacagaggcaacaatatggctaacaagtggtatagaattgttgcagacattgaccttgaaaatcaaattataaccacaacgttgtatgacagagattggaaaacgggtgacgcaggttcatatatcttaaataaaaaaccttttgtggttgcggctaaggacgctgacggcaataacaatgaatatccgaaaaatatagatttatctaacttatactttaatatttacatggatgtatttaacgatacagctaacaaaatggaatattattttgacaacattgaactgacatatcaagattttgaataataattaaaactgcaggaggaaatctcctcctgcagttttattcaaaattttattaacaagttaaataatttaaaaattatttatagatttcttcccaataaattctaaaacataaactcccaaagaatgagtacattcgcgggagtttttgttgctttaacttaattttgctatcagattttatatttgtaaactgttaaattttagtgttaaaaccgtatgagaagttttttaaaaaataaatattccgattattgctccgcatagtatataaataatcggatgaactttttttaagggctttatatagagtaaaactaaggttacggcacaaagtatcagggcttttatatccactagattcataagtttttttgtttcattgtataaatccaaagtgagaattgtgacttttataacctggtatgcggcaactgctattagaccggctactgccggacgtagtccataaaatatatcttgaacgatttggctttcctcaaacttttttaaatagtgagctattattatgataattataacagacggtactactaagcctattgtagcagagagagctccgaatactccggcggttgtgaaaccggtgaatgttgccatatttacacccataggtccgggggttgattctgatacagctatcatgttggatatatcgttcatatttatccactctggatatcttacggctatatcataaataaacggtaatgtcgcaagaccgcctccgaccgcaaataaaccggttttaaaaaattcatagaacaaaagcagatatgtcattttttgattcgcctcctcagttgtccggcaataagaccgacgattaatgcgccgataacgacgtagacagatgatactcctaatattccggctactgcaaaagctgcgatgaaaataaccacgccggttaagtctttaacacccgacttaaaaaatttgactacagcgtttataatcaatgcggcaaccacagcgcgtattccgataaaggcatgagccactaagggaatatcggcgaagttttgaagaaatgctgcgattataattatgataacgagcgatgggaatattacaccggccgtggctaaaattgctccgggaacccctctgtatttgtagcctataaaagtggcggtgttaaccgcgataactcccggcgtgcattgtccgacggcaaaataattcataagttcttcttcggttgcccattttttattctgaaccacttcgcgctcgagaatcggcagcatagcgtaaccgccgccgaatgtcataactccgactttggcaaatgttaaaaacatgtctaaaaacacgtgcaatcatacccctccatgtcataaattttttgtttataaagattttattatatacgagattatctgttaaccgcggttataacaggttttccttctctgtcgagcagcggtgttaaccctcctgcatttgaatctctgtgatacagatagtttattcctgtttctgtatcaacccaaatttctgtagtatttagtattccttgtgaatatattttttcaaatctatctttttccatattgagcttcctccaaatatctctaagaatttgtctaaaatattatacgtattatttttaaaaacgaatctgatttatagactggattaaataaaaacaatagatattattgacagaattaatccaatattaccataattttcagaagctgtaaatacacaaattttaatcaacagaagcggtaattttgtcaattttttgattgttgctgtaggtttgtcaatgatgtgttacaaaaaagattaaaagagttcaccgaaattgataaaagagttgatgtagtcaattggagctttccaattactgaaacggagttatatgtatttcttaactatttaaaaaggaagtatttaatggatttttattttaaatagttaattatttttatataagcaaaaactttccggtgtttttactccgtttcagttttttatgcgtatgcttgtccaacttttcggagttaccggagcgcgtaatgatttacgccctccggaatttttcagtttatgtaaaaatccatctttttaattctacactccataatttctaatagccaaatatttacctattattaaaataactaatcaataaattgaaatttattatttatatacctctcttttccgtcaataacaacttttgctctgccattaacaaacgattcagcataatcatacctgttttctgttgcatattctccggatttattaatatatgtgaactcatctttttcatcaaaacttgcaaaaagcggtctgggtaaatttcctttcgtttgaacaaccgctaaaccttcagaaaaattattaccgcttacaaatgttttatcgccaaacatcttattacctgatttatcaatataccatgctctaaaaacattatctaccgtatcataaacacatgcgcttccatccttaaaatctgtcgacatataataatattcaaatggtataactaactctcctttgacatttatataaccatatccatcaaatcggtcagtccccgtacaaattacatctcttgactttaccaatgctaacccatcagaaaaattattcgcctcagtgtatgatgcttcaattacaatatttccatctgtatctttatatccatataaacctttatcttcaaatacttcaagattattattagcttcattattcttttttaatgctatattatcaacacattctccctttgtgtttattctatatggatatggataaaaatcagattttactgttgcaatcccattctgaaaatcacctgcttctgtatatatatcaggtattacaaaatatccatagtcgttaatatagccataatatttttttgaagaatatttattactttgactcgctgcagctagaccatcagaaaatttactgcagtcagaaaaatatccatattcattctcaggcatatcttctctattaaaatagtaatatccaaaccactcatcacaagatatgtctccgacatgccacttatcaggcagatttgagtcatcaatgatatcaacaattgaatattcatcatcccatctaaccatacaccccaaagcttccgagactgctctaagaggaacataggttctgcagtcatctactaaccttgcaggaacatctaattttatatattctttattttttatcattatatcactgtttattgttacggatatagtaatattattttttgtggctataactgtttgattgttctcatcccaatcaacgtcagcatctaaggcttcaaaaatcccccgcataggcaccatagttctgttatcttctataaacggatacatatcaaggtttatttcattattatttatgtagacttttatttcgtcgttataacttaaattttcagaacaaaaacaagttagagacatcattaatactacaattattatacttacaaaacgtatacatttcattttacttcctccaacaaatattattttgccagcaatatcattacattgcttatacatcaaaaactttatgctttaataaaattcttctaaatattttctatatactcataaaaactaaaacggaactatatgtattctctaaccattcaacatagaagtatttaatggatttttatttcaaatgattaagtaatttttatatattcaaaaactttccagtgttttttactccgtttcaattttttatgcgtactcttgtccaacttttttgttttaccggagggcgtaaatgatttacgccctcaaaatttacttactaaacattattttttaaagttatcttaatttattattttattaggaacctttattctctatagccttttttccaatcatctatgtaatacatatttacatatccccagtagccggtctgaaatcttggtatgtataaaatagttctcactatttttgaaaattctttccatgttatattatcgtctaactcttccggttcaataaatactgacgatgatgaaattaaattcccatagtttatcatcctacattcttcagctaaatctaaataaaatgaatctgataaatcacctttataaagaagttcactatttaaagtccttaatgccataactattacatctctatatgtagctaaatctttaatattagctttatgtaatccattttctatatctcctttaaatatactaccttctactccccaaactactattgtacattcctcagtaccattttcaatatcttcaaattcccatccaagtgttgaacatatactctcttgattattcctaggttctaagtcattatcaatatagaccaaacatgagagtgtatcaacaacctctgcccttgttactaaatcatttatatctttttctctatattcttttggtactattcccaaatcacatattattttaaaatctccatcagcccaaaattgacctatttgtgcacttactgttatacttgataataatatacatattgcaatcatacatcctattgatcttttcattttttacacatcctttttatttatataatactttagttataaacatctaataaatattctactatgttgggtcctctgcttctcaatattgctgctgatacataatcacctatccttttttcttttaaatcacccatatctgattttggtgaaaaaacagaattacttgttactgtcaaatcatacggaaattgaccatatccattggttcctattactaaatctgtattttcacttcttgtttcataagatttttcagctctaaaagcatcttctattgtcattgcaaacgcttctccatattgtttttctatataactttttatttttgactttgttatttctacacttaattgtttttaatatacttacttacgaataaaaaactgaaacggagttatatgtatttcttaactatttaaaaaggaagtatttgatggatttttatttcaaatagttaattatttttttatattcaaaaactttccggtgtttttactccatttcagttttttatgcgtatgcttgtccaacttttcggagttaccggagggcgtaatgatttacgccctccgcaacaattttactttgtataaatatctactctttgcaatgcttcgtcccattctacccgacaaccgaatgcttctgatattgctctcaatggcactaatgttctgctgtctcctactaatcttgcaggtacatccaattttatttcttctccatttttttgcatcctattactgtcaattgtcactgatactgttattccatcctttgttgctgttgccgtttgcgtttcattttcccattctacttctgctcccaacgcttcaaatattgctcgcattggcaccaatgttctgtctttttctgttataggatatgtatcaaaatttaactgcttattgtttaaatatatttttatttcattgctactttcatattgaggtattttatcctgatttacaaatttaggagaattgtttaactttacagttttatgattaagaacaaatatagtatttaattctccagcataatatactgtattattttgctttaattttgtatgaccagtaaaacaacatacaatgttattattaccaccaataaattcagatacagtactttcatcgtctgaactattttcatataacaatatctctccaatttcggttaaatccctattataaaaaacattttcaagtctaagtaaattctcaccataactaaaacatttgtcatacaaattattaccttgtatatattgttttaactctttactaccaataacctgcccatctggagaaactagttctataaatccagtattgttctgattttcgtttaaatacccgtcgaataaaaccataccactatccaatattctaaaatttttataatacgttccatgttcaattatgaaagtattagtatatttaagttcattatcccttccatacatatatgcatttattttgtcaaatttatcgttttgttttgataaaaaggtataaacttttattgatgattttgaatcatatcctattaattctccgctgtcaggcagttctatcttgttcttttgacaaggaaccaaatccttatcaattatatattttttaccgtttagattgtattctgcataaccatttgaaaatacctcataattttcttctttatcatattctgttgctatacttgaatgatattttacaaaatcaccttttgtactaaaaataacattacctgtattatcaaaaaagaaattttctatctctccagaattattctctttgctagcaaaccccataccatctttaaaaattgtagcaaagttgtatattggtggaacaacccaattatatgactcgtttatatatccatatttatcatctatctttacccttgctataccatcataaaacaaaccattcaataaatcatcatttttattataataccttattgaaccatcatatccgactaacgccatattccatttatcaacagagttttcattatcgtctattccgtaaaaatctatccatattccattttcatctgcataataaatatttacagcttgagcatctaaaatacaatcatcatattttatggcctctttaagtttaataacatgatattcgttatcaattttatttgcaaatgtttcattatgttcattataatcattttcaatgcttgaaaaagctaccatatttacaaacaaacataatggtataagaataataagtattttttttaataatttcattttcatcacccaatctttctattctatatactcccagccaggagcgtatttatttaatatatcttcatgatccgaatatgcaagccaattattaaaaccattatttttatagttatataacatcatagcaaaatccactggttgtgcaaaacttccattcgacataatactcccagtattttttataggtttccctttattgaaaggtttactgtcaaaataaatatcatataatttaaaaccaccatgaccaaattcatgagccgctacattttttaagtttcttatacaatttgttactgcataatcatattggatttgaatttcctcttccgtaaaatcattatcatcaattctcgtcggtttagtacaatttaaagtaatatcacctgatctgattttggtgaaaaaacagaattacttgttactgtcaaatcatacggaaattgaccatatccattggttcctatcactaaatctgtattttcatttcttgtttcataagacttttcagctctaaaagcatcttctattgtcattgcaaacgcttctccatattgttttttatataactttttatttttagttttgtcacttctacacttaattgtttttaatatactttactacgcataaaaaacttaacagagttatatgtatttcttaaccatttaaaaaggaagtatttaatggattttatttcaaatagtttattaattttatatattcaaaaactttccggtgttttactccgtttcagttttttatgcatatgcttgtccaactttttggtgggattaccggagagcgtaaatcattacgccctccgcaacaattttactttgtataaatatctactctttgcaatgcttcgtcccattccacctgacagccgaatgcttctgatattgctcttaatggtaccaatgtcctgctgtcttctactaaccttgcaggtacatccaattctatttcttctccatttttttgcatcttattgctgtcaattgtcactgatactgttattccattctttgttgctgttgccgtttgggtttcattttcccattctacttctgctcccaatgcttcaaatattgccctcattggcactaatgttctgtcaccttctgttatcggctctatatcaaaatttaatcttttattatttaagtatatatttatttcaccataaacatctttaggttcaacatatttacttattctatttttgtctacaagcatatcatcattactcaaatcttttttattattataaactatgtatacattacttaactggtaaagacctttactgaatatactatctgatgaatctgcatattttagtaaactacatattaattttcctttatttacaaaaattttaacttcataattatcattgttatataaatgacccacatattctaagttattatccataacaattccattatcaaatactaacatattataaaaactatatacttgttcaaatggaaatccatctttaaaataataagatgtataacaatcacttgttaatgcagaaaatagtacaatgcaatgtgtatcattttcaacatttaaacataaaattagatctccattatttaatatttgacttgtaaaaatattaaattttttaccaattttatcacttaaatttagtgcgtttagtaattcaccttttgaattatacccatttattattatatcgttatttttttcatcagctctataatatatattatttttaattctattatcaaaagtgatataacctccttgacttacttccttttcttcttttgaatttaagtcatacttatttataatattaaaactattatccaacaaatattgactcttagtctttagattacttaattttaaaataacatcaccagtagaaaactctgcataaaattcatcttgtctaaaagaaatttgtacttctccgtaaatattaaatatatatattcttttgtttctctcagccataataaaaccgttatcgcaatacactattctctcatatataggtggaattatccattcatatttactatttatacatccatatttatagtttgttttatgctcgtctaaatttttatctgtcgtttttataattgcgtatgtgatattatggtgatataactataacacaatttatgagttttccgtattctttttttctctttgtaacacatctattgtaatcctacaattttgtcaattttttgattgttgccatattgacaatcaataaacatagttgtataataattgaatagccacgttgaaatggcgtaatatccggttcggcgtgaataataaattattagtaagggagatgtgtttatatgatgaaaaacggtgccgatatagttatggaatgcttgctggagcagggggttgacacagtctttggatatccgggcggtactattttaaacgtctatgacgcattttataagtactctcataaaataaagcacattttgaccgctcatgaacagggagcggcacacgcggctgacggatatgccaggagtaccggcagaacaggggtatgttttgcaacatccggtccgggagcaacaaatttggttaccggtatagccacggcctatatggattctattcctcttattgccgttacttgtaacgtcgccactaactggctcggcaaagatacgtttcaggaggttgatattgtcggtgtgaccatgccgataaccaaacataactttttggttaaaaaggcttccgatatagcgcctacttttagaaaagcgtttagaatcgctgcttcgggacgtccgggaccggtgcttatagatataacaaaggacgctacggcggagcttgctgattatgagaaaaagatacctgagaaggtagataattataaaatagatagtgaagtttgtgattttgaaagagcaataaaacttattgaagaagctgaacgtccgcttatatatgcgggcggaggaattatttcatctgcggcgtctagagaactgtgtaagtttcaggaaatgctggacgcacctgtcacattgtcattaatggggcttggggcttttccggccagcaatgaagcgtttaccggaatgattggtatgcacggtacaaaaaccacgtcgctggcaattaaaaattgtgatttactgattgcaatcggcgcgagattctcggatagggttatttgtgacccggggacgtttgccagaaacgcgaaagtattacatattgatgttgacagcgctgaaattgataaaaatatcaagactgacgcttatataatcggagatgcaaaagcagttttggatgagcttaacaagagcttatcaaagcaaaagcatcctgaatggatgaaggagatagcagagtggaaagctgagtatccggttaaatataagggcagtgagaaattttcacctgaggatataataaaaacaataaaaagtgcagtagatgaagatacatatttagttacagatgttggacagcaccaaatttgggcagcacagttttttgatgttgataagcccagacattttgtcacatcaggaggtcttggcacaatgggattcgggcttggagcagctataggaacccaggttgcaaatcctgacagtacggttataaatataacgggtgacggctgtttccacatgaatctacaggaattgtcaactgccgctaaagaggagcttccggttattgatgttgttatgaacaacaatgtattgggaatggtaaggcagtggcaaaggctgttttatgataacagattttcaaacacaacacttaataagcgtaccaattatgacaaggttgccgagggtttaggagccaacgcttttacagtttcgaatgttgaggagcttaaggaagctctgagcgaagcgcttaaatcgaaagataagccaacggttattaactgtttgataaatcaagaccatacggttctgccaatggttccgggcggacagtcgatagaggaaccaattcttgaaatcaaagaagacggcggggaggtttagtattatgagtgataataaagagatgcacgttctgtcaatttatgtcgaaaaccatgcaggtgtgctcagccgaatttccgggctgttctccaggcgcatgtataatatagacagcttgtctgtgggtgagacagagaatcctaaaatttcacgcatgacaattgtcacccatgctgatgacaatacattccgtcagatacagaaccagttggcaaagcttgaggatgtaaagcgcatatgcgagcttcacaaggatacctctgtactgcgtgagcatgttttgataaaggttaatgcaaaagattccacgtcaataatgcagatgtgtcagatattcagagctaatgtagttgatgtatcaagggagcttttgacgcttgaactcaccggagggcccagtaaaatcaacgcatttatagagctgatggagcagtttgatattgagggcttggttcgtaccggtctcaccggtctcaagagaggtaagtccgaaagacctgaagaattgaatcagaaaaacaattaattttaatatacactgtataaataaaagatatttggaggtatttacaaatggcaaagttatatcacgaaagcgactgtaatttgggacttttaggcaataagaccgtagcggttatcggttacggaagccagggtcacgctcacgcgctgaatcttaaagagagcggagttaatgttattatcggtctttatgagggcagcaaatcatggaagacagctgaggaagccggatttgaggtttatacatcagcagaagccgctaagaaagctgatattataatgatacttatcaatgatgagaagcaggcaaacttatataaagaaagcattgagccaaatttggagccgggaaaagtattggcatttgctcatggtttcaatattcacttccagctcattactcctcctaaggatgttgacgttatcatgattgctcctaaaggtcctggtcacacagttcgcagtgaatatgttgcaggcaaaggcgttccttgtcttgttgctgttgctcaggacgctacaggaaacgctatggatataggtttggcttatgctgccggtattggcggagcaagagccggagttcttgaaacaacatttaaaatggaaacagagactgatttgttcggtgagcaggctgttctttgcggtggcgtaaccgctttgatgcaggcaggttttgaaactttggttgaagctggctatgacccgcagaacgcatattttgagtgtatccatgagatgaagcttatcgttgaccttatttatcacggtggattcagcgagatgagagcgtcaatttctgatactgctgaatatggtgattatgagattggaaagagaatcatcaccgaggacacaaagaaagagatgaagaaagttctcacagagattcaggacggtacttttgcaaagagctggataacagaaaatgctgttaaccgtccgcacttcaacgctacaagaagaattaaagctgaccatcagctcgagcacgtaggcgctgaaataagaaagctgtattcatggaatgatgagaaataatttcaggaatacttatataaagtaaaaacagagggtttttacagagattgttttgtaattataacagtctgtgaaaaccctttttggtacataatagcggattaaattgcctgacagatatggtggtgaaacggcttggatttaactgacagacatattggtaagaacatagaggtatttgattctactttaagagacggcgcccagggcgaggggataacattttcggttgaggataagcttaatatagtaaaagccttggattatgtgggagccgattatattgaggccgggaatccgggttccaaccctaaggatttggaatttttcaaagaaattgatttaggttctttgagacacgccaagcttgtagcatttggttccacccggcgtaaagatataaaagctgaggatgacgaaaactgtttgtcattattgtcggcggaaacagaagcggtggctgtgtttggcaaaacctgggatatgcacgtaactgatataatcaagaccagccttgatgaaaatctcaatatgatttcggatactgtcgcgttttttaaaagcaggggcaaggaagttatatttgatgccgagcattattttgacggatttaagagaaacccggaatatgcggttaaggctttgatggctgccgcggaggctggggctgacagactggttctctgtgaaactaacggcggatgtctgccgtttgaagtagctgagattactgcggaaacctgcgatatatttaaagacagcattataggtattcactgtcataatgacagcggctgcgctgtggctaatactgttgcggcggttcaggccggtgcagaacatgttcagggtacgtatttgggatatggagaaaggtgcggaaatgcaaatctttctactattatacctaatcttcaaataaagctgggttataattgtgtgcccgaaaaaaatcttgaaaggtttaccagaaccgcgcgctggatttcagaggtagctaaccagcctttatacagaggtatgccgtatgtcggcggttcggccttttcacataaggcgggtatgcacatagacgcagtcacaaaagagtcgtcatcttttgaacatgtggcgcccggaagcgttgggaatgaacggagatttttgatgagcgaggttgccggccgcggcacggttcttaaaaagatacagaaaatagccccggtgcttacaaaggattctgctgaaacctctgagatatgcaagcgagttaaacagcttgagtatgaagggtattcgtttgaggcggctgaagccagctttgagcttttggtcaaagaggttttgggtgagaaaaagaagtattttgatttgaattattttaagacaacagttgaccagcctaatggaaataattttagttcttcagctattattaaaatcactgtcggagacagaactgagattacggcggcggagggagacggacctgtgcacgctttagacggggcgcttagaagggtgcttgaaggattttatcctgagctcagcggagttcatctgacggactataaggttcgcgtgctggagccgcagaaagctacgggcgctaaagttagggttttgcttgaaagctccgatgagagcggaagctggactactgtcggagtatccacagatgtgattgacgcgtcttggattgctctagttgagtctgtggaatataagctgatgaaggaagaagaaaaaataaatcaggaaacaggaggttaaagatatgggaatgacaatgactcagaaaattcttgccgcacatgccggtcttgacaacgttaaagcaggacagttaatccgtgcaaaactggatatggtattgggaaacgatgttacgactccggttgcaataaaggagtttaaagcggcaggctttgaaaaagtttttgataaggataaagtgtctatagttttggatcattttacgcctaataaagatattaagtcggcggaacattgtaaaatgtgccgtgagtttgctgttgagagagatgttactaatttttatgacgtgggcgaaatgggcgttgagcacgcactgctgcctgaaaaaggtttggtggctccgggtgaggttattataggagccgactcccatacttgtacatatggagcggtgggcgcgttttctaccggggttggttcaacagatatggcagcaggtatggctaccggtgaggcttggtttaaggttccggctgctttgaagtttaatcttaccggaaagcccggaaagtggatttcaggcaaggatgttattcttcatataattggaatgattggcgttgacggagctctttacaaatctatggagttcaccggagacggtcttaaatatttatctatagacgaccgtcttactatggcaaatatggctatagaagccggaggaaagaatggaatatttgaggttgatgatataaccgaggcttatcttaaagagagggttagccgtgaatatacagtgtatactgctgatgaagacgcagagtatgagaaggtgtatgacattgatttgtctgagctgaaaccaactgttgcatttccgcatctgcctgaaaacacaaagacaatcgaccaggttggagaagttaaaattgaccagtgtgttataggttcatgtaccaatggcagacttgaggatttggaaaaagcggctgaggtatttaaaggaagacatgtagcaaagaatgtcaggactataattattccggccacacagaagatatatcgtgaagctatgaacgagggtctgtttgatatatttatggacgcaggctgtgtaatttctactccgacttgcggtccttgcttaggcggacacatgggtattctggcagagggagaaagagcgatttctacttctaacagaaactttgtgggacgtatgggccatccgaaatccgaggtttatttatcaagcccggtagtggctgcggcttcggcaatcaaaggttatatttgcagtcctgatgaattatagaaatatagattgatactataataaggaggttttttcaaatgaaagcacatggaaccgtccataaatatatggataacgttgatactgatgtaatcattccggctagatatttgaattcgtctgatccgtcggagctggcggctcattgtatggaggatatagattcagattttgttaataatgtgaagcagggagatataatagttgcacgcaacaattttggctgcggctcatctcgtgagcacgccccaatagcgattaaagcgtcgggaatcggatgtgttattgccgctacttttgcccggattttttaccgtaatgcgataaatattggtttgccgattatggaatgccgtgaagcggcagaaaatataaatccgggtgatgaggttgaagtggattttgataccggtgtgattaaagatataacgactggcaaggagttcaaggcggaaccgttcccggaatttataaaagacataataaataaaaacggactgcttaactctataactaaagagaattagtatatatattagcggcggtattagtcattattttatcagttgggttttgccgccggaataatgaattattagattttaccattacagaaaataaacaagcatgataagaatgcggcaaaggctgcattagtgaatttgaaaggattatgatgtcagatgaatattaaattagcagttgtaaaaggtgacggaatcggacctgagataattaccgaggctgaaaaagttttagataagataggtgaaaaatttggtcatagctttgaatatactgatattcttgccggtggctgtgctattgatgagacaggaaagcctcttcctgaggaatctgttaaaatagcaaaggagtccgattcggtacttttgggagctgtaggaggaccaaaatgggatactctccctggcaatctaagacctgagagagcgcttttggggctccgttcagaacttggactttttgctaacataagacccgctaaactacatgatgcattggcagacgcatgtccgttaaagccggaaatatcgaaagacggacttgatttggtgattgttagagagcttaccggcggattatattttggcgacagaggaagacgtcacagcggcaatgatggtgaagaggcttatgatgagttaaaatattctgaaaaagaaattgaaagaataggcagagtcgcatttaatcttgcaatgaagcgtgacagaaagaaagttacaagcgttgacaaggcaaatgttattgagacctcaagactttggcgcgaagtaatgcacaagcttgccaaggagtatcctgctgttgagtttgaggatatgctggttgataactgtgctatgcagcttgtcagaaatccggctcaatttgatgttatagtaactgaaaacatgtttggtgatatattgtctgatgaagccagcatgacaacaggttctataggtatgcttccatcgtcttctttgggagttggcacttttggtatgtatgagcctattcacggaagcgccccggatatagcaggtcaaaataaggctaatcctattgccacaatattgtcatgcgccatgatgcttagagacagttttggacttatgaatgaggccaaagcggttgaaagcgcggtaactaaagtgctgaacgatggatacagaaccgctgatataatggatgaaggcggaaagctcctgggaactaaagaaatgggcgataagattgttgaaaatctttagtttttaatttgtttagaaataaattaaagttgtagggctgtaaaagaataaagtcgtgataataaatcatacaaaaaactctataattgcgcgaaaacagcgctcttttcaaggtcaaagcctgaaaagagcgctgttttttgtacaatgtttttgaaaaatatagtattttatatcccatttttgatttaaatacagtaaaaaatagggaaccgaattccggttccctataaaatttatgaaaggaatgaatttttaatctcaaatgctgctgacaataaattatatcagtttgtctatgcttccgagattataaacgtttgtaaatcccatttcttttgctgttttcagtgccttttcagctcttgagccggcgctgcagtagaaaatcaaaactgtgtctttgctgtaagccgagagaccttcttcaatcgtgtcgaccggaatatttactgagccttcaacagacttttctgcaaattcttctgcagaacgtacgtcgacaaatattccgccattatatacgagagtctcagcttcatcggcttctatggaatctccgcctatgtcgctcatgttgatttccatatttttatttccgtcactaacgtacattatgccgttttctattctcatctctttaatatctatgtccgcagctttttttagcttgtagcacttcatgcaatcagtgaaaactataactaatccatcatcgcatcctgcataaagtctgcccttatattcagctaaattgtttatggtgaacttatctccatattgaaaatctatgtcagattcatagaaaaagtcagtgctgagttgcatgcgaatgccgcctgcagctatagtaaatacttttgtttcgccggttacatcgtttttggtaagaaccacgtcagtgtttccccattttgtgaactgtacaggtctgtcttcaccggctgcttccgtatcgttattgttggtgttagaatcttgtatgctattatcatttaattcggtgtttgtgttcgaagccgaagttccataatactcaacaattattgctgatacaaacttattgcttccgcttccgtaagtataaactggtgtggatatatcggttatttcagcgctgaaagctgtctttttaccagatacagatcttccggttgccagtttaacaccgttttgaacaatatattgttcgcgtccttctccgccgtcaaataaaactgttactttacatggagctttaggagtgaagtataaacagcgctgagtttcgtgtcccataccgcctttccaagctcttgtgaagctatagtcataagttttttcatttacatccgtatatgtgtatttacagctgctggaggaattttcaagtgaactgtatccgcttaaaccattaactgttccatagggctcaccatctgttgaatttgatggactggttaattttgtatagtcgtaatccttgctgtcaagtgaataaactactatttcgctgtcagccggcgttttatatgttttttctgttttttgactgagcggtttcatttcattcaagctgttccatataaataagttgactttatcgccgtctttggctccggtagaaatttcatattcacctgagccgttaacttcagttgttaacatatttttgagagcgccgtcagggctgtaaagcgctgatatcatagtaaccggagatgacagtgtgctgccgcggtagctcagtgtcactttcatatttccgtttgttttgtttaatactttatcgattacgtatggttcatcgtcattgttttctatataattcattctaaagtagtccaaattggttccgttagtctgaatatagacggttgcgcatccgtatttgtcaagctttccatttaacagagcgtcattcagaactccgtggtcgagatttaattctgcctcggaccatttattccaggctcctgtagctggtacggaagctgaggcaataaggttttctgaattcttatttttatcgagacttacgtatattgttccggcatttttgcccgcatatctcacttttagactgtttaaattagaaagtttaatcgacttgtattcaatccatgcatctcctgtgcttccggcgtcaagaccgccgctggtaccggattgtgcatctgtcaaatctgctccgttaccgttatcggcatattcgccttcaacttgcatattgatttgaaccattagaaggccgcaggtcattgattcaatattggctgctgttatttgaactattccgtttccgtatacagtaagaacacctgtctcgctgttaatgtcggcaacttttcgaattgagttgtcaaatttctgtatctgccaaacgagttttgaattatcaatagcattgccatctttatcataagcttgaagctgtattcctgtatatggagaagcgttcgtaacagttccggctgctccgtcataaattggtattccgtcttcgcgataatctataacgcctttttctatatattttggattttctgatataatgctgtagtcattttttagattatccataggtattgaattcaggtcgttgattgctttagcaagtgttgtgcttaaatcatcttttgttgtgactgcatctaaagcggaaactgcgttattgtaaatatcgtcaatctttgcaagattcgattcagaataagcctgtctgggaagtttatcatatgctgttttgaggtttgctttcgctgcagctatttcttccatgctaggtctaattttcagttcatttacaactgtgtatgaatctgattttgtaataccgtttacagtgacagatgcggtaattgttgcgataccttctgttacccctgatgttactataccgttagcgtctactgccgctatgtttgaatctgaactttgatatataacatctgaatttttaaggtctacccatacttcatctgtcattatagcagaaagttttgagtcgatttttgttatcgattccaaacctgtaccatcttcgcggattagaccgtgtacggttataccgtccggcatcgtttttacagtttttagagttgattcaagggttcctgtaacgttaaagttttttgttaaagcgttggcgtcagaagcatttttaccaattattgcggtatatgtgccattaggaacatatgttttttgatccttttcactgaataagtttaagtctttaacatttaatttaaattcaacagttttgctttcgccgggagctaactctattttttcaaatcctttaagctgtttagcaggtataattgaatctgtttgcggatgtgaaatatacagctgagcaacttcttttcctgatgtagttccggtattttttatatctgcgctaaatgttaaattcccgtttgcatctgcattttcggaggatattttcatatttgaatattcaaaatttgtatagctgagaccataaccgaatggataaattgggacgccggtataatattgatatgtatggcccggattttttccgtcactttggatattgtagtctgtatagtatccttcaatgccgtcaatagtctttttggttgagtttgcaagttccatttttgaaatatcggcatttttataccaggttgatgaaagtcttcctgatggattaatctgtccggtcaatatttttcctaatgcagtaccttgtgtctgtccattgtagcaggtccaaaggatcgctttacatttattcatgaatggttccacattcatttgacctactgtctgcattacaacaacagtcttttcaggataagcttctgcgatttgctgaacatgagcctcgtgagatggaagattaatatcatttctgtctttggattcagaagaatccgcgtctccaaaaccttcctgcttaggtatagttccggcgtatgcgataattacatctgcagcgtcaagttcatttttatatgtttcaactgagaatggagctattgccgggcttgcggtaatatacatatctgcaacatcactatagccgccgtcttcgcctgtgtatgcagcttcacaagaaatatatgtgttaaggtcagctgtagcttgtgatgaaaccgatgctacggtaggtccgccttgaccgtatgatatattaaatgagccgcccatctgtgtgcctgttgccatttcgattttaacagaagcaacatctttaaagtccacacttgggatataggctgaagcttttggcgtcatatttacaaattgtccgtttgacagtgtcattccactaacatttttggcttttgagatatctacatttcttgtttttccattctttaatacaagagtgatgctctttacattaaagagtttttcattttctgaaactgcaccaagatgttcaacctctgtatctttatttacgtttttaaattcctgagtgataccttctatcggagtaactgtatcagtaggagttcctgaataatcaccaagaacaagtttgtttgctaagtttcccacaacagctaccttggaggctgtatttttaacagggagaaaatcattatcatttttaagcagaacccatgactcctcagccgctttttcagctatgtcaacatgttcctgtttctccagttcgtcttttgtaatatctgagtatcttgagccttggtcaaattcacctgttctaaatctctgcaagaaaagatgatatacaactgtctcaaggtattcttcactcatatatcctttttcaactgcttcaacaccgttagtagtagcagcacatcctccgcctaaataacattctatatccatacctgagagaaatggctgtgcaatggcttctgcgttagaaacattgcttgaaccaagcataccttgcttataggccgcatttttaatcatatcttcaccggctccgcagtcgcttgttacatatccgtcaaagccccaatttcttcttaaaaggtcagttaagagatatggatttgcagatgatggtttatagttatataaaagctttccgtttctatatattgttgtagcgttatatgacgacattactgaagcaggcattgcttcttcagctatattttggaatacttttgtgtagtaatttctaaaattatattcagtcattactgatgagccgccgcggcggttcttttcgttattgtttgctgcaaagtgttttaatgttgagatggtttttaaatatttttcgtcatctccctgcattccgttaacaaattgtattcccagctgacctgtaaggtaggggtcttcaccgtaagattcttcatttctgccccatcgtggatcccttgccatatttacggttggactccaatatgataagtcagtattcggatttttggctcttgcttctgttgaagtagcgtcggctacttgaaataccaaatcacggttccatgtatttgacatagaaagaggtgaaggaaagctggttgctttgccttgtcttgctactccgtgcagagcttctctccaataattatatgaagatacaccgaggcgcggaatttcagatgctttgtatccaatctgtgaaactttttcttcaagggtcattcttgaaactaagtcagccgcgcgttcttcaaatgtgtaatttgtatcaaggtagattggtgtttcctgattcggatcagttgtcggagccggtgttgcagttggcaagttcgggtcagttgtaggctttggtgtggcggttgccgcttgactgttatatagttttacatatatatagtttccgcagtatgtatttgcaccttcgccagtaatgttaagagtgataagaccttcagcatcggttgtagtcagagtttgagtaaatacattaaaagtctcccagccgctggtgttaatattgcttaaagaagcaatttctgtatctccggcttttacaacaactgcagcgtttttctcgctggcaacgtataagtcaagtttgtcgtatccggaatttttcaagtttacacttggcaatgtgagaaccgcaatactgtcgtcattggttctgagattatccggtcttaaaattccgccgtgttctgagtcggtaacaatatcgcccctgttgcctttaacggtgatagaatcttgtccaaaattaagcattactgaaccgtcagaattttgggttaccgttccatagtcagtggcagctgtacttacctggttgttttctgtgtttgtattatcttcaatgctgactgcagaagccgatatcgctacgcatgacaatgccattgccaatgtcagtattaaagcaatacatcttttcattttcataaaaatacctcctgtttttttatttttattttatattttatacttgtattttaacatcaatcactgtataataacagtcaaacaaattatagttttagtcaattattgctatgtaatgagtatttttgggcaggcttgaaaatggttccattttataaattttaaacgatctgaataactataaagcaccttgagcgtaagttaagtttttatcagcatttgcacgaacatattaatataatatatatttttaataagggtcagcatattaatatagatacaaaagattatgtttaagcgccagtgagtctgctataatcttctctgacacagtttataaatattatcgtttgttcagttttcccttcagacacttttaacagagcttttaaaagtgtctataatatgtctctatgataatataagggaagtagaggagaactttataaatataatgatcaaaattaatgttttttaatgcggattaagctgcataatgtttggagcaagttgtgatattttaaattgcttctaaataaaattataaataaaagataattttaaaattaaaagtgtttatagcaaacagttttataaggcaggataatagaaaaaacagctcttaaatttaagccgttttggcaaaattaagaactgttcatatatgttttgattcaatttattgtttgataactatttttctgcagtttattttttaacataaatattgtttgcttaacttatacccaaatttcatctaagcttccgaatgtgtaaccttcggataagatatattgaataagacgatcgagaacgtttgcgttatcagatgaacatgcgtgaagcagcattactgcgccgtcgtgaagatatggcgctatttgcgtgaatgctgtatcagctcctttttgatttgcagtatcccaatctgagtatgcaaaactccagaaaactgttttatatcccatatcatccgcaagctgaagagtacggctgctgtagcttccttcaggaggtctaatataattcatattaactccaaacatttcagcaaatctattggataactctgaaatttgataagctgcggattcgggagagactgtcggaagaataggatgtttaaaagtgtgatttcctactgtataaccatagtccagcattctttcaactaactcagggctttcttttagataatcgcctgtaataaagaatgctgcgggtatattatatttgtttaagacgtcaataatttgatttgtgtatccttcctcataaccttcgtcaaatgtcaaataaatttttttaggtcttgcggtgtctctgaatattactttatgatttgagattaaagaaaccacgctgctgtctatctcagaatagccgggcgcttttctaaaccaccaatcgtttctggtgttatctatattgtaatacgatgaataatcggatataataggttttggttcgggagaggcttttgccagcggctcataatcagttgaagaaaacgcgtttatccaagctttcatagccttaagctcaggaacccaatagacttcgccaacttcattaagttcttccagacgtatgaaagaggagccgcatgcgttgtatacatcaatgctttttccgttaaacatcagcctagtgtcattcaatgtgtaacgtgaatattgtatgccggttttttgggccgggagcataacgttatctatgccgctaatctgagtttgattattttctgaagtttttaaatcaagattagcagtgcgcgtttcttcatcccagctcacgtcgaaaccatagtattccaaatcgcggactttaacaacaatatatccggtgtcagaagcatatgcaggtataggatagtggttgatatatgctgaaatatcggtatataataaacgtccggttactgaatcagcagatactgggaaagtatatactgatgttgtaatgaatatcataaaagaaactaagagcatactgatttttttcataagtaccaccttttatataatgtttaatatgtttccgcataaaaaatgcgggttgtgtttaaaatttaatgatgtaaaaatatttgcagttataaaaatatttttatctatacgaagacttctgctaacttattttttgcattttacaagcagcatcattggtcttctaagctcgtccgacattccgggaatatccatcatttcaggcggcggaaccgcttcctgaaccgcctcgagctgaaatcctgtttttattaaacccattaatatttgggtcagagtatgatgctgtttaactacttctttacctaagaagttggtttgccgttctcctgtataaaagtaattgtctattggccagtattgaatactgccgtcagagccataaatccattcctgatttacgcttccggtgaaaatcgggtgctcgatattaaatataaaagttccgccgggttttaatgttctatatacttttttgtaaatctcatcaaggtcatttatataatgcagaacgagatttgaaactacgcagtcaaatgtgtttttcggataagagaagttatccaagccgcatacttcatacttgattttagggtcgttatttttcttttttgcttcccgtatcatgttttcgcttaaatcaatacccaagatttgtttggctccgttttctgccgcgtatttgcagtgccagccataaccacagcctaagtcaagaatagttttgtttttcaggtctggaaataattcttttaactggtgccattcgcctgctccgccaagacctttctgacttcgaggcatttttgaatattctttaaaaaaatctttgttatcataaatattattcattttgtctttccttttttcaatcggagattaaatatatctcttgttatagttttttaagttttttagtgaaaaaataactccgtttgattctttaaatcctgcactgatatgaaacagtcggatagtttcgctgctaagttctcaatcactggcaaaaccaaaacagcatttatagcccattgcacacattcgtgcagtagtttttttgaatatcctttagcacggaaaatttcttttataaaaattccttcaagacacccaattgggctaatttcagttccttcaaaataattatatcataattggcattgtgcaaatccgaccggtatcagttcttcaaaaacgaggaagataacagagtttttggggagagataatctatgaaacttcagttttcaaagattttattatatgattatctaaaagcattgcggtcaaatttgcctgtatatccaggcagatagagttgcatttctaatcattttaaaaagtcacctttcaaacgctttaagtgatatactattttttatcttttttatttttaatctcatcttttctggctctcagcatggcctcggttgcctctatttcttcttcagttttaagctgcggaataaaacttgacgcaacctttcccttgccacgtgttcttatgtagaaaaatccaaaaatagagaatattattgcgccgagacagttaaccaacatatctttcattgtatctattaagccaatatccaaatatgaaccggttatggcataatcctgcggaacaccgtttattgttcccgatatgaccgttttggtaatatcttttattatgatagggtcgtttaacccactggggttcagcaaaacagaggaaatgtttggaacataccagtctttttgcatgtcggtcagaaaaaactgatccattccatattcaaaaaactcccaaatgacgcctatagtcatggaaaagcaaaacgccacaaacgctacgaaaagaggagacatattgatatgaaagtgcggatcctggttaagaatatctatcatagcaaaacctatagcggccatcataaatccgtttatggtatgaaggattgtatcccaaagcggaattattgtatagaagctttgaatctctcctaaaatttcggcagaaaaaataaaaaacattattacggcctcaagagcaataggcagttttatatttaattttctgtccacaaatgatggaatcataaataaaatcaaggtcagtacgcatgtaaagacatttgcatagttttccataaagaactgtcttaccataaccaaaatgaccaaaatactaagtatagtatgaattatttttcttttatcccgcttctttttaagagatacgtcttcattattaattcttcgcataatctctccccttttgaaattacaaatatagtctaattatatcaagtttagtcatcaaagtcaattatatatattttactgccggtaaagataaattttaagacaaaatataactgtttacttttattgttccaaatgttataatttatttattaaattaatatgtttggtattatattagtatgtagatatattgggagggaaaggatatgaggcaaaagatacagaagaagatgtttgaattttgttatctgctggaacttttaatttcctgcgtgataggtatagcagttgtgattttaggcgtcagattattccttgagatgataaacctcagcgtgttcagcggcggggataaaatattagagactattcttgacaaggcaatgatacttgctatcggtgtagagtttataaaaatgctttgccggcatactcccgaaacagtggtggaagttcttttgtttgcgattgccagacagttggttttggttcataaatcagctttggatattcttattgaagtggcggccattgcagcgctatttgctataagaaaatatttattgaccaagcgcgatgagagggaaagcgttggtgatactggaaagtctaaattaaacttttttaagaaagaggaagaagagaacaaaaaagttgatattctatgataatttaaaatttcgcctggctgaatgtcaggcttttttattagatttattttgtgttttaaattataaatgggtgtcggcggagggcaagataattctatattttcgataatgatactgctgcttagcgatgtaaacaaggtttaaaaaataacattaatgtttgcatatttgaattattgacactataggaatatcaagcagcagtagttgccgcattgagttttttatgtgaactaaatagttgtgtaaaaacggcacgctatatattatagcgtgccgtttaatatttaaactgtatttattttttatttgccggtgcgataactttataaactaatgccgctaaaattcctccgaccagaggagcaacaatgaacacccaaacctgtgccataggcaggctctttcctgcaaacagcattataagcgccggtccgaaacttctcgctgggtttactgaagtgcctgtgaatggaatacctaagatatgtaccagcgtaagggtaagccctattactaaaccggcaacagcggcgttttctattttagacgtaacgccgataatagctatgacaaatacgaatgtcaggattacttcaaccaggaatgcctgccacatgcctatgccaagagcacttgcttcaccaaatccgttttgacccaaaccattctcggttcctaaaagtaaagctaaaattgcagctccggctataccgcctaaaaattgtgaaataagatatccgatataatcgtttaccgtcattttacctgaaaccagcataccggttgaaactgccgggttgatatgacagcctgatacgtttccgatagaatatgccatggcaacaattgataaaccaaaagcaaatgctatcagtaatgtagaaagcgccagcgcgctgccggtcataaccaaattggcgtcaccaatcagattgttggcagcaacagcgctgccgcagccaaagataaccaatacggccgttcctataaactcagacaaatactttctcattttacttcctcctctaaagttttatttattaatatatatttaacttacagatgatattataccatatttttctaagaaattcaataaaaaaagacggcaattcagccgtcttttgttaaatttgtattactttttattcaataatttcagcttttagtccaaaatgcttgaatgcggcttcgagctggttgtcaacaattactgtagtgttctgtagcgcgttatacaactctctttgtgttgttaagtcaagcacaccatatgggaagagctcctgattgttttgaaactgagctacagcgctttcaagttcgctgtcaaaatacgggtcattgatgtttccgttatacctgccccagacattcagtatctttttagctttggatatattagcatcgctttcgccgggattatatattctgctgtaatcaaagtcttcgtaacctgaataatcaaacggcacggaaccattctcaacaacggcgtcaggcgttattcctattttatcaatattttctccgctcggcgtcagataatatgcggcagtatatttcatagcttcgccgtcttttaatgagacgctgctctgaactgtccctttaccgtaagtttttgttccaatcaaaactccaacttcattttcttttattgcggccgccaaaatttcagaagcgctggcagagtattcatttaccaatacaactacgtcatttttctgagttctctcattgttagacttgtatgtaatatcaaaaagatcaactttgtggtcctcagtaacgattacgtttccattcggaacaaagtagtttgctacttttaccgcctgggttatataaccaccaccattatcgcggacgtctataataatattatttatattctgactgtcagcctccttaacggcagcgtcaaactggtctgatgtattgtccataaaaccatagatttttatatacataacattagctgaattctgttcgttttgttcatcgggagcggaaacaattttatacgccactgattgtttctcaccgatttcttctctggtcaaagtgaagtacaaaacgtcgtcgacaccttcacgtaaaactccgacggtcacaggggatccaacctgacctctgatatatttctgtgcaacttctatgctaacgccgagaagattgttgccgtcagcactgtagagtgtgtctcctgtcaggattccggctttagccgccggggaattttcgtatactgaacctactatcaggtttccgttcgattcattaaatgttattccaataccgcctacggctccctcaagctgtgaaataaactgttcaaattctccgcttttataaaatacggaatgctcgtctattgagcctaaaatcgcactcataacggtttcataaagttccggatgctgttttaatatctcgagcagtcctgctttatataatgacagttggttaacaccatccttagcatagacagaaagatagtctataacctgacttacgtaatcagatataaattccccgtcttgagactgatctgcaggagccgcagtcgaaacagctgtttcaggctcgtccgccgttacggttccgccaaatggtagaaccaaacaggaggccgctatcgcagcggctaacaatcttttgaaatttttcatattatacctcctaaaataataaggggcagaaagcccccataaaatttatattatattgtagttattgatactattctataaccgccgccggcaagagtggctactgtaacttttacattcatatccaaaaaccatgcaagggaactgaggtccagttcttcaccattgcttccgtttttgatattccctccaaaggcaggaatttcagtatattcaagctgtgcggcaatagcagtgttttcttcattcacaattacaggttttacatttttaagaacgattccctcatctttccagtcagataaaaacagaacaccggtatatgacgataggttcgttattatcttgttttcatcaaacgcaaaggccggcatggctgaaactattattaatgcggcaataagcagtcctgctgttagtttcttcataagcacctcctacattttttcaggggcagtaatcttaagcatattcagaaccccggcaataacttgtcttgtgcagtcaatcaatttcattctgcagtcacgcaggtcttcgtcctcaacgttaacacggcaggcattataaaacgtgtggaaagcggaagccaaatccataacataacgcgtcatttttgacggctccaaactttcagccgatattcttatctcctcaggcaaatcgctgagcttctttaataaatccagctcggtttcatcagttaaaagttcgggctttatttcggcgtaaggtttgacgttaattccctcttcactcagaaggctcagtattccgcaaatcctggcgtgcgcatactgaacataaaataccggattgtcattgctttgttcctttgcaaggctgaggtcaaaatccaaatggcttccggcgcctcgcatattaaagaaaaatctagccgcgtcaatgctaacgtcttctaagaggtcgttcagagttattgcctttccggtacgtttagacattctgacaatctctccgtcctgcataagacggacaagctgcataagcacaatttccagtctgccggaatcaattcctactgctgagagcgcgtttttcattctggcaacatggccgtgatggtcggctccccaaatatttatagcaaggtcaaaatttctggtttcaagcttgtttatatgataggcaatatctgcggcaaagtaagtaggtattccgttttggcggacaagaacctcattcttttccagtcccatcttttcacagttcagccaaacagcgccgtcttcatcataagtatatccgtttttgcgcagacgttcaattgcagacgttacctcgccgttcttgtgaagaaggctttctctgaaccacacgtcataattgattctatatttttccaagtcagttttgagtgctgatatatttttttccagtgcataatctatcaaagcctgcttgcgttcatcttcgccgcagtccaggtatttgtctccataaagctttataaactcttttgcgtgttcggttatgtctccgccctgataaccgtcttcagggaactcaactgcatcctcgccttttaactgctggatataacgggcactgagcgacttgccgaacttttcaatttggttgccggcgtcgtttatataaaattcacgcgttacatcatatccggcgtattcaagcacggaggccaaacagtcaccgagagctccgccgcgggcgttgcccatgtgcataggacctgtaggatttgcgctgacaaactcgaccatcacctttttgcctttgccgagatcaatctttccgtaatcactgccttctttttcgatagattccatagttctgtacagccagtcaggggcaaggtaaaagtttataaatccggctcctgcaacctcgatatcttttatatctccggacttgtcaatattcgaggttatagcgtctgcaatttttctaggcgcggttttgagctgttttgccaaaaccatggctatgttgcaggcaaaatctccgtgagatttgtccttaggcacctcaagtttagcaaggctgcttatatctatattttcatcggtttcaggcaaactgccgtttgatacggcctctttatagcctgcgctgattttttcgattatttcactttttataccgtctatgatactcattcggttttcccctttgtaatcgtatatagttttattattaaatattttccgccgacggttttctattaaattccgtttcgcatttcaacacagaaacatcagaaaaccggagcggacaactaattaatttcagattttgattccgtgacgctgtctgttctaactgtaaccgtcatattattctttataaaattttggttgtcggcgtctaaaagataattcatattgagagttccgccgttatcgccaaagtcaaaatttatattttcggtagttattgcggcgccgacttgtccatacggcgtatttatcagacagagacttttttcacctgtcagataattcatttttgaagtataacgtccgcttctgcgaacgctcacgttaccgtcgctgacttttatggtagtggtcgtatcttcaaaaccggtcatgtcgctttcatcataaattatatatattttattgtttctgatagcatatttgccgactgtatcgagagcaattgtctcctgctcaccgtctaactcctggtttgtgcgtatggatataactgcattgttttccatattttcacctctcagtatttttctatatcgatttttgcaacgtcgccctcaatttttttagagagaaaaaggcttccgagttcttcaaatccgtgaactgtgtcgctgacataatattttgaattgcccatatcattgctgccggacagaagtccgtgcatttccatcatcctcttagcttcaccggccgcagcggcgcctgaatcaatcaaggtcacgccgtccccaaccacatcttgtattgtctttttcagcagaggatagtgggtacagcccagtataatggtgtcaacatcattctttagcataacgtcaagatattcctccgcaagcattctcgctattttagaatcagaatatccattttctaccaccggaacaaacatagggcaagcattagatatgacttttatttcgggatttaagttcccgattttttcggaatattttccgctgtttattgttccgctggtgcctaaaactccaatacgtccgtttttggtagcattcactgccaattttgaggcaggttccaccactccgataatatcggtgtcgtattctgttgtgatatgcggaagggcggcgctgctggcggttccgcaggctatgactataaattttatatcaaattttcttaaaaaatttatgtcttgccgcacatattttactatagtagcggagcttcttgtgccgtacggaactcttccggtatcgccgaaataaattatgttttcattcggcattatcttcatgacctcgcggacacatgtaagacctcctagaccggagtcaaaaatacctattggtctattatccattatatatcaccttatttattgtttttgtctagggcgtaatttataaggttgtcaagcagttcaaagttgccgacaccgctcttttcccacattttagggtacatacttatggaagtaaagcctgggagagtgtttatttcgtttaatctgactgcaccgctctccttgtcaacaaaaaagtcaactctagacagaccgccgcattcgcatattttatacgctcttatcgcatagtctttgagtttggcttcaacgtctttggtcacattggcaggtatggttattttggaactgctgtcattatacttagcgtcaaaatcataaaactcattagccggagcaatctcaccaatattttcggcaaccatagggtctgtgtttcctatgaccgcgctttcaacctcgcttgcggcaacgaattcctcaatcaggactttactgtcatgttcaaaggcgagattcacaccttcgataagctcttctctgttatgcgccttgctgatacccacagatgagcctgcgtttgaaggttttataaaacaagggaagcccagtttttcttcaacattttttatccagttatcatttgaaatatccgaggttttgacggtaatccagtctgcttggggtatccctgcttctttaaacagaattttagccacgcatttgtccatacaaacagcgctgcctagaactcctgaaccaacatatgggattccggcaatttcaaataatccctgtattgttccgtcctcgccgtttttgccgtggagaacagggataataacgtctatttttatattttcaatgtctccattatttttaaatcttaaaagccctttatcgctgcgtgagggagaaaggatagccttgtcatattttccggccggcagagtggatatttcagacgtcggtttatcaaaatacatccagtttccttcagtatcaataaaaatcttatgtatattatatttggcagtatcaagagagtcaataaccgtagcggcggatatcttgctgatttcatgttcgcttgacacgccgccgaagatgacgcatatgtttaatttttccaaataaataaccttctttccaaaaagtttcatgttattgcggatttgacagccgcagcactaaatatctattttaacatatttcgcgataatttcaataggtataatttataaaaatatgttaaaaatctataacatgatataacttatggaagaataggaagtttattacattaaaattttaaagagcaaaagttttaggaggaagaattatgccaaaagtaaatttgatgagagtattcggagttatctgcgctgccgcgctggttcttgtcacagcagtttcttatatttcgtggcaggtcaacgatattgaggatagtgtgctcagattacatatcgttgcaaacagtgactcagatgaggatcaggcgcttaaacttaaggttagggatgaagtggtggaaagatgcggatttttgtttgaaaactgtgtttccgcggaacagtcaatcaaaaccgccgctgataatataggatttataaaatatgttgctgagcaggtcataaccgaaaatggttataattatgatgccgactgtcaggttacgcagtgctcttttcccacaaaacaatatgagcggccgggagacggagtggtatcacttcccagaggggaatataatgcgttaaacataaaaataggcgccgccaaagggaaaaattggtggtgtgttatgtatcctccgctatgctttgttgacggggttgcaagcgttccggatgagacggacgagcttttaaaatcccagctgactgcgtctgaatatgagctgataaccgagtcagaccgtccggaaataaaaataaagtttaaaattgcggaacttttaggcggacagcaggactgagccggcgttcataatatttaactattgatatttttcacccaatatgttataatttactatatttctgcggggtgatactgatgaaaaatattaaatacagactggcgaatttgttaggtcttaatactgacgcgtctttgtttgaaataaatcatgatgaaatacaaaaaacaaacctattgtttttgcagcagatttcttttacatcgggtttaattatgctgctgctttatcttgttagtttagttttgccgtctatagccgatttgagaatgacttattttatggaatttttagtttcggcaattatatttgttttaacctgcgtggcttttgacgcactgctgccgtattcgcttgtgctgacatattttttgacgtcggtgataatggcgtatggcgcgatagccgggatttatcaaactccggagggcactgcaacggcttttattgttttgatttcgtttttgccaatgcttatatttgataaacaatcccatgttctgcctttttcggtggttttatggctgcttttctgtggtgcgacatttatgcttaaagattttaaatattcttcatttgatatattgaattcttccgcagggcttttaatgggtatcttaataaacgctaagatatttaaaataagaataagcggaataaacagcagcaggattttggcaaggcagacacaggttgatgaactcacgggtctgcctaactataaaaagctgcttgaggatttgtcgggaaagaacgatacgaggattgcaaaatctctctgcagtttggctattattgatatagatatgtttaaagaatacaatacaaaatatggacgggaaatgggagataaatgtcttagaaaaataggtaattgtatgctgaagatttctgacccgggtgaacttatcgtctacaggtatggcggaacaagtcttgttgccgtcagtctcatacatgattataagggaatacagcgggtatgccagggcttgtccgtccttataaagggtcttaatattgagttccagggaaccgaggaagaaaagattacagtaagctgcggttataccgacgttgtggaatgcgagtgcgacgagtttgaaaagcttttggatatggcaggcgaagctttgcagcaggctcgcaaagacggaggaaactgcagcgtcggctacttacaggtaaaagcgcttaaggaaaattaatttataatatgcggaatataataacataatttgggtgaagctgtttgattcatatgaacttatttgttggggaattgaacagctttttgtgtatgaaaaaataatttaaaaagacagcgtttggttaaaaatgtatttaaaatagttgaaatttgtggtgttgctttttaataaatacaagttgtcttgaactctgttagttgtgtttttcatttaaaaattggaattatagttgtcgtttttaataatagaattctatattttagtaaatatttgttaaaggggggggttgttatgaaatttaaaaacctgtatactaatgaggtatataaagaaaagcaattgctggctgataattatgaaaaagttgttgatagtaataatgactttacaaaggttatacttaaaataggcggattttgcttttttatgctttttattacgtctatgtttataccatcatattacaatctgagaattgtatattttagcgtatttttgattttagcagctttttatcttttgattaaacttcgtgagaagtatgttgggatttggagcatttacgtcgttttcacagctgcggttgtatgtttcactctaacaggctcttttattaccccaaatgatattggggttatggttttggcgcttttacttacatttcctattattgtacttgataaatcaattagaataatacttactgagttttttttcttggtattttatattagcatgatttatttacataaagcgccgtcgctggttattgatgaaatagttaattcaattttttcttttgtgttaggagttaccttaggtgaatattttagaatcgtcagactaaaaaattttgagcttgaaaggcaagctcatattcgtgaaacgacagatgttcttacacagctttttaataagcgtaaactttttgatttttttattgaatatgagaatggtgtttataaagaaccagttacagctatgtcgatactggatattgatgactttaaactatataatgatacttacggacatcagaccggagatgattgccttagacaaatcgggttatgtttaaaaaaattagaagggatttatcatttaactttttatcgatacggaggtgaagagtttgtagcggttttacatgatcctgatattgcggatataagcagtgtgttcgaaaaaataaatcaagccgttcggaatttaaatatttcacattctgctgtaagtaaaggtgttgttactgttagtattggagtggtacctataaaatataactgtaaaccaaattttgagcaattgcttgataatgccgacaaagcgttgtattcagcaaaacgaaccggaaaagataagactgtaatattttgtgatgattttaatgaacctgatattcatggacattacagcaaagttcatacataaaagttaaaaatataagttataaaatgttttaaaaatgaaaattctgtaaatttacggttacatggtcaaatatatcaatagataactaagtataaatataaaaataactttatataaaaaatagaaaaatgatatatttaaagtataatataatagtcaagtgaatatttttataataaaatttgcggctgaaataaatttcagccgcagtttattaatttaggcgtttaataaatgtataagaattagagcgccgcagaggtttaatcgacctaataaagtatctttattttccaaataaaaaattggttcttattgttttgtttaatttatatagataaactatgatgctaaaactctaattattatttaataaaatctaaaatttatccgctgccggcatgtcttgctgtagtttttgcagagtaaagtccaataagtagatgacaaattataaaaagactcttgttagaaaaatagaaaataatctgaaatagtaagttttttaatttattttatatgaatatttgatgtacatgattaaaataacataacaaaaaccataataaaggattgtaaacaggcaattgacaacgcgtaggtatttgtaatacataataaaaatttggtaatactaatattcggttaacactttattacaaatcaagcaaaattgacacaaaataaaaaaaggtgatataatataagttaagctctgtacttattttaggaaaattctggagagtgcagaggtatatttattttgtgaaacttgtaaattcagagtattattcaacttaaatttatatatagaggatgaagagaatgattcagcatattaaaaacggtgtggatttcagattaattccagcacaaaagtttaaaacaaatgttatcagtgttttctttaatattccgctttcaaaaagcacagtgacaaaagcggctttgctgccgtctgtcatgaaaagaggaacagaaaagcacaaaaccatgaatgagatatcaaaatatctcgacgaattgtacagcgcaactttgcgcgccggtatcaggagcaagggcgacggcgaggttatatacttcactgttgagtatataagggataagtttataggtgagaacctgacccaaaagattgtggacttgctgaaagaatttatattctgtccgcttgcaggcgatgatggttttgttgaagagtatctaaacggagaaaaagaaaatttaaagaatgctattgaggggcttataaacgataaaaaggaatatgttgaggttaagtgccgtgaagctatgttcggaggcgagggttacggtatgtttgaagccggttttgctgaagaattgccgaatattacctccaaaaacttatatgatttttataagcatattataaacgatacaaaagtcgatatttttgccagcggagatttttcggacgaaactgtggaaatgctgaagacggagctcgccggagaatttgagcctagagattcaggctatgttaagactaaaatcgctgttccggaaggaaaagaaataaacagaatagttgaggaaatagcagttgttcagagtaagctttgtatcgggttaaagtgcggtatagaacctacaagcaaagaatattatgcgcttatgctcggcggatgtattttcggcggcagtccgttttcaaaactgtttaccaacgttcgtgaaaaattaagccttgcatattatgcttctgtgagaacagagaggtttaagagcacaatgtttatcagcagcggtattgaaactgataaatatcaggcggcctatgacgagatactggttcagtttaataagatgaaaagcggtgatataactgacagcgaggtagtgaattcaaagctgtatctgactaatggtttcaactccatgaaagacggtttgagaacaatggaagactattatctatctcaggccattatggataataagggcgagatagacgacctgatagaaatgaccaataaggttactaaagaagaaattgttgaagctttcaacaaggtagagatagatactgtgtattttcttaaaggctgtgcaagtgacggaggtgacgaataatgggcggatacaatattgaaagactgtatagcgagaacttagacgaggaaatgctttttgcaacgcacagcagcgggcttagagtttatgtgttcccgaaaaaggggttcagtaaatattacgctatttatggaacggactatggatcaaccgatagagagtttgttgttccgggagagaatcagaccactgtgatgcctgacggaatagctcattttcttgagcacaagatgtttgaacagcctgacggcagcaacgcatttgacagttttgcgctgacaggggcttccagcaatgcgtttacaagttttgacctgacagcttatttgttcagctgtactgataagttttatgagaatttggatattttaattgattttgtaaatcatccgtattttactaaggaaaatgttgagaaagaacaaggaataataggtcaggaaataaaaatgtatgacgacgatcctggctggagggtgttttttaacacgcttaccgcgctttttcataataaccctgtaaaaatagatattgccggaaccgttgatagtattgctgagattgacgatgacgttttatataaatgctataatactttttacaatcccggaaatatgattttggtgctggcaggagatatagaaattcaaaaggttttagagagccttgataagcatatcagttcagacagaaatttgggaatcatagaaagacctaaaattgctgagccggaaagccgtgtgaaagagtttactgagcagaagctggttgtatctcaaccaatgtttcagataggatttaaggatataactccttttaacggcggagaagagcttttgtgccgtgaaatttcaacagatataattttggatatactgttcggaaagagcagtgatttctatatggaattatacagcgatggattgatagacagcagttttggggctgaaaccgagcttgaaaagcgctatggcttcacaatgatcggcggagaatccaaagaccctaaagaggtctacagaagagttaaggagcatattaagaaagcgcaggatacgggactaagtcatgatgaaatagaaagggctaaaaaggttgcaaaggcttcgcttattaaagtgtttaacagtattgaggctatgggaaattcatttattcggcttctgtttaaaggggttaatcctttggagtatgcggcggctatagattccgttcccgatgtggcggtaaacgagcgccttaaaaaccactttgatttgtcaaactgtgttttgtcaacaattttgccggacgatagccaaaatgagggggagaaataatgataaacaatatttctttccccaatttggggcttgatttcagcataaaccgtgcggctttcagtataggaaatgttaatatctactggtatgggcttataatagcgctgggaatgattattgctcttgcttacggcatacgcgaatttaaaaggtgcggattaaagcaggacgaccttttaaatatgtttttgatttgcgtgccggttgctataatatgtgcaagactttattatgttattttcagctttgaccaataccgggacaatctgctgagtatttttgatattaggaacggcggtatagcagtttatggaagtttaataggcgccggtattgtggtgcttgtatattgtctgaaaaagaaaataaatttgggagcggttttggatattcttgctgtcggatttttgataggacaggcagtagggcgctggggcaattttgtaaacggtgaagcatttggaacggctacaacactgccttgggcaatgacgattgcgtccgacggggttacatatgcggagtctgtgcaccctacttttctttatgaatcattgtgggatttagccggggttatcatacttcttgtttacagaaaacataaagggtttaacggagagatatttttaggttacattctttggtatggtattggaagattttggatagaggggcttagaaccgattcgctatacctaggtccgcttagaatttctcaggttgttgctcttatgtcagttttcttggggcttgcaggaatagccgccgggcggtttttaaaacataagaatatcaaaatcagcgttggaaaaccgaaagggactgaaaagagcagtcttgaagaacccaaagacgataatgatgacatagatgagtaatattttttgcgttaaaaattattttatttatattattttatgggaggattatattatggaacaggatattcaagtattgagacagcggatggctgagttggttaaaaatgagaacctgaaatatgatgatatatataaaatgaaacttgagatggatgatataatcgacaaatactattttgaacagatttaacaaaagtgactgaaaactttcaaagcagctgaacactgcaaataatatagtaccagtaaaaattgtatgttcggcgcttatgttttgacagggatgctgactgatgtatttgaagattattaattacgataacgtcaaaaatacttgacagaaacagtgtaagtatttttaaatgatttcctattgacctgttgagactaatatgttaaacttgtattaagatagttattcgttctgaccacaagggtttgcccgcgtgaaaaggcgaaggataaatggctgtcatgcgtttttatgacaagtttacgtgcgtgcatgggcgccttttttgaataaatcaaataggtgacagaatcctttcgctttgcgggaggattttttattttgtaaagagggtgattaaaatggaaaatgtaaaaaaacttgaagatacaaggatagcgcttgttggaattattgtagaaaatcttgatatcactgataaaataaatcgtataatccatgattacagtgattatatagtcgggagaatgggtataccgtataaaaaccgcggtgttgctattataagtcttgtaattgacgccccggtgaatataatttcatccttgtcgggcaagctggggatgcttgatgacgtatctgtcaaggttcagtatacaaaagtataaaacacagtaaatttttataaggagataatattatggaaaactataagtatgatgtgaagtcatcaaaggcagaggaatttattaatgacggagagataaacgatacgctgaaatatgcctcagaaaataagacaaacagaacgctgattaaatcaataattgaaaaagcaagggaaagaaaggggctgaatcacagggaagccgctgttcttctggattgtgaactggaggacttaaaccaggagatgtttgagttagccagggagataaaacaaaagatatatggaaaccgcatagttatgtttgctccgctgtatctttcaaattattgcgttaacggttgtgtatactgcccgtatcatgcaaaaaataaaaccatatgccgcaaaaaactgacacaggaacaagtgagagcggaaacgatagcgttgcaggatatgggtcacaagcgtttagctttggaggccggagaggatccggtcaacaatccgcttgaatatatactggaatgtatagacaccatctacagcataaaacacaaaaatggcgctatacgcagagttaatgtgaatatagcggcgactaccgttgaaaattataagaggctgaaagacgccggaataggcacatacatattgtttcaggagacttataacaaagaaaactacttaaatcttcatcccaccggtcctaaacatgattatgcttatcatactgaggctatggacagagctatgcagggaggtattgatgacgtgggctgcggcgtgctgttcggattaaatttgtacagatatgactttgttggtcttctaatgcatgccgagcatcttgaggcagcttttggggtaggtccgcacactatcagtgttccgagaatctgtccggctgatgatattgatgttgaagacttttcaaacgctgtttcagatgagatattccaaaagataattgctgttattcgaattgccgtaccatataccggtatgattatttcaaccagagagagtcaaaagagccgtgaaaaagccctgcagcttggaatttcacaaataagcggagcgtcaagcaccagcgttgggggatatgtggagaaagaaactgacgaaaataacactgcccaatttgacaggagcgatacgagaacactggatgaggttcttaactggctgttggagcttggatatatacccagcttctgcactgcctgttatcgtcagggcagaacaggagaccgttttatgcctttggcaaaatcgggagttatacagaattgctgtcagcctaacgcacttttgacgcttaaagagtatcttgaggattatgcttcagaagataccaaaataaaaggcgacaaagttattgccgctgaagttaagaaaattccaaatgataaggttagagaaacaactattgattatttggataagattgttcatggaagccgagattttagattttaaattataaacagccgcattttgatattgcttcaaaagttagaataaaaatcgagcttttgaagttagttcatttgcggctgttttttgtattttataataaaaatatcgtgttaatggagaagtgttactgtgtgctttcaaatgttattatatgcactgactttttttattaaacctgaaatgttagtaaccccaattgagttgtgaatatgtaaaatgttaacttattccgacaaatctgcatcaacattaatatataattaaagcagattttttgctggttagacgcgcattctaggtaagttttaaaatttactctatgttcatatcacacgctcatctatatatgctaagtgtgtgatgacaattatagtatacagaattttgttaaggtttttttattcaatatcaaaaaattacttagttgtgataatatacatcccgctattttcatcttgaatctgcgcttcaagatgaaaagccttgaactttcccgttgactttgtaaactgcctcgaaaaaagatttctcgaattccggttgattacttatcgaaaaactgagttttcagtataaaaaatacacagaaatgaggattttcagtgaacctcggaaggtgtgaccccacctgacgggtgggtgtgatacaaagtgctttgttttatctagcctgcaatgtcaattgtggctacacttttgtttaaaagtgtatgctatataaaccatataatgtcatataaactataaacgccgataattaacttagttgtcatataataaataacttagttgtgatgtattgcaaacgtagtttgccgcgttaggtgggctattatctgaaaacgcagtgctcaatattatatactttccaggttgaaaaattattattgcgttacgtgaaaaaataaaattattctgttaacaaatataaatataataaaaaacaaagataattttatataaatcgaaaaatatttataccgttataaaaaatgtgtgtacgtcaatcctattttattgtttattttgttttttaaatcccattgcttttttagaattatgttattataatattatatgaaggctgaatcttttcatcattgaaaaaggtttggtttttcattttagtttaacaaatgtttgttagacggggaaagaggatgaatatgggaaaggattttattatagaaaatttaaaaaacgccggaaaaaatattaaagaaaattttaaatcttatacattggattttatttttatagtgttgtttatatcagtgtttcaaacagtatttggtcaggaaaataatatagtcggagttatattaactatattgatggcttcatcaatgatgagagatttgacttctacgcctttaaaacatttagtgattcaatcttcggttttggtggctatggcggtttctgcctgtttggtagtgattcttaacccgtggattgctcttataattaattttattatgataacgataatattatattcttttacatatgagtacgctagtaatctatattttccatatattttatcctacttgtttatgatttttattggacctgttaccttggaacagctgccgaaacgtgttttgagtatgctggcgggcgctctgtgtataatggcatatcagtttgttaaaggaagaaaacgggttgttgatacaacgagggattcgctgactgtaataatagacgaggctttggtttgtacccagtgtttgattgacggagccggtaaacctgcagatttagaagaggtccgcaaaaatttgtataagctttgtaaaatggtctatgagcgcagaaaaagggttttatgtgtgtctgacgccaactttgccatgatagacagtgccaggggattagaaaatctaatattggttttatatgaaatgaccggtccgataacgcctgacagaattgagattttaaagaaagttaaagaaaaacttaaggaattccgtgcatttgtgcagcgtgaagtgaattgcttaaaagatatggatttctctgattttgccggaagcaattcttcggcggagactgaagaaatttttaggtgcgtagaatatatagctatacatttaaaacgaatgacagatcctaaacgtcgggttaaataccgccgaactgttttatcgtttgcggtgcgtttaaaggcggcattaaatctgagtcctgttcgtgttgtgtatgcgcttagggttgcagttttgctctcagcggcaactttaatagttcagcttttaggactgccccatggaaagtggcttttgtttactattgcctcagtttctttgccatatgctgatgatgttgggaaaaaggcgagacagcgttttacagcaagcgttattggctgtgtaataggtatggcctcatatgctttagttccgtcagctgtcgggcgtacagctctcatgatgttttcgggatatatcagttactatttttcgggttataccggaacatttgcgtgttcaacaatcggcgctttgggcggggctgtctttatgaacggttttggctggtatgacgttgggagcatggctgtggttcgaatagtgtatattgcagtaggaattctagcagcagtggcagcaaaccgtttgatattgccatttagaaggtctgctgcaacaaaacagctctggaagaagtatgagaatacggttaaacttcttacggtgatatgtgaaagtgacgatgcagatacacaattgtattacagtttagtaatacagtcgcacctgcttgaggaaaaactgttggagaatgctattaatgaaaattggaatggtattgataatatgcttagcgagtgccgagctttggtgcgcagcgctcacaggaaaaattcttttggtactttgattgcaaataatctcagctagttattatataaacttccaatttttatttatactattggcggcggtttcaaagtgatattttagaattcccaaatcgatttttgagtaagcgccgccaaaagacttaacgctgacttctaaatcattgagtgaaaagaaaaatttttgccggttcattgctgttggtgccagcatagcggaatttactcctgctaaaaaccagtcggggatgttttcattataatcgcagactttttctatgggtttgtttttatgcggtttcccttgggtctgaccatagcctagagtgattacgcagaccagtttttcaccgtctccggcagtatagctgcttttctttttcttatatgttgcagctacccagcaggtattaagacccagctgttgagctttcagcactaagtgttctccgtaataacctattttttcatcaagattaacatctgatttgctcaccatggcaaaatagtttgtaacatttttgaacatgccgtagtgtgccgtaaaaccactgaaagcttccggttcattagtaatcagctgtatattgagattgcttttgtgattgcaaacttctacctcagactttagttcctctataatattatttgggataatttgattagtatattttctaactgaatgacggttatttattgcttctgaaatattcatgaatattacctcctttagccaattatacacatataaaaatgaatagtcaaaataattttttataggataaaatatgattttgtcaaatggacagattatttggtgtttttgttgttacaattgaacaacatatagaaatgttcataaaaaatcgcttgacatgaatttaacggtaacttataatactatcattagataaattcacataaagataaataccatataacctatatggtgtattatagaaatgaggaaaatgtaatgaatgaagaaaagaaaaaagctcttgaccttgcactgagtcatattgaaaaacaatatggatccggcgctgtaatgcgtcttggagaaaagcctgatgcaaatgttgaggcaatccctaccggggctttgtcacttgatattgcattgggaatcggcggaatacccagaggcaggattattgaaatatatggacctgaatcgtcaggtaagacaactgttgccctgcatgtggtagcacaggtgcagaaaatgggcggagaagcagcgtttatagacgccgaacatgctcttgaccctatttatgctgaggctttgggagttcagaccgatgacttgatagtttcacagccggataccggagaacaggccttagaaataaccgaacagcttgtaagaagcggtgcggttgatgtaatagttattgactctgttgcagcgcttgttcctaaagcagaaattgaagggcttatgggtgattctcatgtggggctccaggcacgactgatgtctcaggctctcagaaagctggcaggtattatttcgaaatctaatacaactgcaatttttataaatcagctgcgtgaaaaagttggggttatgtttggcaatcctgagactactaccggcggacgtgcgctgaaattctatgcttccgtaaggctcgatgtcagacgtatcgaaagtcttaaaggcgacggcggagttataggaaacagaacaagaataaaagtagttaaaaataaggttgctccaccgtttaaagaagctgaatttgatattatgtatggtgagggaatatcaagagaaggaaatatacttgacgttgccgttgatatggatatagttaaaaagagcggctcgtggttcagttataatgaggaaaggctgggacagggacgtgaaactgttaagtctattttaaaggataatcctgagcttgctgatgagatagaaaataagattcgtgaaagcgccggactgcctatgattggagaagaggcggagagcatgtttgacgaaaagcctgttgcaggattagaaaaaccaaagaagaaaaaataaattgttttgaaaacttctatttaggtaagtgataaaaatgatggatgagatattaaaagggaaaaaacttgctatgagatttctcgcttcaagaatgtatacctcaagagaaatctttgataaactgcgccgtaaaggttatagttcagaattggcggagagtatagtaagtgaacttatcagtgaaggttttttagatgacaaacattatgctgactgttatattgctgatggtgtaaacataggatacaaggggacttttcgtatcaggcaggaactcttgcgcaaaggcgtatcgtcttcaataattgaccgcgcgtttgatgaggctgatgttgacccggagaatgctttgcgtgaatttgtaaagcaaaggctgcaggttgctgatattactacaagaaaagagtatgaaaaattcagaaccatgctggcacgccgaggcttttcactcagtgagataagaaccgttttggatgagttcgatatagagttttacttagaggattagattgaaatttaaggagaaagccgatttgaaaaaaatatctatggcgtcgctcggatgctcaaaaaatcagatagacagcgaacaaatgctgtcaatacttgaagaagccggttatgagatttgtgagaatgaagaggatgcaaatattataatcgttaatacatgcacatttattgaggatgctcagcgagaatcgattgactgtattcttgagctttcacaatacaaaaattccggcaatgctgaattattgatagtaaccggctgtcttgcgcagcggtataaggagcagatattatctgagatacccgaggttgacgcggttataggaactaacgagtatgacagaatagccgaggttatagaaagctgcctgaacgaagacgataaacctgttaaatgttcggagaagccgcttctttgtgagcacgaaagggttcgtaccacccctggatatacagcttttttaaagatagccgagggctgtgataaccgttgtacatattgtgttataccatctatccgcggaaattatagaagccgtaaaattgaggacattttagatgaagctcataaaatggctgaggacggagttaaagaaattattgtaatagctcaggacacaactagatatggtattgatatttatgatgaatatgcccttccgaaacttctcagagagctttgcaggatagacgggatagaatgggtgaggattcattattgttatccggagcttgtgactgatgagctgattgatgttatagcagaagaaaacaaaatttgtaattatcttgatatacctattcagcatataaatgataaaattttaaagcggatgggacgaagaacaggtaaggaacaaatagttactttgttgagtaagctcaggaggagaatacccgatatagttataagaacatctcttatcgttggatttccgggagagagcgagtctgactttttggagctgaatgagtttgttgaaaaagctgaatttgacaggctcggcgtatttacttattcgagagaagaggatacgcctgcatataatcttcctgaccaggttgatgaagaagaaaaagtgcgccgccaagaaatgataatgtttacgcaggcagaaatagacgatatgaagaatcagaacaaaatcggaagtattgtcaaagtgcttgttgaagggcgtgatgaaataataaaaagttattacggcagaacttatgcagattccatggagatagacggaaaagtgttttttaaatcgggaagaaagcttaatgaaggcgattttgttgatgttaaagttgaacaggcaatggatatggatttatttggatctgaggtataacttgtgcaattaatgatttataaaattgttttgtggaggaaataatatgaacttacctaataaattaactttgcttagagtgatactgataccattgtttatgattttattcttgagctgcggcactgttggtttatatttagccttggtgacttttattttggcggctgtgactgatttttttgatggtcaaatagccagaagaacaaacagcattacaacatttggaaaacttatggatccaatggcggataaacttttgacactgggagcattagtttgttttttggctgcagatgtgccttatataaacgcatgggttttgataataattattgcaagagaattgattgtaaccggtatgcgtatgctggctcttgaacaaaacagggttatttcagccagcttctttggaaagcttaaaactgtttcacaatttgcaatgattattgtggtgctgataaatcaaatagtaatggttggaaaagatccattgcaggggggattcggcaattttcttgtaatgatattggttataatctctgtagtgctgactgttctttcagggatagattatgtatataaaaacagggaattgttaacgtttaagtaacggggatgttacatgaatgtaacatgtattgaaattttgagagttttatattaatgtgttagcgatagataggaatgagaatatgaatataatagtagacgcgatgggcggagacaacgccccggaagaaattgtaaagggctgtataatggcagcaaatgattttggtgaaattattacactggtaggaaaaaaggatataatcagcgaacatttaaaaaaggccggatataacggagataggataaagatacaaaatgctgaggaagtaataagcggagacgatgagccgactaccgcgataagacagaaaaaggattcgtctttaagggttgggcttgatatgctccataaaggtcagggagacgttatggtcagtgccgggaacaccggggctttgataaccggagccactctgatagtcaaaagaataaagggagtaagacgcgtggctttggcgcctctaatgccggctgaaacaggctgttttttgttggtcgacggaggagctaatgttgagtcaagcgcggcattcttaaaacagtttgcaataatgggttctatatatatggagaaaattatgcatattaagaatccaagagtaggattagttaatataggttctgaagaagaaaagggaaccgaggatgttacagaagcaaacaggcttttgaaagaaataccgataaactatactggatatattgagggccgtgaaattccatgcggagcggttgacgttgtagtgtgtgatggatttacaggaaatgtaattttaaagtttatggaaggtatgggaatagtaataaaacgaatgttgaagggtatttttttcaaaaaccttaaaactaagattgcggctcttatggttaagggcggaattaatgagcttggtaaaactcttgattatactgaatacggtggagctccgcttttaggatgtacaaagccggtagtaaaggcgcatgggagttctaatgcgaaagcgttttatcatgcaatcagacagtctatagatatggtgaacaataatctagtggacactatttctgaaaatataaataaatattgatttaaagggatggattgatgcttcggcatagaatagtgttaaaaaatctatgctgtgaaaatattataggaaaggcaatgatgatatgagtaaaaagcatgcaaaaattgtgggcgtaggcagatatctgcccgataagatacttgataacgcttattttgagggtatagtcgaaaccagtgatgaatggattctgcaaagagttggtataaaagaacgccgaatgagtgatgaaaatacatttgcttctgatcttgcggcaaaggcggcagaaaatgccttaaaagacgccggcatggatgcgagtgagattgaccttattgttatggcttcggtgtcgccggagatgtatacgccgtcaggcgcatgtattgtgcaaagtaagataggtgccaagaatgctgcggcctttgatgtgaatgcggcgtgcccggggtttattttcgccattactgtcgctactcagtttgttgaaaacggagtttataaaaatgtgttagttatcggagcggatactctgacgaaaattactgaatataaagacagaagcacatgcgttttgtttggagacggcgcaggcgctgcaattttgcaggctactgatgaagagacaggggtcttgggttcagttttaggtgctgacggcgacgcaggggacgttttaactgtgtgtggattaaaagtttctgagcttgataaagagagacgtccgtttggaaactacagaactatttggatggacgggcagttggtatataagtttgctgtgaagacaatggtaagttcgacaatagaagtggttgaaaatgctgggtatacgattgatgatatagatttggttattcctcaccaagcgaatcaaaggataatacaaagtgccagaaagaggctgggtcttgatgaaagccgagtattttccaatgttgagcagtttggaaatatgtctgccgcatgtatcccggtagctttgtgtcaggctatagaggaaggcagaataaaaaaaggtcaaaaattggttatagtgagtatgggcggcggtcttacatggggcagtgtgcttattgaattgtaaacatgttctttaggaggaaaatatgaacagaatttgtgaattacttggtatagagtatccgattatacagggtggtatggcttgggtggccactgctgaacttgcggcggctgtgtcaaatgccggaggtttgggattgattgcggctggcggtgcgcctgctgacgtggtcagagagcagattaagaaagccagaaccttaacagataagccgtttggcgttaatgttatgctgatgtctccgttttccgatgaggtaatggaagtggttatagaagaaaagccggcagttgttgccacgggagcaggtaacccgggcaagtacatagaaagactgaaggaagccggaattaaaattatgccggttatagcgagcgtagctatggctaaaagaatggaaaaagcgggagctgacgcggtaatagctgaaggaaccgaagcaggaggccacattggtgagctaaccaccatggttctcacaccgcaggttgtggacgcggtttctattccggttgtgtctgccggcggatatgctgacagcagaggtactaaggcagcgtttgctttgggcgcagacggtatacaggttgggactagatttatttgttcaactgaatgtattgcacatgaaaattacaaaaatgctgttttaaaggccaaagacagagacgctgttgttaccggacgttcaaccggagcacctgtcagagctttgaaaaataagctgaccaaagaatatcagagacttgaaaaagaaggagcttctgccgaggagatagaagaacttggagtaggcggtttaagacgcgcctttcaagacggtgatattgaaaacggttctcttatggcagggcaaagcgcggctatggtgcatgagatacagccatgtgctgagatagttaaagattattttaaggatgttgaattttaaatatattgttgtatattagatagagttattgttttacatatgcggtcttatccggctcacggtaagaaacgcggtcttataacaatgtgagccagaaaggctatgataaatatgaaaacagcatttttattttcaggacagggagcacaggctattggaatgggtaaagagctttgtgagaactttcctgtagctgacgaggtttttaacagcgcaagcgaagctttgggatttgatataaaggatatggtttggaacggtgataaggacactttaatgataactgagaatacacagccggccatcttgactatgtctgtggcggctttaagagtggctgaaagtttaggtcttacaccagatgttgttgccggacttagtcttggagaatacactgctcacgtagcttcaggaagcatggagtttacggacgcggttaagcttgttaagaagagaggcaagtatatgcaggaggaagttcctttgggagtaggcgcaatggctgcgataattgcgttaacgcctgaggatgtaaaagaaatatgtaagcaggcttcaagcaaaggaatatgtgagccggcaaactttaactgtccgggacagattaccgtggccggtgaggttgcggctgttgaatacgcgtgtgaacttgcaaaggaaaaaggcgctaagcgcgctatgctaatgcctgtttcagcgccgtttcactgcagtatgttaaagggcgccggagagaaacttgaaaaagaacttgaaaatgtcactgtatctgaaatgaatgttccaataattaccaatgtgacaggtgattacataaagagcaaggatgaaataaaagagcttttggttcgtcaggtttcaagctcagtattatttgaagaaagtttaaaaagaatgatagctgacggagtagatacatttattgaaataggacccggaaaggctctgagcggttttgtaaagagaatagataagactaaaactattttaaatattgaagatatggcgtcattagaaaagacaaaagaggcattaagcttataataaaggttctgttttttcagatagagttagataaatattttttgaaaagtttgactgccaattataattaacaatcggaggtagtgaaagtggagtttaaggataagtgtgttatagttaccggaagtgccagaggaataggcagagaaatagctcttaagtttggcgctgagggtgcaaatgtagtcgtgtttgatataaatatagacggccaggctgaaaccgctcaggcggtatgtgatgaaataaaagcattgggaggagacgctaaatacatattgggtgatgtctcaaaaccggatgatactgacgcactgataaagtttgcaaaggatgaatttggaagcgttgatgttatagtcaataatgcaggtataacaagggataatcttattatgcgaatgagcgagtctgattgggacgctgttcttactgttaacttgaagggagcgtttaatgttattaaatcagctacacgtactttaatgaagcaaagaaacggcgttataataaatatggcgtctgtatccggcgtgacaggcaacgcaggtcaggctaattattcagcttctaaggctggcttaataggtcttactaaatctgttgccaaagagcttgcttcgcgtaatatacgctgtaatgcaattgctccaggatttatcagaacacctatgactgataagctcagtgaggatatacagcagtcttacaaagattctattccgcttaaaaaatttggacaagttgaggatatagctaatttagcagtattccttggcagtgacaaatcagaatatattacaggtcaagtaataaatgttgacggcggacttgtaatgtgatataactatttatagtaaaaataaatttatataaataaaaatgaaattttattttggaggagaattgaaatggaaatttttgaaaaagtaaaggaaatcacagtcgatcagctcggagtatcagaggacgctgtaactatggaagcatcatttattgatgatttggaagcagattctcttgacattgttgaattaatgatggctcttgaagaagaattcgacatagagattcctgatgaggatgctgaaaagattacagcggttaaagatgctgttgaatacattaaagaacatcaagactaattatgcaataggctggactgcggagattaaaaaatctccgcgggtttccagactcggtatgaattatatagaagtttgcatccggcttgatgttatgcggtgcaagtctctatatgatttgaccgtgtctaaatcgtatttgattttgttttcctgcatatttttgcgggcaatggttatttattttgatgctgtgcatcggattgaaataggaggataaatatgaatagagtggttgtaacaggcgttgggggagttaccccggttggtataggcagagaagaaatttgggaaaatattaaaaacggtgtatcaggcattggcactattacaagatttgacccaacagattttgcatgtcatgttggagctgaggtcaaagactttcaggttacagattatattgataaaaaagaagctaagcgtatggacttgtttgtacagtatgcggttgccggagctaaaatggctattgaggacgcaaaacttgatatggacagtgaagacccaactagagtaggcgttatggttggatccggaatcggcggaataaacaccttatgtgaacagcataaaagaatgcttgagaaggggccgggaaaggtttctccatttatgataccgatgatgatttcaaatatggccgtaggtcaaattggaattatgtttaattgtaaaggtattaatatgactactgtttctgcgtgtgcttccggaactgattctattggtcatgcaatgcttgccgttcagcgcggagacgctgacgttataatagcgggcggagctgaggctactataaatgaacttgctttggccggattttcatcaatgaaggctttaacaaccaggaacgatatacctgagaaagcatgttcaccttttgacgctaatcgagatggttttattatgggcgaaggcagtggtattcttataatcgaaagtttggaacatgcgcttcagagaggagctaacataatagcagaacttgttggatatggctcaacgaatgacgcatatcatatgacggctcctgctcctgaaggtgaaggcggtgcaaggtgtttagcactggctgtcaaagacgccggaataaaacctgaagatattgactatataaatgctcatggaacatcaacaccttataatgataagtttgaaactgcagcaattaagactgtttttggggatcatgcatataagctggctgtaagctcaaccaaatccatgacgggacatatgcttggcgctgccggcggagttgagggaataattacagcacttgctgttaaagacgactatttgccgcctacgattaatctcgaaacccctgaccctgaatgtgatttggactatgttcctaataagggcagaaagtctgaaataaattatgctatatcgaattcattaggatttggcggacataatgcttctatcgtgtttaagaagtatactgattagtaaatacataatatcaggtcgggagggtcaatcctcccgatttttatatgacaaagattaagaggttatttatatggtgattataataggaggagcgagccatagcggaaaaacttttttatctaaaaagctaattgaaaagtataaaattccctgcactagcttagaccacataaaaatgggattgatacgcggttttaatgactgcggtttttcagcagttgacagcgatgagacaatagcagaaaagatgtggggatttatagaaggtttcatcagaacctgtattgaaaataatcaaaatacaattttggaaggctgctattttccgtgtgaaaaggttaaaaaacttttatgtgatgatttaactgttgtttttattgtattgtcaaaacaatatattattgaaaactttgataagataataaaatacgaaaagatagtagaagatagaaaattcccggagagcagagaaattaaattttttattaatgaaaatgagagactaaaggaagagtgtattaaatatgaacttccatattttgagataaccggtaattatttcgaaggactagaaaagatacttgaatatattaaaagtaaagcggttaaaatttgccgttattcacataatgatattaatgaaatatgtagtatgttttgcgataccgtgaaacatatcaacaaaagagattataccgcagaacagattgccgcttggatgggcggtatagataaagataagtgggacaaatcattatctgagcatttttctttagaagtaaaggtaatggggaagattgccgcgtttggagatatagacggagaatatttggatagactgtatgttcataaagactttcagggattgggatacggaaaaatcattttgattcactcgaagagcaagctatacagtcaggatttaaaaggatttggacatgtgcgtctataactgcaaaaggtttttttgagaaatatggttataaagtgataaaacgtcaacaagttgaaagaaaagatgttttattgaccaattatgttatggaaaagcattttgaacaggagtatagcaatggaatataattataaatttaaaaataaaaaactatttgatttggcaatgacgcatatttcacttgccaatgaccttcatatagaaagcaatcagcggcttgaatttttaggtgacagcgttctctcgtttgtggttgctacttatatttataatgaatataagaaggtggacgagggagtattgacagaacttcgcgcaaatgcagtgtgtgaaaagactttggctattgctgccagaaatcttaaacttggagaggatttaaagtttggaaagtctgaacgtatgtcaggcggaaaggataaagattccgttttggctgacgcatatgaggcgttattggcggctatttatttagacagtggaatagaaagcgcaaaagactttattatggatacaataggcagcatgataggcgatacttcttatgttgaactggaaaactataagtctgaaatacaaagttattatcaaaagcgtgatagaaacagagaagttgttaagtatcgtttggtaaataaaaatggacctgaccatgacccgacgttttttgtggaagcgctgtaccgtgatgaagtaatcggcaaaggcgagggaaaaaaccgaaaaagcgcagagcaggaagccgcaaaagctgcgcttgctaaggttaagggaagtaaggaatagctatgcgaaaatataatatacctatttttattcctcatgaaggatgcggacatgattgtgtgttctgcaatcaaagaaagataacagggattcaaagttcggtttctcctgataaagctaaagaggaaatagctcggtatctttcaacaataaaatctgaagattgtcagattgaaatagcctactttggaggaagttttaccggtcttgatatggagctgcagcgagaattcttggaggcagcttcgggatttaaagacgaacggataatcggaataagaatgtctaccaggcctgactatataaataaagaaattttagagcaatgtgtggagtttggagttaaaacaattgagctgggagttcagtcagccagtgacagagttatcgaactgaacagaagagggcatgtttttgaagatgtaattcgtgcggcggaaatgataaaatcattcgggatagaacttgggcttcagatgatgctgggaatgtatggctcagatccggaaactgatattgaaacatgcaggaaaattatagagcttgaacccaaatgcacacggatatatcctactctagtgcttagcggaacagcgcttgaaagtttatacagctgcggcgaatacataccatatactcttgaaactgctgtcagcactgcgaaaaggtgtttgctgatgtttaggaaagcaggagtagaggttattagaattgggctttatccgggagaagatttaagaagcgaggggaatattgtggcaggcccttttcactctgcatttggggaacttgttgaaaacgctgtatacaaggataaaattgaggaagagattatacagaagagattaaaggactgtgattatgagataatagcgctgtcttcagagacatcaaaaataattggacagaaaaagtgcaataaggagtatttttttaaaaaatacggagttagaataaaagtaaaaaaccggttagggtgaaattatgcttgagatggagatgaaagacgcctttttttggtatttggattcaaaatatgagaaagtaagagttatagaggaaaaggtaatagggaaatcgcgtgcggatgttgttgcggttttaccggatagaataatagggtatgaacttaaaagtgacagcgacagttatcagcgacttttaacacaggttaaagactatgataaattttttgatttcaattacttagtggttggagaaagtcataaaaaacatgctggtgaacatgtgccggaacactggggtattgtgacagtatcaaaggatacgggagtaaatattatgcgcgaggccgaacataacaaaaaagctaaaatgcgctggcagctgtcattgctgtggaggagcgaacttctaaacattcagctcgagaacggactgcataaatacagtcaaaaaagcaaatattttgttataaaatatttaatggaaaatgttgaaactgaaaaattaaagcgtcagatttgcaatgaactttttgagagagactatacattgctgtcagaataataagatttatattaaacaggataggttatataacctatcctgttttaatattagtattttaaagtagtttatttaaactctttgcctacagcaaattttatcattgcaataaaggctgaataatctttactgtcacttactttggtaaaataaccaattgtaccgcggctgttagtattgataaagcagaagaaccaagagtctgttgtcagaaaatctccttccatagtataacattgacggttgtctgaagaatcagctgtaagagcgacgcatttgcattcaatactgtaggtactgtcagcgtctttgaatatgataactgctgctttagttgaattattaatactttctattttaatttcttcgactatatcttcaaaatctaaatctgccttagtaataatatttttatatgcgttatacattacatctaaatcgggagcatcttctaaaaatgtattatcaattatgtaagttgattcggattccagctgaatgttaagaatagcacgttctattgccaaataccattcattttttatagtgttctttaactcttccggtttttcgtttagatagttataaaaattatttgtattataaagtaaatatggaagcaatgtctgttcatatgaatatctcaaattttctgctgagtcttttagctttttcatgtcagagtcagttaattcacttgctttaatagacccttcagttgaagtgccaggcgttggtttagtaactgcagcagaagtcggttcgggaattggtgaaggagtgttttcagatattatagctgtgggaaccggagctgttccggttataataacttgctgtgtttcttctatccagtctacagctgcatcaaggctttctgaaacggctcgaataggtactaaggttctatcttctatcattctggcgggcacatctaaaattatggattcctcatttttgtacattatattgctgtctatagttattttaatcgtattgacatcttttacagctattgcggtttgtgttgtttcatcccaagttactgttgctcccaaagcttcaaatatagcacgcattggaaccaaagttctgtcattttcggtgacaggatcaacatcaaaattaatttgttctccgtcaacaaaaacagttattacatcagtggatgcaaaaatctgaaatgacattactgccgtaaacagtgcgaaaattactgcagcgacagaaatttttttaaaattctttttcataataatccctccgtttatagtttattatattataaatgaaatgtaatattttgtcaaatattgtaatttaatttaaaaataataaaaatagtatagaataaattttaaatataacttaaatataatattaataagaaatgtgtttctgataaatcttaatccttattcttgtcaaatgaattttgaatttaagttgaattaactttatcggtatggtacaatttagtaaatagaatcgtgttcttaatttataaattataagtatttaagactcttataaattgttttataagaaaggtggagggagctatgcgaaaaaggggagtattattattttgtataataattttttccatagtatgtactgccgtcctgcctgtgtgggctgacggtgaaaaagtgcttgcttttcccggggctgagggcggaggaaaatatgcaatgggagctcgtgcctcagaaaacccggaagtttaccatgttaccactttggaaagtacaggtccggggtctcttacagaggctgtttcaaagagcaacagaatagttgtgtttgacgtcggcggtacgatttcttatgataaatggaaacagctccgtatagaaagcaatacaactattttggggcagactgcgccgggggaagggattacaattgaaggcactgatttaagtgatttcgccgggaagtcaaacataataatacgatatttaaaaataagacccggtgatagattggaaaaagaggtagacggcatatcaatgcagtatataagcgacgttataatagatcattgcagtgtaagctgggctgttgatgagcttgtctcggtttattcaggaagttccgaaaatcaaagatatgagcttggaaaaaatgttactgttcagaattgtttgatgagcgaagcacttaatctttcccgtcaccaaaaaggcgagcatggttatgggtcaatttttggaacagataattccacgctttaccataatgtttatgctcacaacaagtcccgcaatccggctatataccgtgaaattcagaatgttaatgtagccaataatgttatttacgactggggcgggacagcttcgtatggggggcagcctcattcaataaactatttgacttttaagccgtgtacagtgaattatgtaaataacttttatagatggggaccaagctcaggtgcggaggttcgaaatgttttttacaatattgaaaacgagactccggatatatcaaagtcaagtttctatttcagcggaaacgtaattgatggagttgatactattactaatgataatcttatcggagttacaaatctgaacaacgctgtgatcctggataaaccgattgatttgggtgagtatgaagtgccgcaggagactgcttttgatacatataattctatacttgatactgtgggcgcttcaattccaaaaagagatgctatagacgcaaaggttataaccgatataaaaaacgggacaggacatattattaattctccaaaagaagttggagggtatataaattccgaacctgtgtatagacgttttgagatttctcaggactggaaagagaaaaatggaatgggcagttatgcagaaagtgatattgtttcggaaggaaaatggaaaggttatacttggattgaagcatacgtatataatatggatgagatgagcgggaggcctacaaatcctgatgttgttgtacagtctcctgcaatagcagcgaatcaggataaggttatgggactaacagttgataaaggtgaatggaaagttataaatgaaggtgaatcgtttaattattcagcagttgcctttcctaaatcaggcactcaaataacaaaaattgagctttacgatggtgatatgcttatagatacagttgagtcggataagatagaggttgatatttttccgtcaagcggcgttcattattatacctgccgtgcgtataacggtaaaaatgagtctgcaaactcagcaacggcgattgtttgcgtaaatcctgccggagtagtgcctgaagaatttaaatatgaggttttaggaaccaaatggtataaggaatctgctggagcgtctatggatgagaacggtattatcacggtaggaggttcaggcagaataaaatctaagaacagctgcggatttttataccgcgctgtcagcggagatttctcggcggttgtaaaagttgaggatattcctaggtataaagacagaataagagctggacttatgctgacagataagcctgctgataattcaaaacttgctatgatttctgacaatttggacagaatgggtgagaatatttctattattactagaaaagttgaaaaagagaatatagctcaagtttatatgcgtaataaaaatggcatggaaatttcaaattcaaattcagattataatactcagcttgaccagtataggatacctgaatatttgcgcatagagcgccgagacaacctaataaaattttcagtatctgatgacggagctgattggactaacaatccgaggcagccatatgagataatgtttgagtctctgcctgaaacattgtatgttggtttaggagttgagtctaatccgggaacatacccaaaacctctctattcaatggcaaagttcagcaattttaaaattatagaatataataagcttgctgaaactgaacgctgggaaattgaagatcttagagataatgttgtaagcatatcaaataagttgaacgagggtgaaataacgcctgacggaaaacatattaatgtttatgcagctgtgtatgatgatacggaatccggatgccttcttaaccagtgtgctgtaggttcgtttactacagacaaaaacttaaataaatacgatgttcagcttgataccgggagcggaatattagatattagtaaaacaaagttgtttttgtgggatgacaatatgagacctgttcagctttttcaacaacaggattcttaatagattaaaagcacttaaaaaacttatttattgattttgagcgttatattttggtttataaaatcttaatttattgaccggattatggaacagttgtaaaatatattaaaaggggaagtttgtatgaggccaaaaagaatcggaggggtaaacccagctattcaattaataatggcagtatttctgctggtagtcggaattcttatgataacggcgcctgagtcttttattcgatggctttttctaattgtatctgttggcatggcagcttttgggtttatgtctttgatttcggctgtatttggaaaaaatggaactagacttggatcgcttatttcaggtatattgtatatagtaatcagtatagttattttaactcaaaaagatttttttcaagccgctgtcagcagaatttttagtttgctggcactggtgcaggcggttacaaatttaataagcggctttctgctttataatgataaagtgtccggatatataagaaagtttttttggggtatagtggcgtttggattttctgtattgttgttctttgacccacttggtcatattagggcagtcgaacttatttcagggatttatctgatagtttttgctgtatcaatggcattggagtgtatagatagttttcttgaaactgattatgcaaataaaaaggtaaagcccaaaatatctcttgcattaccaatagtttttgcggcttttattccgtcaagagcccttaaatatataaatgataagctggaatccggacagatggaaaaggcaaagttttcaaagcctgaagacagttatggcaagttagaaatttttatacacttaaaacagggattgatagaaggttttggacattgtgatttctgttttgacggaacggtgtactcctatggctgttacgaccagcactcgcagaagatgggcggttttatctccggcggaacagcttctttaacaaaaagagagccatatattgagcattgtatgagctatgaagaaaaaatgctggtgggattttcgctggaactgggccgagatgattatatgaatcttaaacgtgagatagataggatgctaaaacaaactgaagtctgggaaagcgacctccaaatcgcagaaaaagagggccggccggcggaggaacagaaaaagtgcaatgatccggcaagcgagctttaccgggcttccggtgcttcatttgttaagtttattgatggacaatataaaacttattttgcattaggctctaattgtgttatgtttacatacgatattatgaaaaatgcagggcttgatagtttggctttcagcggagctatcacgccgggaacgtatatggctcatcttcaggatttgtatgaaatgaaaaacacaatagttactgatatgcacgtatatagttatggtaaaacaaaaaactgattttttataggacaaagttacttttttatgacaaatttatatattttatttacataattgcaaaaatgagatatactactatatatagtggtctgaatggacggattttgatgtttttacaatggattgtggctgcttttgattaatatttaaggagggctgtgtatgcgttgcatgtattgcggacatatagacagtaaggttgtggattcccggtcaacagatgatggcacggcaataagaaggcgaagggaatgtttaaactgcggcaagcgttttactacatacgaaaagattgaaagtgttcctataatagttgttaaaaaagataaatcaagacaaagttttgatagggaaaagctggaacgtggaattttgaatgcctgtgccagccgcccggtgcctcttcagactattgattctatgattagcgacatagagagcgcgcttcataatactttgcaaagagaagtttcaagtgaaaaaatcggtgaaatggtaatggagcgtctcagagatattgacgaggttgcttatgttagatttgcgtcggtttataagcaatttaaagatattgaaacctttcaggaggagcttaaaaaactttctcagaacaagaattgatatattgatttaacataagcagtatggtgaaaattatatattttgataaagcctgagtgaaatttactttataacattcaggtttttttgtttgttttattgtaattataatatatatttatgttttttaggaaatttactgattgactaatcgtatacaaaaatgctataatacattatatatataatagattgaaaggtgatggatggaatgaaaaagaaaagtatgagttttatttgcactttattttgtttattattggggattgttatattccttggtatgtctttatgcgtatatgctgaaggcagccgtgatttaataaacagcgctgcaggtcagggggatagagcgtacatagagtatcagggagacaatatgctgagtgttggacttcagcggcagcaatatgtaaacgtatatatgttttccggtgagacagcatattttggcagcagtgttgctaaagcaggttcaattgaggtgacagacccaaaaggtgagaccgtattatatgatgttaacgcggcgggaaatggatttataggaagcataactagtgaggcggcaggtccgaattataatggtttaatttctggcggatataatcctatttcatttgttgctgatagaaacggtatatataaatttatattttacagcagcaattatagttcttcaaaacctaataattctactaatcctacagcaacaaaagtttctgacgataattttgttgctaatcaaaaagacgccgctataggagcatgggatgttaccgttgttgggacagcgggagacggtactgctgaagtaaagaccggcagaatgtatgccgactatttgtcgttaaacatgggggcaaatgagcgtagcctatattcaaaagtctatgttttaacatctgatggatatatatattatacagactttaacggaatagacccgtttgggtttacatttttcggaaataacagaggtcttgtatcatccagaaccaatatgtcgctttatcattcaatggaggatgcgatcacaagcggtaatacaccggacctgaataattttagagatataaccgacaaaaatggagcaaaggacggaatgtatctgccgggacccggcaatacgtcgacccagcttgattcctcgtttaaaatattttttaacgaaccaagcggtgagcttcctgatagtataaagccggcgcctcagccgcctggaactattgattatttaaaatttgaaggaagcgtgttagactcaaatggaaatataatcgaaaatgaaggctatgtcggcggcggtggatattttattataaatgccagcaaagtttcaaactttgaggttaaaattgatttgagcaatatatattataagacaaatacagaaggaaaaatagacgaaaataattttatatatgaatatcccgtgggcagcggaaattatatgagtatgaaagatgactctacggttgttattgataatatatcagaatatattaatgcgggtacagtagtaatcggaaactcttgtgtagaggggataaacagaatattctggaatggctgtgatgaaaacggacgtgttcttcctgccggaacttactttgaggcgggaaagggaaacgcggtggcgattccaaaagccggagaatatcacttccctctgatagatgttgaaaacttgccgaatggtctaaagattacccggctgaatactccggatacctttagtaaagaatagagagattttgtagataatcataaatcttatctatattataacaacattgaaaacagtgtgttgagaaccggaaattataatggcgttgaccgccaaaaaatctggactgttgcggataagcttaataaacgttccggtgtgaacacggaggcgagcggcgcctgcattgtgacaggcaggagtgctgataaaacagtgcttgatttttggacagacttgcgattgtctgatgatgccggaaccaagagtaatcctgttgaattaatagacagaaccgacagtgttgagagcatgcttcttgcaggatttacattctttgattatgacttcagcggaacttatgatatgttgacaaacgactatgctctgtcaaatgtcaaggtcgaacttctggacaataatggaaacagtattgcggagacggtttctgattccagaggtttttatacctttgttgttccggataagtcggcccaatatacaataaaagtaactcttccgaatgatacatatttctgtacaaccgcaaatatggaacaaagtactgttcctcaagatatagtggttgggcaaaccgcttcggttgaagacgttggttttctggctagagaggcaagcccgattcgtataaataaaacctgggcagtgccggatgaagaacagccaaaaatggatgtagaatttttgattgaaggccgggatcaaaatggggacgaaaattcaccggtgctttattcaagaactgcagttgtaaaggattctgagggatattcaactttggttgaaggtcttccggctgtaatatttgttaatgaaaacgaggtagacttaagctatactgttaaagaagtgacagatataccgggatttaccggcactataacttctgagaccggcggtcttgtatgggattgtgtgaataaacctgaggatattagttttactgttgaaaagacttggtcagtcgcatcgaattttactaaaccggatgatataactgtcagtttgatgaagaaaaatgaaaaaggtgagttagtaaaagttgatggtgttcaggatcagcctcttaataattcaaataactggaaagcgacttttgagccggttccaaagtatgaggaatacgttgaaaatggggcagccaaatacagagcaatagactatactgttgttgagaacaatataccaagcggatttgcagcgtctatacaaaagtctgctatagaaacaaaaacaaatacttttattgtaactaatactgctgaaggttcagttaaactaataaaagtagataaggaaacatcttcacctctgcctggagccgagtttaaattggtgcagcttgatgaagacggtattagttatcttgacgttaataaattaaagccggtatatgattctttaaatgaaatcgaaaagtatcaatacgatgaaaattcaactatcgataaattagttacaaataaaaatggtgaaattattgtagaaaatttatctatgggaacatataatttcattgagacaaaggctcctgagggatatattactcctgcagaaaatgaggcgaagtcaagtgatatggttcttggcagcggagtaaattcatctcaagtgaaaatggaaaactctttaaatatcactccaactccgatacctacagcaacatcggcaccgacagaaactccaatgccaacggcaacagcgacacctgagccaacagcaacggcgacaccggttccaacggcaacagcgacacctgagccaacagcaacggcgacaccggttccaacggcaacagcgacacctgagccaacggcaacggtgacacctgagccaacagcaacggtgacacctgagccaacagcaacggcagaacctgagccaacggcaacggcagaacctgagccaacggctacaacagaacctgagccaacggcaacggcagaacctgaaccaacggcaacggcagaacctgagccaacggctacaacagaacctgagccaacggcaacggcagaacctgagccaacggcaacggcagaacctgagccaacggcaacggcagaacctgagccaacagtaacagcagagcctgagccaacggcaacggcgacacctgagccaacagtaacagcagagcctgagccaacggcaacaacagaacctgagccaacggcaacggcagaaccggaaccaacggcaacggcagaacctgagccaacggcaacagctggaccgcagccgggcgatattgtttctataaatgtatcaaaaatatgggaagacgcagaaggcaccgcgagtctaactccaccagcggaacttgatggaagtcaaatagaaattgttcttattaaaaacggagtaagaactgagcaaagtcttgtattaaacaatgaaaacggatttaatggaagttttaataatctcaatagatttgatgaatcaggaaatgttatagactattcagtccaagaagttaacgctccgtttggttattgtgcattctatgaaaatgacggaatcaacagctggaccgttacaaatgcacaggcgaatattacaggaaaggtattctatgatgctttgaataacggtgtttatgatttggataccgattcatttattaagaatgcaaaagtagttcttgaggatgaaaatggaaatcaggttggagaagctgttttaactgatgaaaacggatattatttctttagccgtgtaccggtgaatgatgatggaactgaaacaaaatatacagttagggtcatttcccctcttaatgatgtgaagtgtaccacaactgagaccggaaaccagactgaagaaattataggcggttctttaaatgtgacacagagcgttgcgctctccaagacagatatgattatagacgcttctgacacaggtctgtatggagatgttaaggatttagaggaacagaatataaacgttgcggttaaaaaagtttgggaagataataataaccgtaagggtaaacgtcctcaagaattggaagtatattataccttgaaaaacaaagagggtatcgttataatttctaaaactttgattctgaatgaagaaaacaattggcaggaagagtttataatgccataccgtgcaattgaagattctgaggttgtggagacccaagttgacggatataaggatcccaaaataacaagtacagttgataaagagagtgaaaaatttattataactgtaaggaattcaattgtttcaaattcaagttcaggcggcaatggaggcaaacctactggaggaagcacgggcacagagacgggcgcaccgtggccgacatctactgctaaaccgaatccaaatgtatcggcaactcctaaaccggagattcctgaacttgataagacgaaccattacgcttatattatagggtatcctgaaggcgatgtaagacctcaaaatgatatatcgcgcgatgaggtagctacaatattctttagaatgctgacggatgattcgagaaatgaattttggatgattacaaatccatatactgatgttccggcagacatgtggtcaaataatgcaatatcgacgatgtcgaacgcgaaaatactgaccggtgacccggatggaaaattcagacccgctgacagcataacacgtggcgagtttgcagctatagctgccagattcagcagtaaagagtataatggcgagaatatgtttactgatataatcggtcattggtctgaggaatatattaaccgtgccgcacaagaaggctggatttcaggttatccggacggaagcttcaaaccggaccagtacataacccgtgctgaagcgatgactcttgttaacaacattttaaaccgtcacgccaaagagagcggtttgcttaatgatatgctgaaatggccggataatgtgcccggagagtggtattataccgctgtccaggaagctacaaattcacattattacgaccgtgacagcgacggatataacgagacatggacagaaatcagagaaccgcgcgactgggttcagcttgaaaaaacttggtcggacgctaacagtgccggcagtgaagattcggtttatagcggagagtaatatttaaaataaattttctgcaataaccgttttggaaaaaaataataaaacccttgacaaaaggggttttgagtgttatcataatagaagtaaatgatatcgggcagaagagtgagggaaacctcactcttttgcattgtattatcaaagttaattgttggtattgagaattcagagaggagttgtggttttgggagcgatgacgttttcaaagattgaaaagattatattcgaccttgcggagccgatagctgaagagaatgggctttatatctatgatgtagagtttataaaagaaggcggacattggtttttaagagtgtatctggataaaccggaagaaaatgagtatatatctattgacgagtgtgaggagttctctagaaagcttagtgacgttttggataggagtgaccctatatcgcagaattattatcttgaagtttcctcaccgggaatagagagaaaaataagacgtgctgagcattttgaagccagcaagggcgagattgttgatgccggtctttacaaagcaataaacggcagtaaaacgcttacaggtgaacttatgggtcttgatgacgaagataatgtgcttttgaagatagacggcgagactgtgaagatacctatcaaacagactacggttattaggactcattttgaattttagtctttgccgagctgtttaaaattaattaaatatgtatatcaaatttcacatattatatagagaggatgtttaagaaaaaatgagcgcagagttgtttaatttgttggacgagatagaagaagagaaaggtataagtaaggacgttgtgctggacgcgcttgaaagcgcgctgatatcggcatacaaaaagaattttggcgcggttgaggatataaacgttaaattttccgatgacggtgatataagaatttttgctagaaaagaagttgtagaagaggtagaggacagggaaacacagatttctttggaggacgctcaaaaaattaaaggtgattataaggctggagatgttgcagaatttgaggtaacacctgattcattcggcagaatagccgctcagaccgctcgtcaggttgtttttcagagaatacgcgaggctgagcgtgagaaaatggtagatgaatacagtgaccgtgagaatagtatcgcgagtgctattgtcagaaaaatagagcgcagaaatgttatgcttgaaattgacggcgccgaatctgttcttatgccgaacgaacaggtgaaacatgataactatagagttggtgaaagatataaagtatttgtcgttgaagtagctgatagtataaaaggcgtgcatttggttgtttcacgttcgcatcccggtttggtaagatgtttgtttgaacttgaggttccggaaattgcacagggaataattgaatttaaaggaatttccagagaggcaggttcaaggtctaaaatcgctgttgcttctactatggataatgttgatcctgttggaacttgtatcggacctaagggaatgagagttcaaaatgttattgatgaattaagaggagaaaaaattgatataatcagatatagtgatgatccggcggagtatgtttcaaacgcactcagtccggctgatgttgtatcgatagaagtctttcctgaaaataaaatgtgtaaggttgttgttcctgaaagccagctgtctttggctatcggcaaggaggggcagaacgttagattagcggcaaggcttacaggttggaaaatagatttgagttctattccggacaatgagataaagaaaggtgacaaaactctggaagctgcttttgagcagttgggaaatgagcttttaaccgaagaggatatggaaaatgaggtttcggagattttgaacgacagttattgagtttattatattggagggaaatatgccgacaagaatgtgcgcagtttgcagaaaacgttttgaaaaatcagaactgaacagagttgtaatgtcagagtcgggtgagattttttatgaccgtacaggaaaggcccaagcccgaggtttgtatatttgcagagaatgtgtgagagaagcggaaaaaaagcgtgtttttgagcgtgaatataagcgcagagttaagccgtcggtctatgagagatttgtgtcggaggtggagtccgggtgagtgatgaaaaactattgcggtttatcggtcttgctatgaaagccggaaagcttatgcttggagacggcagggctgttgaatctataaggtcagggaaggcaaaattagttttaatttccaaagatgcttccgataatactaaaaagaaatatagaaatatgtgtgagtatcggaatcttaaattattggatatattttccgacagaaatgaatttggtcagtgtataggcagagattttgcggtagtggccgcagttgaggacgatggattcgcaaagagaatcgttgaacttgcagaaagggttgatgaataatatggaaaaaatacgagcttatgagttatcaaaaatatttgggtttcccagtaagaatatagttaatgttcttcatgaatatggggtatcaacaaaaaatcatatgagtgctctgtcagagtatgaacttgatgttatttttgaatactatactcagaagaatcaagcaaaggatttttctatctttgataaaaagaaagaagagccaaaagaagcagctgaaaatgttagtgataacgaagacttcactccggttccggaaatagaagtaggcagaaagctgcgtactgttgatacgcgcgtcaataatgtggatcttgaccgtattgatgatgaaaaaattgaggagcttattcctgaaaacgttaaacagggagataagaagcagaaaataaatcagaaaaagaaacagcagcagagacagcagcacagcactaaacaaaaacgcaaacctgaaaatgttataaaaaaggttgaaaagaaagaaaagaaggttgagccgctcaatgtgctggtaccaaatgaaataactgtaggtgaactggcttccagaatgaaaaagtctccggcagagattataaagaagctgatgcttttgggtattatggctactgtaaatgaaactttggattttgacacagcctcacttatggtagaagaatttggcggaatcgttgaaaaagaaataattttaacggatgaggaaatactatttgatgactttgaagatacagctgaacagctcaagccgcgttcaccggttgttgttgttatgggtcatgttgaccacggtaaaacatcacttcttgacgctatcagagacacaaatgtgacagagggagagttcggcggtattactcagcatattggtgctcacagagtacgtgtaggagagaaaaagattacgttcctggatactccgggacatgaagcgtttacggctatgcgtgccagaggtgcgcttgttactgatatagctatactggtcgttgccgcagacgatggaattatgcctcagacaattgaagctattaaccatgccaaagcggctgaggtttctatcattgtagctattaacaaaatagataaggacggagctaaccctgataaggttaagcaggagcttatggaacacggtcttgttcctgaggaatggggcggagatacaatatgtgttgaggtttcggcaaagaagagacagaatataaaagaactgcttgaaatggtactgcttgttgctgaaatgaaagagcttaaggctaatcctgacagaaaagctaaaggaacagttattgagtcgcagcttgacaaaggcaggggttccgttgctactgtgttggtacagaacggtactttgcatgtcggcgactatgttgtagccggaaccgcatcaggtagagttcgtgctatgaacaacgataaaggaaagtctgttaaaaaggccggaccgtctatccctgttgaaattttgggattgtctgaggtacctgagggcggagacgaattttatgttgttgaagatgagagaaaggcccgcagtgttgttgagaacagaaagttccaggagaagaaagaaaagcagaagagcgctacggctatatcgcttgataatttgtttgagcagattgaagccggcaagatgaaagaccttaatatcgtcgtaaaggctgatgttcagggaagtgttgaagctgttaaacagtctcttgagagaatttcaaatgatgaagtccgcgtaaacgttatacatggtgcggtcggagctatcaatgagtctgacgtcatgctggcgagcgcgtccaacgctataattgttgggtttaatgtccgtcctacaaacggagcaagcgatgctgctgaagacgcaggggttgaccttcgtatgtaccgtgttatatatgacgcgattgaggatattgaaaaagctatgaagggtatgcttgagccgacattccgtgaagaagttaccggccatgtagaaataagaaccacatttaaggtttcaggcgtaggaactattggcggggcatatgttttggatggcaaaatcagaagagacagcttggtgcgtgttgtcagagacggtattgttatacacgaaggtgagctgaattcacttaagagatttaaagatgacgttaaggaagttaacgcaggatatgaatgcggtcttagcgtcagcaattataatgatataaaagacggagatattatagaagcatatattatggcacaggttgaacccgaataatctgtgccgtaaaggctcggataagaggagatatttatggctaattacagcagaaccgacagggtttcagaagagataaaaagagaattgtcagcaataatacgcgatttgaaagacccgcgtctgccgcagatggtatctgtggtttcggtgcgcgtcacaaaggatttgaagtttgctaaagcaaacatcagcgttatgggtgatgaaaaaactaaaaaggatgcgtttgcagcacttaaaagtgcggccgggtatattaaaaaagaggtcagcaagagattgaatctgcgccaaacgcctgattttacttttgttgaagacgatagcattgaatatggagcccatatagaggagcttttgaaaaatttatagttgtgaactgcattaggacagacgtatgaaaagaggtactatatgtttgaaaaactgattccaataatagaaaaggcaaataaaattgcaatattcacccacactcatcctgacggagatgctatgggaagttcttatgcactaaaattggcgcttacgtcaattgggaaatgctgtaaggtatttttgcttgatgaccctgacgcttccgcatttggactgattattaaaggtgatgatatcgaactgtcacttgaggattgtgatttagccatagcgcttgactgtgcggactctaaaaggcttggaatgtatgaagagccgtttatgagtcatcctaactcgatagctatagaccatcatgttacacatgttgaatttgctaaatcggggactgtgtattctgatatttcatctacatgtgagctgatgtttaatctatttaaagaaatggatatcagtataaataaagaaataggaaataatatatacgtcggtctggcgacagacacaggcaattttaagtattcatgtatcagcggagataccttaagggcagcaggagaattgatagatttgggtgtggattttgcgagcatatcaaaggctgcatttgatacaaagcctaaggcgtattacgatttaatggggattgctataggaaagctgagaatggtatgcgatggcaaagctgcagcgctctatttggaatctgaagattttaaaaaagcgggaataaaagaatcagaggccaatggtatagttaatataccaaacagtattgaaggagtagaggttggggcgtttataagaaagcgtgacgatgatgaatacaaagtgagtcttcgttcaaataaatatattgacgtttcagaaattgccgctgagagaggcggaggcggacatgtgcgtgcaagcggatatagtgtaaccggaaaaactgtggatgagataattcaggatttagcagagggattggataaaagatggcaggattaagcggtattataaatgtttataaacctaaaggtatcacatcccatgatgttgtttataagcttagaaaaattctgggaattaaaaaaattgggcatacgggaactcttgacccggatgcagaaggtgttctgccaatgtgcataggcagagcgacaaagactgcggatatgctcaccgctgccgataaggagtatatggccgaggttacgcttggtttctcaactgatactcaggattcatcaggctctgttataaaatctgttgatatggatgattttattgttagttctgacgacattgaaaacgcggttactaaatatataggcgatataaatcagcttccgccaatgtattcagctataaaaattggcggtaaaaagctgtatgagctggcaagacaagggattgagatagaacgcaaacctcgctttgtaaaaattaacagtattaagcttttggatttttatccaaataaagaacatgtgatgaaatttaagatgcttgtgtcatgttcaaaaggaacttatatcagagcgctttgtaacgacataggtgaagatttgaagtgctttgcgcatatgtcaggacttgtcagaactaaaagcggcagatttgatttggagcattcgtataaactgagtgaaatagaaaacatggcggcaatcggcaatatgtcgttttttacacctgtagacgaggtgttttccgagtatggaaaactagttctatcagataatgctgcctttaagatgtgcaacgggacacaggttaaaagccctgctgaagcaaaagacggcgttacatatagagtatatgatattaatggtaaatttcttactatctcacgtgcggagaatggaaaaatgaagatattaaagacattttatcaggattaattggaggtgtgagcgtggagtattacgcacaggatgagttgttcaacaagcatgatttggataatctgcggctgaaaaatacagctgttgcgctgggtgtttttgacgctatgcacttaggtcatcttgagataatagatgatgttgtaaaatatgcaaaggaaaacggtcttaaatcggtagtatatatgtttcgtaatattcctaagagtgttattactaatacggatataaaaaatgttaacctgttcaaaaagagactacacattctctatgaaagaggggttgatattgttgttgccgagaggttcacatccgagtatatgaaaatggaatatgcggattttataaaaacttatctagtggaaaaattcgacgccaaatatgtttgtgcaggatttaattatcactttggatataaggggttggggaatacagaatctctcaaagaactctgcggaaaatatggcataaaggtacatattgcagagtgtaaggctcttgaaaaacctgtgtccagcactcttttgagaaaacttattgcttcaggagagatggaggaagcagcaaaatatctaggacggcagttttcggttactagaaaggtagaacatggagaaaacatcggacataagctggggtttcctactgccaatatacaactgcctgattttcatgttgtacccaagttcggcgtttatattacaaaggcgaaagttggtggaaagtggtataaagctataacaaatgttggaggaaaaccgacagtcgggacaaataagccatgtattgaaacatatatgcttgactttgaaaacgatatatatggagaggaaatagaaatagagttttatcattatttaagacctatttccaaatttgaaaatattgaggctttaaaaaaacagttggctcaagataaagagtcagcaagagtttattttaatgaaaaataaagttagctgaaagcggaaatagactgcgttatatgcagtgggtttcgctttcttttttggggagtaagataatgagtgaaaaagtaaataaatatgaaatggacatgtgcagaggtccaattttaaagaaaatgctgatttatgccattccgctaatgtgttcaagtatactccagcttatgtttaacgctgttgatatcgtcgttgtggggaaatttgccggtgataattctctggcagcggtaggttctaatacttcaataattggtctcataaccaatttatttgttggtctttcagtagctgctaatgttcttgtggcaagattttatggagcaaaggacgaaaaggctcttgaacagactgtacatacttcaatgcttctcagtcttttcagcggtataattctctcaataattggagtagccggcgccaagtggatattggttttaatgcagacgcctgaagatgttcttccccttgcaacgttatatcttaggatatattttcttggaatggctgctacgatgatatataattttggaagtgcaatcttaagaggcgtaggggatactaaacggcctttatactttttgtttggagccggaatagttaatgttatattaaatcttttatttgtaattgtatttcatatggatgtagctggagtggctattgccactgtaatttcacaatgtatatcggcttttttgatagttcgttgtctgatgaaagaaaacagcggtatacgtctcaaattgtctaagcttaggataaacaaaaataaattgctgttaatttttaagataggactgccggccggttttcaaggaatattattttctctttcaaatgtggttattcagtcgtcaatcaattcatttggttctgtggttatggcgggtaatgcggctgcacagaatttagaaaactttgtgtattttgctatgaatgctttccatcaagccacagtgacgtttacaagccagaattatggtgctctaaactataagcgaataaatagaactgtgattctaggtgaaacatgtgttgctatagtcggaattgtactcggaaatttacttgttctatgcggcggcggacttcttggcatttatacatcaagcccggaggttataagcgcaggaatagacagacttaatatagtatcgcgaacatatgctttgtgcggaatgatggatgttatggttggtgctttgagaggtattggctattcggttataccgatgatagtttcattggtcggggcgtgcggcttaaggctggtttggatagccgctttgtttggaatagagcagtaccataatgtgacaacggtatatttatcatatccggtttcatggcttttaacttttatgatacatactttatgttttgttttgctaaagcgtcatttagaaacgcatatgaaaaaattcggagcgggatattaatcgcgtaaaaatatatttttgcatgattgtattattataaaagggtatttaaactttaaaattcattaaagttttactgattactgttttaaaaatactctgataatttaactttaaaaagtttattttctattaaaagcttttttttggaaatagtagatatgaaaattaggggctatacaacaggtgtgtataatgattatgatagatttttgactatagtataatttataataaaataatatattatactatatttttggtatcatttaaacagatcggtctgtcaaatagactgatctgtttttttatgcaatttatcctctaacactttttatgaaactgcatatcttatattgtaagagttttatttttattaaatataaattaggaggaatcactttgattgaagcagaaagattagtgtcttcacgcccgtttattatgtattcgggaacggatgtcagcggaaccgtagggggtaatccgagtgttcaaagttactgtggcttggattatacagccgcgtcccgctatcgcttagacagacctgatcataatcaaatatttcaattttttggaaatatattaggcagtcagaataaacttgtttactgtcttgataaatttgcagacggtccatataataacgtgccatatgagagccgtccgtttgaaacactttttccgggggcaacggagagacaaaaagaaatgttgggatggattttggcaaatacatttccggctgtgagcgcggctgctacatttgcgcttgccggagtagatccgacagcagcaccggttcttgacaataatgatgcgtatgcagccgttcaagtatcattatgggtacttttggaacagatagcgcttgatgaagttaattttttagagtgcacatcaggcgaaactcatccaaaatctgaaaggctgagaattacagttttagaattgcttcgcctggccggtcaatttgttgataatgagacgctgcctgaaatatcaattactcatacagagccatgctgtggattaacctcattttttagctgctgtaataatagtactttaccgtcagacggcagttctccatatttagtttttgcgaattgtcctaacgaggtcagaacaatttgcggaaggcttctgatagggccgtttcgtgtttcatcaagtttcgcaggacagccgactataacggttacgcctttctgtaactgtggtgaagattactcggtatcatttatggatttctgtggtaatccaatttctaatcctgttataggacaggagttttatattgctatcagaacttgcaaaagattttcgtgctttactataaccgcttcatttactggaaatattacaagagtaataactttagaaccgcagagtacagcattaaactatcagcctataggtacatcttttgaggaccagtctattacattaaatgctgaattatgtatttgtgttgagtatccggcatcatctgaaagttttgttgataatggcaggtttggtataaatataaacaataacaacaacaataataacaataacaataataatagcggaggagggtatccgggtcagttcccttgtataccaatttgttatccgatttggcaaaatcctcgtccgccgtatccgccggaaccaccatatccacccgatccgccgtatccgccaagaccaccgcgtccgccatatccgccatatccgccatatccgccgtgcccgccatgtccaccatgtccgccggaaccaccatgcagaccagagccgccatgcagaccagaaccaccatgcagaccggagccaccatgcagaccggaaccatcatgcaggccggaaccaccatgcagaccggagccaccatgcagaccggagccaccatgcagaccggaaccaccatgcagaccggaaccgccatgcagaccggagccaccatgcagaccggaaccaccatgcaggccggagccgccatgcagaccggaaccaccatgcagaccggagccgccatgcagaccagagccaccatgcagaccggagccgccatgcaggccggagccaccatgcagaccggaaccaccatgcagaccggagccgtcgtgcagaccggagtcgccatgcagaccggagccgtcctgtaagtcaacttctgcttgttcttctaatccaccatataagacaactgcacatattaaaaatgaaaaaacagggagtcagattactaataaaaagcatggattttgatttacaaacaaaaaagctcaatctttttaagattgagctttttaattttatatgcaaataattttataatgcatacttatgtttataaaattcataatcctctctgtattcgcctggcatttcagcatgtagacgtcttaaatattcatgcctgtccaaagctctcttatcagatcttgcttgtagtatagcaactcctatgtttgaacagtgatctgaaattctttccacattactgattatttcaagaaatattacccctgcttcaacagaacatttctttgacttaaggcgtttcatatgcttgcgttctaacttttcctgaataccgtctacaacctcttcaagaggttctattttacagaccaaggatatatcatcccaagtaaatgcctggaatgtaagttccataatattttcaacagcgttaaacagaacttttagaccttcttctgcatcgggagagaattgtattttcccgtttatcagcttttcaatactctctctaatattgtcacaataatcacctatgcgctcaatgttgtttacaagatgaaaatatgctgctgatttttcattatcagactgactgagctgtgtatcggaaacttttgtaagataagcagtcagattgatttcatattcgtcaagaagttcttcgtttgcgagaattttctcagatatagacatatctttgttcttaatcatctttcggcagagcataacattttctttagctactccgcacatgtttgacattacagtatgtacattatttattgctatggatggagtagaaagaaaacggtcgtccagtaatgcaaacggactttctgtttcctcgtgttttgtatctttgattgtcttttgtgcaagccataccaatagccttgaaaatggtaaaagcattatcgttgaagcgacattaaatatagaatggaaaatcgatatatctgttgcatttattgccgaatgccaaaaaggcaggcccaaggtgtattgtaatgcataaataacaaccatgaatactatagtgccaattatgttaaaataaaggtgaatcattgcggctcgtttggcgtttttacttgcgccaacagaagataaaagtgcggtcacgcaagtaccaatattctgccccattattattggaaaggcagaggaaaataccacggcggtactggaagctacagcttgaagcatagcaaccgatgccgcgctggattgtataatggctgttattcctgttccgataagaattcctattacaggattattttgacctgcaaatacattctgaagcgatggaatagcgttaaatactacttccatagaatttgacatgtattccataccaataaatataagaccgagaccgactaaaaattcgcctatagtttttatatttttcttttggcagaagaaaagaagccctgctcctaaaataatagcaacgggagccagcgttgtaggtttaactatggcaaggtaccaaacatctccgggcaaatcgtttaagctgagaatccacgctgttatagtggtgccgatattggctcccataataattccaacagcctggcttaaggtaagtataccagcattaacaaaaccaacaaccataacggttgttgctgatgatgattgagtaagcgccgcaacaacggcacctaaaataactgacttaaataaatttccggtaactttctccattatctgacgaagcttgtctccggcagctctctcaagaccggtactcatggtgttcatgccaaacaagaacattccaagaccgccaaatagtgagagaatttgcagcgcgatatccataaaggacacctccataatttaatttaactcaacttccaccgactataatatatcatcttatacgacaaaatacaactcgtaatattgcatatattagtgatagtatttctttaggaaatttagtaaaatttttgtgttaaagaaaataaatggaaatatcgtgacttatttgagaagaatataattaaaagaaccatgtatagaaaaatacatggtcttttttttaaaatagtattattatatttgaattatagttaaatatataaaactgacataccaactccgaccatatcattgggaacatccccaattctccagccgggttcagtagtttcgatataatagtattgaattccatctaaggacaaattaccgttgcttgaagtctgtaaacctacagccatatggtcttcactcactaggagaactgcaccataacctaggagtttcagcattttagccaaaagcaccgcactgtcttcgcagtcaccgccttggtcgaatagtgtttctatcgggtatttagggtattctataactcctttgtaggttaaatcatcttgatattccaagccttgaacaaaagctgatataaatccggctatatcataagaggaggcgaatccattgtttattgccatatctctgagagtttcagcaagagtataaacagccgtctcgtcagcctcatcctgagcatatgcagagtaattattagttcttggttttgaaacaaaatagttatagtcataatatgaaatgcttacatccagtctgaaagtttctccatagaaaggatagttccatgaatacgacaacgattgataaggtttatcctgattaagagaaaacgaaattcttaagtctgtgttgattatacgtgataccattgctgcggcttcagaacgtaaaatatctgaagctggataaaacgttccatattcatcactaccggttacaactcctgattcataaagttttaatatctcttgataatatggatttgactctctgacatcaggtatgggagatatttcattaattttttgataacagtcaggcagagctttaaataacaagtaagctaactgttctcttgatgcggggtttaagtatcttccgctgaattgatttggttctattatcccttggttaaccgcatactcaagatatggcatgaaccaagtcatatttgcctgtcggttaacggagcctacaccgtttgtatttatataaactccggtttttggggtttgcgtcatagaatcgctgtcatttatttgaaaattgccgtttccgcttataggatatgaatatttgatattgttgttatcaagtgaggcaatgcttccgccagagtttaatttgttaattgtattgccgtagtatttagcattgagtcttgaagctactgttattgcctctgccagtgtaatgtttccgtcgggtgtaaacatattatcgccggttccggtcattattccgtattcataagcaaagcctacatagtaataataccaatcgtcatcgtaaacatcagcatatgtagaagaatcataatagtttgtctgttcaaattgtggaaatatttcggcaaatgctgtagcagaaacagatgttaatatacataatacgagaatagttgaaataaattttaatttatattttatcatgacgcacctcacttatatagagtgtgattaattgtcatcgtgatttttatcgtcagacggttcgtttatttcatcgctttcagaactgttttcagtatcgggttcaaccaaagtaacaacagcttcttcaattctgtggtcagcgactttggttacgtttattttcatagacccgaaagacagctcaggcatttctccatctgcggggactgttccaagctcatctaatattaatccggcaaaggtgttatattcttcgtcaggaatatctataccaagttcttcttcaacgtcttcaatttctgcgcagccctgaataagccagctgtcgtcttcgccgggaagtttaacaatttcttgttcctcctcaggctgatcgtattcgctgtacagttcaccgactatttcctcaatcaagtcttcttgtgtaactatgcctctaaaaccgccgtattcatcaagaacaatagcgaagtgagcatttttatcctgcatttgagaaaacatttcgtcagcttttatagactcaggaacaaaatatggctctcttaaaatatctctaagatttccattcctgtctttaagtaagaatttgtaaaaatcacggctgttcagaactccaatgatatcatctatagcattgccgcatactggatatcttgtatggtttgtttcatttataatttcttcccacttatcaggaccgtcatttatccacaagataactgcgtcggttctgtgagtcattatgtcttcaacaggtttgtcgtccatttcaaaaatattatgtatcatttctttttcatcgtcatcaatggcgccgctttctgacccgatatcaaccatcattctgatttcttcctcggtgacgtcatcatcgttttcgtctggccgaataccaaagattttcaaaataatttttgatataattcgaggaatccatacaaatggtatactcaaatatgttacaaagattgaaatgggagttaaggctacagaaatactttcagagtattttccggccagaccttttggaacaaaaattccaaatattaaatatactaaagttgtaatgaaagaaataattacaaaactcaatatacaagcagcaatgatatttatattaagctcggtaaagtacgaaaccagcggaatcaaatacatatatattgcacatccgcctattgagagcagtagtaagctgtttataaattgaatagacgctacaaaatcccctgagtttccatcgagaaattttgaaagccgtatggcttttttgtttccgctgtctgctagttttttaagttttgcatcatttactacaattgttgactgttcgattaaagtaaaaaacatacttaaaccaaacaaaatcaaaagaatcacccataacgattgcgtagggggcaacgtgtccaaaaataatcatccttccaggcgaacataacccataataatttttattgtccaccagtataacagaaaatatgataaaagtcaaattctatattgtaaacgtttagttaacttttaaggtatatacgttatatttataaaaacgttaataatcatattttctaatccgatgtatctaaaacaatatttttgaaacttgaagttttaattagggctaagatagaaatattttataaataataggttagctaaataatataataaaatatttttataaacttaaaaacgttttattacaatatggctgaaactaatccacagtatctaataacattatagcatatgtctttagaatggaacaatattaactactactttattaacgaggtgtaatatatgtattataaaaagtaaaaataagtttttaaaatattgtaataagttttaatgaaacaagtgtattgcaagcatcggtaggtgtgaccacacttgtaagaatagtgtgtgttatatacattaacttgttttgccattacttgcgatgtcattaatatgtatactcaatgcggacaaagtccgccgcgttaggcgcgcagccgcgaaaaataataacattattgtatttaattattttaatctaagcaagcaaattatatatatatgtaattaattatgtcaattcttaattattttatgttataaaatattgaaagctgtgattcacacagaaccacagcttttaatactacaataaacattcattctttttttatatcaacaccaagatttttaagcttttcaacaaagttttcataaccacgttcaatgtgttcaatatcatgaatcttacttgttccatcggcttttagcgccgcagcaactaacgcggcgccggctcttaaatcggttgctttgacttccgctccgctgagacgttttacgccttcaataaaagcggcgttgccctctgttttaattttggctcccatacggcaaagttcaggaatatgggcaaatctgttttcaaaaatggtttcaacgaccattccgttgccatcacttgtagacagcagtgacatggtctgagcctgtaaatctgtaggaaatccgggatatgggagagttttgatatctacagatttgggcttttggcagggttttaagtctataaaatcaagaccggtttcaaacatgaatcccatttctgttaatttagccaatagtggttttaaatgcagaggttcaatattctctgttttaattccactgcctaatccggcggcacagatgataaaagttccggcctctattctatcgggaataatcttatgattatttttgtgcattcttgtcgtgccttttattattattgtgtcacttccggctcctgtgactgagccgcccattccgcataggaaatcagctaaatcaattatttcaggttcgttggcagcgttttctatagtggttgtaccattggctaggcacgctgctatcataaggttttcggttgctccgacactgggaaaatccagatatattctagttccaaccagaccattttttgcggacgcttcaacaaatccatgaccctgcttgatttttgcacccattgcggcaaaaccttttaagtgaaggtctataggacgggctcctattttacagcctccaggaagtggtatacgaacatttccgaatcttgctaagcatggtgacataacaaggactgacgctctgagctttgaaaatagtgaataatcacgcaatcttttaggttttgtgatatttgccgagattctcattgaaccgtgcttgtctctataaatatcacagcccagaccttttataatttctgccattacatcagtatcagaaagatgagggacgttatctaaaactgattcttcttcggaaagaagtgccgctgccataatcggaagagcagaatttttagagccgctaatttttacatttcctccgaaattttcacagggaccgtttataatatactttgccatataaaatcattccttaacgtattatatttgaagttgagataataccggtgctttgtgggctttcacctgatatggccagtataggaacataggtttttgcagttaaaacaaaagcgcaggtcaaaattaatgatgttataagcctttttttcataaaatttcctccaaaaccgcataataaaattttaagaattatgccacaatagtattttgacctgtaacaacttttttataacttgtattttttaaataaaaagataatatttaagataataataaaaatattgttttaaaaataaaaatttatactaaaggtgaagaagcgtgttgttttatgcaaataaataatgacaacaatttgataaaaaacaataatttaaaataaaatataaagaatataagtcttagtaatacaagatattttcatataattaaaatataaaaatgatatataattttttaaattttaaaattattttgttcaatttaattatcataacataatgcaggtatatttgcgaacttcggcaggcttgcggagcaagcacgtaaggttcgccgccatctgaccgtatatagcggtcaagataaaataagctgtttatattattctaggttatgtaattgttaaataattatattatactcaaaccttttaattatcataacataatacatgtatgcttgcggagcaagcacgtaaggttcgtcaatatctgaccgcaataagcggtcaagataaaataagctgtttatattattctagatatgtaattgttaaataatcattatatactcaaaccttttaattatcatagtataatgcaaatgtatttgcgaacttcggcaggcttgcggagcaagcacgtaaggttcgccgtcatctgaccgcttatagcggtcaagataaaataagctgtttataatattctaagttatataattgttatattttacttcaaaaataaattagtaaataaagtttgcaaatattataagtaaactagtatataacatatcaatttattaaaatattctttataaaaacaataattaattttgttaatataatcttgaccgctataagcggtcagatgacggcgaaccttacgtgcttgctctgcaagcctgccgaagttcgcaaatacatttgcattatactatgataattaaaaggtttgagtataaaatgattatttaacaattatatatttagaataaaataaacagctaattttatcttgaccgcttattgcggtcagatgacggcgaaccttacgtgcttgctccgcaagcctgccgaagttcgcaaatacacttgcattatattatgataataaaaaggttagtaagtaatataattatttaacaaattgaattgcagttaacaatttacattaatggactatgggttaaaaggtacaaaaacataagtatgtatacaacaaattgagatgttgtaaataatttatattgatttattatagattaagagacatgaaatctaaggtaagaaaacaataattttataataattttcaatcttgtttgatttatgatactttaataatttacataaatagttagtaaaaatatgtaaaaataaaagaatgcctttattggcattcttttaatataaacttttacgctggatgagtcatatcatcataattgactaagtctttgtcaattttatatttttcagcttttctctgttcaaagaatttgactgcaacttggtcaaacagtgcatatgaaagtacatcttccggctgttctgtccattctgcacattctttcttgagcttctcaagctcaggctttattaggtcggcaggacggcaggtaattgccttttcatttcctattatcttctttctgaattcatcatcaatcggaacaggagttctgccgtattcacctttacaaattccctttgtctctttggttaccatcttatagcgttctcccatgagcacgtttaataccgcctgggtgcctactatttggcttgtgggggtaacaagaggaggatagcctaaatctttacgtacttcaggaacctcttttaatacctcgtcaagtttgtcttcttttccttgctgcttcagctgagaaactaggtttgacagcattccgcctggaacctggtattttaatgtgttaatatcaacgcctaaaacctttgtgctcataagaccggaagccaaatacttttctcttaaaggtttaaagtattcagcaatttcagtgagcaggttaaggtcgattcctgtatcgtattctgttccttgaagtgttgcaaccaatggttctgtaggcggctgagatgttcccagagccataggcgacaatgccgtgtctacaatatcaacaccggcttcgatagctttaagatatgtcattgaagcaacaccgctggtatagtgtgtatgaagctgtatcggaattttgacagcttttttcagtttctttacaagttcaaaagcattgtatggagtcaaaagaccggccatatcttttatgcagatagaatcggcgccgcagctctcatattcttttgccaactttacaaagaaatcattattgtgtactgggcttatagtatatgatatagccgcctgaacgtgacctttttcttttttagtagcattaatagctgtttgaagatttctaacatcgtttaaggcgtcaaaaattctgattatatcaatcccgttagctatagatttctgtacaaaatattcaactacgtcgtcagcataatgtctgtaaccaagaacgttttgacctctgaacaacatttgaagttttgtctttggagcggcttttctgatttttctgagcctctcccaggggtcttcattaaggaaacggagacaagcgtcaaatgtggcgcctccccaaacttccagagaatgataaccgactttatccattagaggcaatgctggcagcatctcttcagttgtcatacgagttgctataagagactgatgcgcatcacgacatatggtttctgtaattcctactttagccataatattttcctcctataattattttaagattaatgagcgaacatagcgaggaatacgcctgccgcaacggcagaaccgataactccggcaacattcggacccatagcgtgcatgagcaggaagtttgaggggttttcctcctgtccgactacctgtgatacacgggctgccatcggaactgctgatactccggctgaaccgataagcggatttacttttccgtgggtcagtttgcacataagtttgcctagcagcaaaccgccggcagtactgaaacagaatgcaataagaccaagcgcaactatacctagtgtagcaggtgtaaggaatgtttctgcctttgcggttgcgcctactgtgagacccaggaatattgttataacattcattaaaccattttgagcggtctttgctaatctatcagcaactccgctttcttttatcaaattgccaagcattagcatacctacaagcgctacagcgtcaggcacgattaaggccacgactattgtaacaatgatagggaacaagattctttctctcttgctgaccggacgaagctgttccataacgatagaacgctcttttttagtagtaagtcccttcattataggcggctgaataaccgggataagagccatataagaataagcggctatggctattgccggcagcaattcaggcgccagtgttttagtaacgtatatagcggttggaccatcggctccgccgataattccaattgaagctgcttgttcaactccgaatccgattgccggaatagctgcgcccaatgcgagagcaccaagaaaagttataaatacgccgaactgtgctgccgcacccaaaagaatgctcttagggttagcaataagcggtccgaagtcagtcattatacctattccaaggaagataagaggaggatagattcccaatttaactcccaaatagagcaagtccaatagaccgccttcagcaaaaatcctttgtatatccaaatgaccgtctatcaaatacgccgggtctgtaaaaaattcattgtgcattaatatagcgcctgaattttggaacataggcatatttgttagcagaacaccaaatgctataggcaatagcagcagaggctcaaattttttcactatagccagatacagcagaacgcatgcgataactatcataagcggagttcctataacttcaagaatatttccgcctgatgagatagtctcagatattgagtttatcagcgctgctataccggtgcttcctaaaaagcttgaaaaagcctgtaacaaaaaatcaccctttcatcaatatattttggttatgtttcggttggataataaattaaccaatagaaacaagggcatctcctgtattaacggaagcgccttggctggtgcagacagcaactattttaccagattttggcgccataatttcattttccattttcatagcctcgagtacgcaaagcacatcgccctcatttactgtgtcaccgtttttaacttttacagatacaatgcttcccggcatcggtgcttcaacagttgttgcgcccgaaacaggggctgaggctgctgaagcctgcggagctgcttttggagctgctgccggctttggagcaggagcggcagacttttgaaccggagcaggagcgccgccgatttcttcaacctctacctcatatgaattcccattaacacttatattaaactttctcattatactttacctcctggtattgagtttaaaatcttgaattgattacgtcggtcaggccggccttgctccagcttggcagagcgttgccaactcttctgtatgattttatatttagattataacttgatgtgttaagacttgcagctatagcggcagtcaaaacagctatcaattcgccctcgtccatctcaggggctgattttgcagtcgcgttggcagcctgaggcagtgtcttgttactgtttgagggtgtattttgttctttttttgaattatcattgtaaaatagtgttttcatacccattaaaacaaacataagaatgactagaactgcaaacacgatagcaagtccaacaattgtgacctgcagaccttcagatagtgctgcgcctattgtcatagctttattctcctttcatatttatgtttaacatctattacagaggaatattaccatgctttttggcaggtcttgtatctctcttgcttgcgagcatttcaagagcgcttataattctcggacgggttgagtccggctctataacatcgtccacataaccgcggcttgcagctacataagggttagcaaatttttcggtatactcttgaattttttcctgtcttgcgagaacagggtcttctgcatttttaatatctcttttaaatataatattagctgcgcctgacggacccattacagcaatttcagctgttggccatgcaaataccatgtcagcgcccaaatgcttgctgttcatagcaatatatgctccgccataagcttttctgactattacattgatttttggaacggtagcttcagagaaggcaaataatagttttgcaccatgtcttataacaccgttgtgttcctgattaactcccggtaaatatcccggtacgtctgtgaaagtaacaagaggaatgttaaaacagtcacagaaacggacaaatcttgcacccttatcagatgaatcacagtccagcgaaccggccataaatttaggctgatttgctataataccaatggtagaaccattcattctagcaaatcctgtaactatgttttttgcaaacttatcaaacatttcaaagaattcaccgtcatctacgatttcttttattacatctctcatatcataacccttgttgacgtcaaccggaacgatttctgaaagtttgtcagaaagtctgtttaaatcgtcttcacagtcataaatcggagctgtttcaagattgtttgaaggaagaaatgaaagaagaagtttaacctgttcgaaacagtcttcctcagttgcgaatgccttgctggcaacaccgctttttacggcgtgcgtttgagctccgcctaattcttcaaacgaaacgtcttcgcctgtaaccgatttaacaactgaaggaccggttataaacatctgtgaagtcttatcaaccataaaaataaaatcacagatagccggcgaataaacagcgcctccggcgcatggacccaaaactattgaaatctgaggaactacgcctgacgcctgtgtgtttctgaagaagatatctccaaaaccttttaaagcgtcaataccttcctgaattcttgcgccgccggaatcgttaattccgatgataggagcacccatttttgttgccatgtccataactttgcaaatttttgccgcctgcatttcacccagagaaccaccgataaccgtaaagtcctgagcgtatgcgtagaccaatctgccgtccacggttccgtatccggtaacaacgccttcaccgggggcttctgtctttggcatattgaattcgttgcatctgtgtttaacaaaagcgtcaatttcaacaaagcttccttcatcaaaaagcattgcaagtctttcgcgggcagtttttttgccgctttcatgctgctttttaattttgtcagcgcctccgccttgttctatagtacggcgaatctgctgcagctcttctattttttccaattgtattacctccttgtgtttaaattgtttagtgatttaaatcacatatgttaaaattaattatttttctgttataaaaactttaatgatgtctgtttccagactttttagtgctgttatttttgcttctttggataccatttccgctatagtgaggtttctttttggcactggttctgatttttggttttgagtttctcttgtgtttttcagctgcgtctttaccgtagatactctcactgttttctttggatgattttttccctgttccgatttttttcagcatatttacttcagattcggaaagctttctccatcttcccaaaggtaaatgacccaaattaaggcctgcctctttggtgcgtttcagacgttttactatacagccaaccgattcgaacatctttctcacctggcggtttcttccctcatgtatagttatttcaagtttagttccgagctgggtggctcctataacttcaacttttgcagggcttgttcgtatcccgtcaatcactactccgtttctcagtcttgttaaggtttccatattaatattaccggtgacttcggcaacataagtttttggaatattgtttttaggatgagttatattgtaagtaagctcaccgtcgtttgtgagtaggagaagaccttctgtatcataatccagcctgccgacaggataaagcctgattggtatatcagtgaccaaatccataactgtgtccctgcctttgtcatcacttacggtagtgacaaatccggccggtttattaagcataatataaaccagctttttttcaattctaacaggtatatcgtcaaccattaccaaatcgttgtcttcatcaatcttaacgcccatttcggtaacagtttctccattcacacggactcttccggaacgaatgatttcttcactgcctctgcgggatgcaacgccgcagtcagcgagatatttttgaagtctgaccactgaatcaaaccctttcttttgtttttaactgcggctagattattagactaaaataaccgcatgttatcataaacgctttgcttactattatagcctatttaaaaattaaattcaataaaaaccgtaatataaatttgactgatattactgttttaaactaggtatatattagtatttttgtataatttttaacaatcgtatatggcaagcttgaatgctggctttaaaaaaacgcatagtataaaaattataattgatttccatgcagaaatagtcttgatttttatttacagctataaatagaattcagacaataatagttacataatgttgtctgtttcaatatcttaaactttttatagaactaacttatttttatttatttcgttaacagattttattattttgataaacaatcagtgatttataaagagtgtctgctttggaaaaaatattttttatagagtgctattttatataactaaatttatacaaaaaaggaggcagacaattattgtctgcctcaaaaatatattttatttttctgataaaggaatattaagctttgaaaaggtgcgcctaacaaagactatacatagaataacagaagctatttcagctatcggtatcgaccaccatacaaggtctagatttccaaactttgatagtataaacgcgaccggcaaaagaataattagctgtcgtgaaatagatgttacgagcgaatatattccctggccgagagcctgaaggattgataaagttactatacaaaatccagctgctataaaactgatacttattattctgagagccggaacacctattgcaatcatatctgacgaggcgttgaacattccaagcagctgtgtggggaagaactgaaaaatcagcaaaccaaaaatcatgattgatacagcgtatgttatgctgagtttcatcgtctttataattcttgaatgtttttgagctccataattatatgcgattattggaaccattccgttgttaagaccaaatatcggcatgaaaatgaaactgttgagtttaaaatatacgccgaaaactgctgttgctgttgcggtaaatccaataagtattttattcataccaaaggtcattattgatgatatggctatcataagtatggatggcagaccgactttataaatgtttgccacaatgttcttttgaggaagtatttttttcaggtcaaactttaattctttgtttacttttgcattacaaatcactgccagcagcatagctacgatttgaccaagcaccgttgcaagagccgcgccgcttacacccattttcgggaatcctaaaagaccaaagatgaatatagggtcaaatattatgttaattattgcgccaataccttgagtaaacatagtataaattgttttacctgtggactgcagcagtctttcacccattatctgcccgaatataccaaatgagaaaatacagacaattgagagatattcatatccgtattgtataatttgggcattgtctgtctggattctgaaaaaccaatgtgatagcgttgaaccaaatagtagcagtaccagccagttcataattgcaagaaagatacttatattagcagctttattcgcgaatttgtaatctttagcgcccagacattttgaaacgaaagagtttaccccgactccggtaccgctggctattgctatcataaggttctggacagggtatgcaagggatactgctgtgagggcattctcgttgatttgggcaacaaagatgctgtcaacaatattgtaaagagcttgaaccaacatggaaataattatgggaagcgacatacttataagcagtttgttaacgggcattgtacccattttattctcctttacggagtcaagtgtgtcaacttcagtgttgataatttttgttttgttttttgacattactttacctctattcttaaagtgtaagaactattctaacatattatagaagaaaatgtcaaataatttatgttgaataaattttatctcttattgtttgctattatatgatgaatggaaagaaatgctgaaaaataaagatgtgtttctgccggtataattattttattgttaacaacagtacctatagttcttcaagtccggttattttcatttttccgccgctgaaacttacagtatatttgtacttttcacttatatctttgactgagccgtctttatataccactctgatagttgaacttcgtataacggttgccgcagtgtcagatattttttctccgccgtagcaattcaatgaaagtatttcttcgctttctacggattgacggatttgtttatggcttttgagttcctggtcagcagcagaacttgagaaatatacatcaatatatgaagtatcccctgtattgatgccgttaacaaatgaaacaagagcgccttcaataaagttttcagcagcattggtatcaacggaagcggccggttcctgattgtatgagtaggtattataataattgtttacaggcggcgcttccggctgctgaacaactattacctgaggcggagctgtcggcggtgcgggtggagcaggcgtagccgtagccgctgctgtttcagttggtttagcgttaaaagaattaaatgatattatcccggttgaaaataaaaggataaaaataagggcaaaaactaaaataactgataataacgaaactgttacgattaaaccagtgtttgacttgccatgtcccggaccctgttcattataatttggattatacaagcaaaacccctcccaaagtacgtacttatatattcacattatataccaattgtagaattttgtaaatatttattatcattaaaaacaaattaatactataattaaaatatatgaaataaaaaatattacttattttataatagaaaaattgtgtctcacactgaaaaaagtctttttatatagttagtttagggctgttcagttatatgtgcatatagtatttaaattgtctttggaaacaagttatagagtttatttatttcagaaatattaaaacaatttttacttcagttatttggataacagaaacgccctaaaataatatagggcgtaattaaagctttatttatattttttcaacttcttctttaataaacataatacaaaagctgataatcagaagaagacatgaaaaccaaattgcatgaattccatatattttagtaagcataccgccaagaccggcgcctgcggcaaaagtcagtaacacgcaaaaatagtagagcgattttctaagaacacttttttcttttgtataaaaaaaggtgtaaagtgattccatagcacttcttatgtttccgatacacattgtgcttgcataagggtgaccttcaatttttcggaacgtataaacctgcatagcacagacgaatgatactaatgaatttgccaaaatatcaagtgagttcggaataaatcctacggttaaaagtaagcttatttctgcagctataattaactgtctccaatgaatttttttcatatatttaaaatggcggtgtattacttgtgctagatatattccggtaataaacgccaatatcggaattaagtagcgcactgcattatataattttccctgaaatatgtatgaactcatcagcacaatatttccggtttgtgcattggcaaatacttcttcacggcaacagtaagtatatgcgtcctgaaaacctcctgagagtgttagaaagacagcgtttataatggcttcagacatttgcctggattttaatgacgaaattattgtgttaagctgcttcatttaataacttttcaagtgtaactatttttactgacagggcaaatatttttgttgccagttttatatctttcatgtttgcaaatgtaggagctatacggatattttggtcttcagggtcgtttccgtaaggatatgtagctcctgccggagtaaatgccacgcccattttgctgcaaagtgtaactgtgtcggatgcgcatccctttaaggtgttgaacgagatgaaatatccgccgtttggttttgtccattcagctataccgagcccgttaagttcatcatttaaaattttgtctactgcttcaaatttggggcgcagtatatcagcgtgttttgccatatgagcttttattccggttatgtttttgaagtagcggacatgtcttaactggtttatcttatcaggaccgatggttgcatactttaaaaatccttttatatcaatgaggttggcaggactggatgcaacagctgatattcctgaacccggaaatgttattttgcttgtggagcagaattcgtaaaccatatcaggatttccggctttttcgcattcactgataatgtcaggaatatcggtttcttcattttgatatattgagtgcacgcagtaagcgttatcccaaaagattctaaagtcctttgctagaggttttaggttcgcaaacctttgtatggtttcgtcactgaaaactatacccatagggttctcgtattttggcacgcaccatattccttttattgtgtcgtctgatgacacaagtttttcgacaacatccatatcaggaccgttttcattcataggaacagggataagtttcattccaaaatgctctgtaatagcaaaatgacggtcatatccgggagcggggcacaaaaatttcctgtcctcaacctgacaccatggtttctctccaagaagcccatctgtcatggcgtggcttataatatcatacataagtgtaagactgctgtttccgcctactataacgttttcagggcgtgttcccatcatatcagccataagctgtttcgcctccgggattccgtccagccctccgtaattacggcagtccatgccgctttcagcgtccagaatacttttagagtttaccgtgttcagcatttccattgataaatttagctgttccttatccggctttcctctggataaatctaaattcagttctaatgctttgatttcttccatttctgatttcagttttgataactctttttttaagtcttcagtgcttaaatctaaatatgacacttgaaattccaccttttttataatttattgtattattttcttgacttatgacatttaataaatataatataaaagtataaatatgtaaaatgtattattgatattattattatatcaattttgtataattgagtgcatgtatggaggaaataaaatgaatattaactatgattattaccgtatattctattatgtggcgaaatatggaaactttactcaggcggcaaatatacttttgaataaccagcctaatataacccgctctataaaaaagcttgagaacgaattgggctgcactttatttgtcaggtctaatcgtggagccacgcttacgcctgagggagagaaattatttgctcatgtatctgtggcggttgaacaattgcgtgcaggagaggaggagttgtcgcgcgataagagccttcagagcggtactgttactgtaggggttagtgaaacggcgcttcatggcttgctgctttctgtgctgaataagttccgctcaaagtatccgggaatcaggatacgtttgtcaaaccattcaactcctcaggctatgtcagctctgcgaaacggaagagtggacttggcggttgtaacaactccaacggatgtttcaaaccctcttcatgagtataggcttacaacgttcagagaaatattagtgtgcggaaaggatttttcccatttgcagaacaaagttcttcaattaaaagacttaacaaaatttcctttaatttgtctcggtaaggaaacaaaaacaaatgaatttttcagcagattttttatgagccacggtttagtctttctgccggatatggaagcggcgactacggaccagattctgcctatggtgaggaataatttagggcttggttttctgccggatatttttgcggaacctgctattgaaatgggagcaatatatggacttaagcttcaggaaaagataccaaagagagatatatgtttgcttaaaaacacagaacgtccgttaagcattgcggcaaaagagcttgaaaagatgctgctgcaggaaaagacattattggaatagtcatataggttataaaataagcaacggtaaaaataagattataaatatacaaagtttttccatataaatatcttgcttttaatataatatcaacgtctaaaatatttatgtcttgataattgcaactattggtaaaataaaattaattgtatgatttgatatagcagtataaaaagtgtttatataagtatattcattaacgtttttaaatgtaaaataactatcaaattaatttggtataaatatttgctaaagatttgtttaatacatgcagcagagagtgttaaaaagattacgtgaataaaaacagtattaataagagctgtaaacactaaatttatttgcggtgtgtttaattcaatattggtttggctctaacaatatttattgagattttatatttttattattagaattatttagattatgagtttatgaaagtctaagattgcatttaaatttattttacttacgctaagaatttataagatataagttgtatataaaaatttttattaaatcaaaataacgccgcggtagttcaaattaccgcggcgttattttataattatattatgcttttccgtttgaaccaaacagacgtattttttcaattactttagcttttacattttctctggcaggtccaatatattttctcaaatcaaataaatccggtttttctgcaaatatctctctgattttatcagtgtatgcacatcttaactctgtgtcgatattaattttattaactccaagagatatagctttctttatactgtcgttatctactcctgacgctccgtgaagtacgataggcatatttaggtctttttttattgtgtcaagcctgtcgaaatcaagttttggtatacccttatattttccgtgagctgttccgatagcaatggccaaatagtcaacgtttgtctcgtcaacaaactttcttgcttctgccgggtcggtgtacatagcatccttctcatcaacagagatattatcttctataccgccgagacgtccaagctcagcttcaacagaaacgccaacatcatgtgcggcttcaacaactttttgagtgagagcaatattttcatcaagtgaaagatgagaaccgtctatcataaccgatgaccagccattttttaaacagttcataacagttttaaagctgtcgccgtggtcaagatgaaatgctacaggaacactggctttgtttgctgctgttgttattaccgctgaaagatactcatatccggcatatgaaatagcgccgcatgttgtttggataaataccggggatttttcttcttcagcggcttctataatagcctgggcaacttccatattaacagtgttaaaggcaccgactgcgtaaccgttcttgtgggcgtcatccaaaatttgcttacctgtaactaacataaaatttcctccaaatataataaattttttatttttctatatcattttcacgataataataatacatatattgttgggcaaaaccggcgtaattgccgtatttttctgttacaaagctgtcagtttccttttcctcaactccatatacctgatttaaaatacgttttatccagacgtctttgggaaacagttcatatcttcccattgaaaacaaaagtatacagtcggcaacctttccgccgacaccctttattttcagcagttctttttttgcaagttcagtcggcatttcgggaatatcttttaagttaacttcgcctgacgagactttttctgcggcgtccatgatatatttatcacggtaaccggctctgagacaagctaaatcttctatgctcagactgtttaaacgttcaggttcagggaaagaataatactctccctcaggaataccaagtttactgttgtatttaaaatcaatcttgtctccgaattcacggcacatagtctcaagtattttttttatcctggggatattattatttgccgaaattataaatgatattatagtttcccaaatatcttgatgaagaattctgattccgccgccgaaatcaatacatttttttagagtttcatcgtggctttcaagatatttttttatttcagaataatctgtatcagcggaaaaataatttgtccaatattcattatcagaatcagggcagtatattgtgtcgtttgacactctgcaaacctttccgccgcaaatgccgatatagccgttgtctgactggttccagcggaagcattgtccgcattcaaacgtatgtataggatcaaagtcctgttttaagtaaatcatttcttaatctctctatctgtttaatatatattcttgatacatggagggttttaacatatatgttcacatattttactgttatagaagtgtgatattcaatagattctttaacggtgtctgcaatttttctcgcttcttcaacaacattgcatggatatcttaaagacagctcaatgtcgagtatgagacggtttcctttagtagtgctgctttttaatttaagcaatttatacatgctgggaaaccgggaagtttcatatgaacaaatatcaaaaatcgctttatgagaaattttgtaatctcccaaatagctgtaagtggggcgcataacggttttttcttcaactatagtatggtttttgcgattaaaaaattgaaccatagggtctataaaatatccggaaaactgtttttttacttcaaatgtaggaacaggaatcacatgctttccgtgtttagttctcatttcgttagcaattttcatctcttcaggagttgatacatcttcaatataaataaacttttctattggagaaactccgatagcgtcagctattttattcgccattctctcacttgtaccaataattaaaagcgattgtatattatagtccgtgatggcctttttcacttcatcctggtgaatcttatcactaaaaattgctcttcgcacagacgcaactttagttggttcgcgttttgcacttttgccggctataatttgattatccgagaccagcaagccgtcgtctatgatataatcaatattattttcccgggcgacccacatactgtgatgtgattttccggttccggattttcccacaagtgcatagaccttcatagtattactccttgtcaagtttctctttattttcacattctgaaatcttatatgaaagcctcataagactgtcgcttaaatgaacgttttcaactattattccttctgtttcagcaagttcggtatatgaaaaattcataaatgcctttattcccatgcttattaagtcctcagcaacagctttcatagcttcctttggaactgtcagtatagccattttgggatgattttcgtctataaattctttaatgtccgcataatccataaccgtaaagtcgctgacttcagtgcctataacttcaggacttgaatcaaatattcctataagtttaaagccgcggctttcaaatttagtgtttgtggcaaaagttcttcccatatgcccggctccgaccaaaacagcggtataaccacgattgagaccaagtatattggcaatctcagtcctgagcatctcaacgttatagccgtagccctgctgaccaaacccaccgaaacagttgagatcctgcctgatttgagaggctgtaactcccattctctcgctaagttctttagaagatattctttcggttccgctgctgcaaaggtctgttaaatgtctgtaatatctaggaagtctgttgatgacagaacccgatacttttttatccattgtttattctccttaagtgcactgccgcaaatgcggcagtgcaaaagtagttcggtttgtgaagctggtcagaaaagccgtagtattatgataattttgacattacataatctgcaaactctgcagaagttgctccggtatctcttccggttatctgaagcttcttttcagtgtacatacactcatcaagagcgttttcaagcgccttagctttatcggcataaccaatatgctcaagcagcataacagcagctcttatgatactgcatgggtctgcatatatgtctcttccttcctgaaccattcttggagcgctgccgtgaatagcttcaaacatagcatagcgttttccaatattagcacttccggcagttccaactccgccctggaactctgcggcttcatcagtaagaatatcgccgtaaaggtttggcagaaccaaaacctggaactgggttcttctcttagggtcaacaagttttgctgtcatgatatcaatataccagtcgtccagttcgattccgggataatccttagccacttctttgcatacgctgaggaagtttccgtctgtagtctttattacgtttgcttttgtaacacaagtaacgcgtgttttgccagcttttttagcatattcaaaagcggcgcgtgctattctttctgttccttcatgagtttgaacaacaaaatctatagctaaatcgtctgtaacgtttactcccttagaaccaacagcataaccgccttcagtattttctctgtagaacgtccagtctattccctcttcgggaactttcacgggtctcacatttgcgaataagtcaagagccttgcgcattgcaacgtttgcactttcgatattcggccatgggtcaccctgtcttggtgttgttgtggggccctttaaaataacatggcactgctttaattcctccaaaacatcatccggaagcgcttggttaacttcggcgcggtgttctatagtacagccggtaatttctttaaactctacttttccggcttctgtttcgtcttttagcaagaactttaatattctttcagcctgctctgtaatagccggtccgataccgtcgcctccgacaacaccgattactatcttatcaagtgtgctgaaatcaagaaaatctttttcagctttcatcttttcaacacggttcagctgctcgctgagcacctgaccgaatttttcttttgcttctgtgatttgtgctgtgtagtccatttatatctcctcctgtatattgtctgtcttgcctgctttataagttttggttaagcattctctttggtgtaatttaaaagtccgccggcgagaagcatagctctctgacgctctgaaaggtcaagtttcgcctcaaactcaaagcctttagttttgtctgtaatttttattatatcactgtttttaacttgttctcttacgtttgcgatatacaagtcgtccatttggtcaactttgtcatagtcagcttcgtttgcgaaagtcataggcaggattcctgcattaattaagtttgccatatgaattcttgcaaaggattttgtcaatacggctttaacgccaaggtaaagcggagcaagagcagcgtgttctcttgaagagccctgtccatagttgcttccgccgattattatgctgcgtttgagctctaaagcgcgttttggaaattcctcatcgcacactgcaaaacaatattcggaaatttttggaatattagaacgcagaggaagaatctttgctccggcaggcataatatggtctgttgtgatattatcaccaacttttagactgcattttgcgtctatttcgtccaaaagcggttctgataccgggaacggtttgatgttaggtccgcgaagaacttcaactgtgtccattttttcttcctcaatcggaggaactaccatattgtcatttatagtaaacacttcaggcagtttgaactcaggcatatcgcccaaacttcttgggtccgtcataacgccggcaattgctgaaactgcggcaacctcaggagataccaagtaaacctgaccgtcctttgttccgcttcttccctcaaagtttctgttaaatgttctgagagaaataccgcctgaattaggtgactgtcccataccgatacaaggtccgcaggcgctttccagtattctagctccggcatcaatcatctttgaaagagctccgttttctgctatcatattaagaacttgttttgaacctggtgcgatggagagagaaactcccgggtcaacagtttttccatctaaaatatatgcaactttgagcatatcaagaagtgatgaatttgtacatgaaccaatacatacctggtcaattttcattccggcaagctcggaaatctttttaacattgtcaggtgagtgcggacaggcagccataggctcaagttcgctcaaattgatctctataatttcatcatattcagcgtcagcgtcagcgctgagaggtttataatcggcttccctgtcctgagcttttaaaaattcacgtgtaatttcgtcagacgggaatatagaggtagtagctccgagttcagctcccatattagtaatagtagctctttccggaactgaaagcgatttaacgccttcaccgcagtattcaataaccttgccgacgccgccctttacagacaaaattctaagaacttcaagtataacgtcttttgcggcaacccatgggttaagctttcctgtaagctcaactttaactattttagggtatgtaatataatatgtgcctccgcccatggcaacggcaacatccataccgccggcacccatagctatcataccgagacctccgccggtaggcgtatggctgtcagaaccaattaaagtttttccggggattccgaaacgttcaagatgtacctggtgacagataccgtttccgggacgagaaaaataaataccgtgctttttacaaacactgccgataaaacggtggtcgtcagcattttcaaaaccgctttgcagcgtgttgtggtcaatatatgcgactgatttttcagtcttaactctgggaactcccatagcttcaaattcaagatacgccatagttccggtagcgtcctgggtcaaagtctggtcgatacgaatacctatttcctgcccttttacaggttcgccctcaaccatgtggtctctcaatattttttctgtaagtgtcaaacccactaaaaatcaactccttttcaatatacaaatactttttaattgttatgtattcattttatattaacatgcccgaaatgtcaagcgttatgttaagtttttcacaataattacagtgtttccaaacagtgggattattgtgaaattgggctgtataaatgagaatatattgaaatgaaaatcatataatctccatttgtttttaattacaaacgttagtttgatgtgcctagcccggttgcgcccgccggacccgggcgccgacacatatttttttattttattatatattaaatatggagtaactttgttaataatctattaaatataaaaatatataaaaaataaataagaataataacaatagaatgtctatatggtttgaaaagctaagaataaaagcaaaaattatttagcaaaaaagtttatttagcaacaaatattagcaacaaataatggtttggaaaaagaattagactgtaggtaaagtatgaagtgtttggcaagatgcacaagacaagctttagccccgcttgctcgaggatttaagaggcagctttgcggtttcaagaagaataaatagcgtttatgagcgttgccatttctcagctcagattcaacaatagttccttcatcggaggaatcttactttgtttattcaatgtttctcgtaaaattacctttttatatgctaaaataaattaaaaatttatgtttattatatattttaaattactttaatctatgtttataaaagtaaaatgaaaactataagtatatgaaatgattttatctataaaatatttcaaaaatccgatttaaaatcacattcatatttaatattcttgaaaagaataaagtatgtcagcgcccgggtccgacaggcgcaactgggctaggcacaccaaactaacgtttgtaaataaaagtaaataaaatctatttattaatttcagaattattagtccgccctacgagataatcaatagaaacatcaaaataatcagcaatagcggttatagtttttagactgggttgtgcagttccgtattctaaccgttgtacagaattaggctgaatatttatttgtttggcaagctgcttttgagtaataccgtttgaaactcgcaaatttcttaatttattattaaaactattcattaaaatatcaccattcttaatatgaattatataaatgtgtcagcgcccgggtccggcgggcgcaattgggctaggcatatcaaactaacgtttttaaataaaagtaaataaaatctatttattaattttaggattgtcagtccgccccacgagataatcaatagaaacatcaaaataatcagcaattgctattaacatatcatacgctggtttacgggatccttgttcataattttgaacgcctcgttcactggctcctataaattcagcaagttgtttttgtgtgacattatttaatttacgtaactcttttaatcttgtacttaagttattcattaaaatatcaccatttttaatatgtattaaataaatgtgtccgcgcccgggtctgacgggcgcaaccgggctaggcacatctaactaacgtttgtaaataaattatagtttatttattaatttctggattcttagtccgtcccacgagataatcaagagatacattataaaaatcagctagggaaatgagtatatcaaaagacggacgttgatcatctgcttcataacgttgataattccgttctgtaataccaatattagaagctacttgcttctgagtatattttaatgatacacgcatttcttttaaatgttctccaaaattaaacataaaaaataacctttcaataaattaatatatagaagcgcccatgcacaaatttgtctgctcaaaagattgggcatatcaaactagtattccgtaaataaaagtaaataaaatataatctatttatataatttgggattgtcagtacgtccaaccaagtagtcaatggatacgtcaaaataatcagctaaagcaatcagcacacttgccgtaggttcacgttgaccacgttcatagtattgatatgctcttaatgacaaatttacatcttttgcaatatctttttgcaaaaggtttttatctttttttaatttaataagtctgttagaaagtttattcataaaataacctcacaaattttgtaaaaaagtattgacaagcataaacgtgcatgatataataagttcgaaaagagcacatgtgtgcattcgttgctttggaaagagatgatgcaatattatacatatataaaaatatctaaaaactatataatataagattatttggtgtattgtgtacatagtaaaacgtagttgataataatcttttgtattattatagtttaacatggtttgacaaaataaacaagccttttattgggcttgtattaaaaaattaaaagaggagggagttataatgagcttctttttggaccctttcagcaaagtaaatattcagcagattgcttcatttattatgtatggggatgaatttacgatacctacaaaaggttcttatgaacagagaatagaagaagcctggaattcttttgttgaagaggcaaaaaaattatatccggatttaaaagaaacagacaggatttttgactctattattttttatgcttcggtagttgaggaaatatatatggaagtcggtatgaggtgcggagcagagctggctgtaaaactttttgaaaaagatatttaatataattattataaagattatacatcataattattacacagcatgtaataatttacttacatgctgtgctaattattgtatctcgtaatcaattgacggttaaattgatatagaaattaaagataaaatagtggcattacttagtatgataaactttgaggttaaaatagctttaaacagtttcatgatttgttataatgttataaattatatatttgattataaaaatataattattatacaaaaataatcttaaaagttttgtgattagaaaatagatgtttagtttataaatcaaaacattctcatgtgttccagtttaaactttatatttttaaatcttttttacgggtatacacaaattcgaaatcagaccgtctttgtcatttatctcagaaggagacgtgatatattcaagaaacaagtgtccgttaaaatcgtagccgtttatctccatccattcagctattgatttataaatgtcgcatatctggtcataccagcctgtaaatgtaacgcaggctgtgagtgtttcggggacttccttaaatttaagaatttcagagtcatcaaacttaccgttgacaccaatctgtacctcaatatccgggctttcatctttatggtcattatccatatagacagcgacaggagggcagtcatttgataaacaaatgtcatttttagcggcaagtaagtagattttcttccacagttctccttcgtctttatattccggtattgtttctcttaatgctgccactgagcgttttggtactgtctttaattcaacattatattttggcatagtctcattcctttcaagttttttaatagtcttatcaagcgttaaaagccgtttttcaatatctgaatattcagcctgcatttttattcggcattcttttataacggtcagcatagcttcaggagaatagttcagatgtttaagaattttaatttcggatatacttatacccatatccctaagaagttttacattagatatttcggaaagctgtttggtttcataataacggtatccggtaaatttatctatataagccggggatagtatcccatgctcatcatagtagcgcagcatacgtatgcttaccattgacagccttgagaaatcacctatttttaacattatatttccttctttcgtacatgtacttttagctcgtatttagtataatacctaacactgtgtcagagtcaacagtattttttgttttttatgaaaataaaaatttttttgaaaaattttcaaaaaaagtcttgacaaaaataaaattaggtattataatgcaagagttgactttggttcccctcgtgtcaacaattttgcgagcatgctggaatcggcagacaggcacgtttgaggggcgtgtgcttatggcgtgtgggttcaagtcccactgctcgcaccattatattgcctgattgtgtaagggtagcacaaatgactctgactcattttgtccgggttcgaatcctggtcaggcagccataaagcgtttgacacaatgtcagacgctttttattttaaaatttctgattggcggcggttatattttgtttgataaattgaaacagaaaactatgtcagcaaacgagtatgtcaaaacttttgtaaagtggatgtttcttgctactataaccggaggttttggcggtatagtcggttccctctttaatatgtgcattgtatacgttactaaaatgagaaataaaaacagctggctgatttttttgcttcctcttggaggactgctgatagtgtttctttaccggatttgtaaaatggataaaaattcgggcactaataatgttatcaaatcagtgagaagcgaggaggatgttccgtttcttttggcgcctctgatttttataggtactactgtcactcatttatttggcggcagcgttggcagagaaggagctgctcttcagcttggcggcagtattggagaaatgacaggtaagctgattaagctgaatgagaatgatatgcacattataagaatgtgcggtatgagcagcgtgttttcagctctttttggaacccctctgactgcaactttttttgctcttgaggtcataagcgttggtataatacactattcggcttttataccgtgtcttttgtcggctgtgctgtcgtataaagtgtctttattgttcggaatcatacctgagacatacttgcttccatacatacctttgttatctatggcatctttctttaagaccattgctattggtatagtttgcgctgttgcaagcataattttctgcgttggaattttcggtacaaataagctttttaagaagtggcttaggaatccttatctgaggatttttgttggcggagttataatagttgctttaacattttttcttggaacaacagattataacggagccggaatgaatgttattgaccgtgctgttttagagggaaaagctttgccttatgcgtttctgctaaaaatgatttttacagctatcactattggatgcggtttcaaaggcggtgaaatagttccgacattatttattggagcgacgcttggctgcgttcttggaggactgcttcattttaatccggctttttctgctgcgctggggatggttggtatgttctgcggtgtggtaaactgtcctatagcctctgttttgctgagtgtggaattattcggttccggaggtattgtgttgtttgcgactgtggcagctgtaagttatatgatgtcaggttattatggattatacagcggtcagaaaatagtttactcaaaacttagaactgagtttataaatatatatacaaaaaaagaatattaattttgcggacattcagtccgctttttattttgtcccggcgtaatatgccgggattttttattttaaagaaatattttaaaagttaaaaatatgtataggtttttattgtcaatcgtattgtttggtgataatggattatcaggatataattattcagtgattgataatgattttattggtgtaaggcattatattttctgctattgtaaaaggcgtttttgacaatagattttattagttttaattcgggtaaaattaatgtcgatatttttggataaaaaacttttgggaaataaaggcggaaataaagtctttgtctaactctatcaggtagccgtttattaaggattaaattataaatgtggacataaatgatatgagattataaaggaggaaattaaatgaggtatgaaacagaacaaataggaggggctttggtggtcaagctatacggcgagattgaccagcattgtgtaagcgagatacgtgacgacattgacagacagattgctattaggaatataaactcattgatagttgatttgggcggagtagaatttatggacagttcaggaatcggtatgataatgggcaggtataaaaatatggtcagccgcggcggaaaaatgatgcttgttcgtcctcagccacaggttgacaaagttcttgaactatcgggtattaaaaaactttttgaaaagaattgcggataaaaaggagtgaataaaatgaataactatatgaaactggaaataccatcaaagaccacaaatgaagcttttgccagagcggcagttggggcgtttgcagctcaggttgatttaactatagaggaactgtccgatattaaaaccgctgtttctgaggctgtaacaaattccataattcatggatataaagacgcaagcggggttatatttataaattgtaatataagttgtaaggatgacaagtatactattgagatagttatagaggataaaggaaaggggatagaggatatagatgtagcaatgcagccgctatatactacctctccgaatgacgagagaagcggaatgggctttacagttatgcagagttttatggatagcttggatgtaaactctgttttgggagaggggactaaagtagtaatgacaaaacgcattggagccgaaaatacttatgactaaattttctgaagcaaacgatgaattgctgaaacggatttcggaaggcgatgagagtgcgcgggaggaaataatagagcagaatataggtcttgttcgctccattgttaaaagatttttaggcagaggccatgaagctgaggatctgtttcagattggctgtatcgggcttattaaggctgtaaataagtttgacagaagctatggcgtaactttttctacttatgcagtgccaatgataataggagaaattaaaaggtttattagagacgacggcataataaaagtaagccgtgcgtataaggacatatcatacaaggctttcactgtcaaagaaagaatgatggcggaacagaagacagagcccactttggcagaaatagcaaatgaattgaatataactcctcaggagctgtcaacagcaatggaggccgcaaggtccccggaatctttgtatgctcagactgacgacggaaaatctgaggggcggtctttgatagaaaaacttccgtctgacgaggattatgaacaaaaaatagagaaccgaatattgcttagtcaggcgtttaaaggaatggatgaaagagagaggatgataatatatatgagatattttaggcagaagacacagtcagaaattgcagctgttttaggtatctcgcaggttcaggtttcgagaattgaaaaaaaggttctgatgaaaatgcgtgataaattaacaggatgatatgtaaaatttgtatatcatcagatattttaggtcataataattccagacagaataaaatggaaaaggagagaatttttatggccggatctcaaaaaaataaaaatcaggaatatcttgactatgtaaacagaacatcgcccaaaagtccaatgctcaaaaatatgctgctggcatttttatttgggggtctgatatgtgtaataggacaagcctttggagatttatacaaaaatgtttttcacatggatattgaaaattcaaagacggcagtcagtataactatggtgtttttgggagctttgctgacaggacttgatatatatcctaaaatagcaaaatatgcaggggcaggtactatcgttccgataacaggttttgcaaattccatagcttcaccggctatggagtttaaacgagaaggtcttgttacaggtatgtcagccaagatgtttgttgtagccggaccggtgcttgtttatggtataacaagttcaattgttgtcggaataatatattatctttataagattttgataggaggttaaatttatggccgttcgtttaggaaagcagacaatagcacttgaagctccggtatctatagtaaatacagccacagttgtgggaaccaaggagagcgaggggccgttggctccatattttgatgttcatttgaatgacgcagagtggaatgaagaaacatgggaaaagtcagaaagcaaaatgcagagggaagctgcaaaactggcaataagaaaagccggaatggaacccggaaatatagattgtgcatttgcaggggatttgcttaaccagtgtataagctcaggctttagtgcgagagaacttgaaataccatattatggcttgtacggagcatgttcaaccatgatagagggattgagtttaggcgctataagtattgacggaggaggatttgacagaaccatagcggtagcgtcaagccacttttgtacagctgaaagacaatatagaactcctcttgagtatggcggacagcgtaccccaacagcacagtggactgtgaccggagcgggagctgcggttcttgaaaaaagacagtttccgccttatattacccatataacaacaggaaaggttattgactttggagtgacagaccccaataatatgggaggtgcgatggctccggcggcaatagatacattaaaagcgcattttagagatacaaagagatcacctaaaaattatgatttaattttaacaggagatttaggaaaagtaggaagagagatagttatagatatgatgacagccggcggatttgatatggaacaaaattataatgacaccggctgtatgatatatgattttgaaactcaggatgttcatgccggaggcagcggatgtggatgtgttgccgttactctttgcggatatgtttttgaaatgatgaaaaagggtgagttaaatgatgtccttatattgggaacaggcgcattgttaagcccgacgtcgtctctgcagggagaatcagttccgggaattgcgcatgcgatttcactttcaacaacaccaggaggcggaaaaaatggattatattaatgcgttttgggtaggcggactcatatgcgtcgcagcacagattttaatagataagacaaatatgactccggcaaggattttggtactgtatgttgttataggaacaattctcggtggaattgggatatatgacaaacttgtggattttgccggagcaggggcaagtgtgccgcttgttggatttggcaatgttttggccaaaggcgttatgaaagcggttgacgcgaatggtcttattggagtaattacgggaggaactgcggcagcagccggaggtatagcggccgcaatattctttgggtttttagttgcattaatttttgatccaaaagctaaaaaataatttaaaatacttcttaataaaagcatattactttataataatattttatatttaatttaagtttttgacttaagatttaaaatttaaatttaatgtgatttattattgttataagttgtcagttatttaaagtatttttgcttgttttaaataatatttcagaaatgtgacaaacgtttgatataaaccatttattgtttttattttatggtaaaccattaaaaattaacttaacatgaatgtcaatgttacaaaagtattaaaagatttttggttaggatataatgattaacgtatttccagtaatcccatagtttcttatatattacattttaaaatttgctttttggatattgaaatgataacatatcaatttgaaaagtaatatatatatgaaatcagagttaaaactttattaggaggtgggattattgatggagagcggtgcgaaacatgggcataaaaacagcgacgggacttttggaattatcaaaagagaagtcaggcttgaaggctccgctgaatgcgtagaatgtgtatttgagggatttctcaggtgttgttatgaaatagaactgagggaacatgaattggttagtatagaatatttgctgactataggacatgataagtttcgccattatggaattaaagcaataatgagaaataaggataatgatattttagattgctctgttgctgaaaataggtttgctacactaactgaatgtattattaaaatgcagatgctggctaaagacaaagtccttccatgcactttgccctatgtagtataaattaaaccgtgttggtttttgtaatataaaaaaagactgccgcattagcggcagccacagaaaccaatatatacataaataaaaatcagtttattctattgtttggttggtgttgtcaacctgagcaggtgcgcttggaacaatatttccgctgtttctcatttcgtttctattgtttcttacaatattaacacattgttctaaatctttcatagaagacataacgactttttcaacagtttcaagaagattgtctgcgtaattaaaggaagaatcagtaacttgctgtgcattcgaacgagcgttttcgataatctgattgccttgaacgatagctttttttgtaatctcgttctcgttgaccatggcaataatcttatcttcagcacttttaattaaattatcagcctcagtttgagcttcctgcaaaattctttgtctttcttctttaatccatttagcttgttttaaatcatcgggaagctttagcttaatctcttgaagaacgtctaaaagttcatctttatcaagaatacagcgtccggaaaacggcactgaagcgcctttgtcgattatatcctccaattcatccaacaattctaatgcatccatataaaatacctccttgaaatattaagccggtctagtattttgaattttcgaaacggctttttataatagggattaagttgtccggaacgagaccgttaagacatccgccatactttgcgatttcctttacgatactggaacttaaaaacatatattctttacttgagtgcagaaataaagtctcaagctcttcatataaggtttgatttgtaagcgccatttgaaattcatattcaaagtcggataccgctctaattcccttaataattatctgtgaatcaattttcttcataaaatctaccagcagaccggaaaacgatgttatttcaacattttctaagtcaccggtaacaagttttaacatttcgacccgtttttcaactgaaaacaaaggattttttgaattgttgacgagtacggcaacaactactttgtcaaagagttttgaagctctttttataacgtccatatgtccgtttgtgcaagggtcaaaactgcctggatataccgcagttctcatataatcacctctgcataaccgttattaccgttttgccatatctggatgattttaaaatgtcaaacccggtacttgttatgtcttcgccgtctgtctctgtttcggctactataattccattctctgataaaagattgtactcataaatcttattcagagatttaacaagaagccccttattatatgggggatctaaaaaaataatatcaaatccgtgtgtcaatttaaacggaatacttttgccgtctaaagttaccataacgtccccgtcaaatagcttatccaaaaaattaattgcgtcagtctgatataggacagaaaactcctgaagacctgaaccattaaggttattgtttaccaattctgcggatttgcgactattttcgacaaatacagcgtagtctgctccgcggcttaacgcctctataccaagggcgccgcttcctgcaaacaaatccaaaaccaaacggcatggaaaacgcatttgaattatattaaacagggattctttaactctatctgtagttggtctagtgccgtcaccgagcggagaagcgagcttatatccgcgttttttaccagatataatacgcaaaacaaagtcccccttgccggaaatagagttaagtaatatattctatatatttatatatcaaatttgtaattttgtcaagcgttttaaacaaatttgtaactattaccaaaaaaagaaaaaagtcgaaaaataaatataccccacgattgccgtagaatggataaggtaaaaacctggaaaccaggtgggatcgactcaaaagcattacaagtccactgaatacccaaaggtatgaggcatgtgcgccgcttactgaagttttgatcccttataaaaattgttggttttacattattgccataaatacgtacaacgcagggaaatatttaattcatatcatattatatcatatttttttaaaaatacaacatttttttgattttttttgttacaaatttttggttttgtatttaagaaattcatttcgttaatgttacagggcgtttcgggaactttacaacctaataacaaattattatttccaaatatttaggattgaaataaaaaaatttttagttataattaattctatattaacatagattttattgagtatcggccgggtggttaaaaactgccgtactttaaattaccatttgctataatttgtctgtttcgtattttgtatatcaattagactaatattttttgtggttattatagcagaaaaattttcagggagattgttttatgaagattgagaagatcaatgagaataaaataaaggttttaatcgacattgacgaagcgaaagagtggaatgtgaatataaagaacatagcgtcaaatacacctgaaattcaggagatgttttggacagcgcttcgtcttgccgagaaggatgtggaattttcagttgacggagcaaaattatttgttgaggctataccgggacagacagaggggtttggaatgcttataactaagatatttagtgataatgacctaaatttggctgtttcaaattgttcatataagggtcgtgtcaaaaaaagaaaattgacgcctgggaggaatgagtgtataaaaagggctttggggaaacgtatattcaggttttgtgattttgaaaatgtttgccaggctgcaagtgcggtttatcgggattttgagggagaaagcactctttataaacttgaagattcatattatatgctgcttcttccaacagacagctcttctattattgggatagaaaaggttatgcttgagttttccgataaacagtctaagacgcttatatctcacggcagactcaatgaattgggcgagataatgataaaagaaaacgcagtaaatatattatcagaatatttttcataaactacataaaatatactttataaattcaaaatcggcagagtaataatcactctgccgatttttaagttatagctcttaatattaggttaaaataagtattaggtattaggataaaatacagcgtctaataattaagatttgtcaaacaagattattaccggcgctgattctaataacaaaaaatcttacatacgaatctatactatgactttgtacttaaagaagcgcaaaatacatatggattatataaatatcgtatgttcaacttatttgataaagtaaaacaagttaacgaaaataactataatgaaaataaataaaaatgtggttttgcaagcatcggtagggaaaacgaagtttgccgcgtaaggcgcgcagccgcggaaaagctattataaaaaagtttatgttaatattaagcggattgtttgataaacctacactttcaaaaaattacttagttgtggtgtatattcttgaacaccgagtgaggtgatcagccatatcacgtgaagtatgaacatacttagaataaattgacatagttttttaataataaacttttccgcggcgcgcgccttacgcggcagatttcatctgccattcgaagcttgcaaaaccacatttttatttattttcattatagttgatcttatatttgccttaaaatttctgtccatatattataacatttccaataaatcagttttcaaattttgacagcttataatacctctataaaagttatattaataaaaattaaatgggtgtaaaatcaataatttgattttacacccatttttttagttttcttcatattaatgaaagattatgaatatgaatgatataactggattaattaaaacattttaagagaagggaagaacttttatggagaacaatgaatcaatgggaagacatactgtcactattgaagaccgaaaacgaataaaaataaattgcgttgaggacgtggagagctttaatgaagaaaaagtagtagtttatacaagcatgggcgtaatgatagtctccggatttgattttaaggttaaccgtttgagcgttgaggacggacagctaattatcgacggagaggtagacaaggtggaatatatggaagttgcagataatgacgacaggggaggctcaggatttttcggaaaactttttagataaataaattacggaggaaaaacagatggatacaattacaaaagcaaacgaattaaattactttttttggtcaatgatatgcggcgttgcaatgacaatagtttatgactttttgagagctagaagaagagaaaaaaagcaggttggattatttatatatatagaagatatagtttggttttgcgttttaggggtgctcgtatacttgcttgcattcagacagaatgccggtatgataagatggtacagtttttttggaataggactgggggcgcttatttataaactattgctcggcgacaaacttatgaacgtgtttagaaaatgttattcatattttgtcagggccttctgttttctaataaaaattataatgtggcctgttagatttatagcagctttaattaagcggccgattggagttgtagtgtggcattcaaggaccggctcaagacagctgtcagatatgatgaaagtgtctaaacagcggcttcgtaacagaatgagatataaggcaagaaaaacaaacagcagtgaggaagatgaataataaagctgtgattataaaaataactaataatgggtagaatatccaagtaattttgtattgtaaattatagtatttgagagactttttcattgacaaaacgtatttgataatatataatatccttgtaggtttgtaaatttattacataatcaaatagctgtgaagttttcactgctgttaggaggatgagcgtcggtgaattctgcgggagaaacaaggagaacagataaaaacagcagaaatttttcgtcggtaggcgcggccgctgcggatgttaaaagcagggcaacaaaaacgataaaaaagactaagaatgttaaattcaatataaaaaggctggttgtgtctgtagccgtactggttttctgtgtatattttgtttgcatgatgataggtcagcagagcacaatcaatcgtaaaaataacgagatacggaacctgaatgagcaaattacttcggctaaccaggaaactgaaaggctgaaggaagagcttgaaaatgtaaatgacccggaatatcttgagagaatggctagagagaagctgggacttgtaggtccgaatgagcgtgtttatattgacgctaacagcacaaactaaagttgagttttagactcacattttaattgagtattattaatttatataagcgagagtattctctcaggagggaaatttagtaagtatgcaaattgaagttggaatggttttaaatgtaaaggttaccgggattacgtcatttggcgcttttgttgagctgcctgaaggaaagtcaggacttattcatatctcagaaattgcatccgcttttgtggaggatgttaatcagcacttgaaaaaaggtcaggttgtttccgcaaaggttatcggtgttgataacggcaaaatcagcttgtcaataaagcagctggaatccggagaaaatcaagctaagccggaaaagaagccaaaagacagaacaaagaagaggacttcaagtccccgcagcaatcaaccgccggaagagtttgaattcgtgtcaaataagaatagaactgacgatttgagttttgacgatatgcttcaaaaattcaaaaaagacagcgatgaaaaattccaagatttgaagaggaacactgataataagagaagcggcggttataagagggcatactaacagattgtaggtgattttatgacaagtgccggtatattttggataattgcggcagttttgttcgctgtgattgaagctgccacagttgcgttggttacagtgtggtttgcggtaggagcacttgcagcggcaatagcagcgcagtttggagcaagtattttatttcaggtcggtacttttgttgtagtgtcggctattttgctttgcgttactcgtcctgttttcaaaaagatatctgtgaaaaagccgcagagaacaaatgcggacaggtttataggcgaagaggctatggtcattaaaaaaattgatgatataaataatgatggtcaggtaaaaatagcaggacaagtttggtcagctgtatcggaggataaaagtccgcttgaagagggaacaatagttaaggttattgctatcagaggagtgaagctggtagtagaacctattaattcataattttattgaaaataatttgattttataaaatatatttatgaggtgaagcagcatggtatttctaattatattacttgccataattgttgttcttgttgtggcaaatataaagattgttccccaggcgcacgcatatgttattgaacgtttgggagcgtacagcacaacctggagcgttggtcttcatattaaaattccgcttattgaacgagtagcgaataaggttactttaaaggagcaggtagttgactttcctccgcagccggttataacaaaagataatgttacaatgcagattgatactgtagtatactatcagattactgacccaaagctttatacctatggggtagagatgcctatgtcggcaattgagaatctgacggctactacacttcgtaatattattggtgatatggaacttgacgaaagtttgacgtcaagggatataattaatactaaaatgcgttcaattttggatgaagcgaccgacccatggggaataaaagttaaccgtgttgaattgaaaaacattatccctccggcaggtatacgtgaagcaatggagaaacagatgaaagctgagcgtgaaagacgtgaggcaattcttagagccgagggtgaaaagaagtcagctattttggttgctgaaggtgttaaagaatccagaattcttgaagctgaggcagaaaaggctgctcaaatccttagcgctgaagccgataaggaagctgctatacgcattgctgaaggtgatgctgaggcaatcagaagtattcagcaggctaccgcggatggaatcagaatgcttaatgagtctgagccgggtgaggctgtattgacaatcaagagtttagaggcgtttgttaaagcggccgacggtaaagcgacaaagataatactgccgtcacaaattcaaggtatagcagggctggctacaactcttaaagaagttatgaaggattagttttactaaaataaatatgttattattcatttgcacagatgattttatttcatctgtgcaaatgctatgatatagataaaagacttaaattacagagatttaaaacataggaggaaataatatgtcaggacattcgaaatgggcaaccataaagagaaaaaaaggagcaatcgacgctaaaagaggtaagatatttaccaaaatcggcagagagctaatggtggctgttaaagacggcggacctgacccggacacaaattctaagctgcgtgatgttattgccaaagcaaaagctaataatatgccgaatgacactattcaaaggagcataaaaaaggcagccggagaaggcgacgcaggaacatatcttgaaatggtatacgagggatatggcccgagcggaattgctgttatggtggagactttaagtgacaataaaaacagaacggcggcagaccttagacactattttgataagaacggcggaaatttaggacagagcggctgtgttggattcatgttcgacagaaaaggtcttatagttattgagaagaccgactctgttgatgaagataccttgatgatggacgctttagaggcaggagccgacgattttaatgttgaggatgagtgttatgaaattctgactgctccggaagcgctgggcaagaccagagaagagctggaaagcaagggttatacattcgcacaggcagaagtaaattacatacctcagaccactacgaaattagataatcctgaggacattgccaaaatggaaaaactgattgatatgcttgaagaaaacgatgatgttcaaaatgtttatcatacttgggatatgccggacgacgaggaataatattatttatactgagctgcaaaaaaacagagcggcggctgaaaatgcggcgtgaatctgtttttctgcggctttatttataggaggtggatttgtggcacgtatactgcatatggcggatatgcattttgattctgcctttacctcgaacctttcaattaataaatcaaaacttaggcgaagcgaacagcgtgaagtcttttcaaggataattgaaatggttaagaccgaacaaattgatgttatgttgatttcaggcgatttgttcgacagtgaaaatgtcagcgaagaaactattaactttatggttagaaaatttgctgaaatttctgaaatacctgtattgattgctgctggaaaccatgacccttttaatatgaattctgtttatgaaagaatcagtttaggtgataatgttcatatcttcaatatagaaggcggattttatgattttgaaaatcttaacctaagagtttccggagtcagctttggcagcgaggacggaagcaatattaaaactccgaaaacacttcatcctgaattttcgaatatacttgttatgcacggaaatgttgtttctggtactgctgagagcggaataagatataatcctgtgaccaaacaagaaatagaaaactcaggatttgattatatagcttttggacacgttcattcttttagcggtataaatgtagaaggaagaacatattgggcttatccaggtatacctgagccgcgcggctttgatgaaagcggagaaagcggagttgttataggaaatgttttaaaagcgggttcagaatttaacttacgtaaagttttaaagagaaattatcatacattagaaattgagataacggcagatatttctgataatgaacaaataatcgagcttattgacagtaagataaaagagtacggcaatcaaaatatttttagaataatccttattggtaaacttcgatcagactttttcattgatattgatttgttgaaaagcaggaccgaaaagcttggtttttttgttgaaatcaaagatgagacagaaatggagtatgatttgtcggttgatatccaggataacagtttaagggctgaatatataaggttgatgcagaaaaaacttgatgaatttgtgcacggaacacgtgaatatagaattattgagaacgctgttaaatatggtttggacgcgatagaaggcaggcttaaaccataaggaacggaggtgagcaagattagaattacccggttagaattaattaagtttggaaaattcgttgactattctattgatatcagcgatggaatgaacgtaatatatggggataatgaggctggtaaatcaactattcagctttttattaaatttatgctctttggtattccttcgagaggcggaaagagagaaaaaataaaagacagagagaagataattccgtggcaggataataaggccgccggaaaactctttttgataaaagacggcagagaaatagaggtataccgggagttcagaaaacgtccttccggagatatagtaaaagtaacagacagatatactggagaaaattattttaacaaggaaataaagtctgaagacgtcggcgttttgctgcttggaatgagcagacagatgtttgagcgcacagtttgggtaactcagagtagtatttgtatgcagggcagtgatgatgaaataactgctaggcttataaaccttttggagagcggcagtacaagtgatgtttcaattaaaagcgctgtcagtgggattgaaacaaaaatagcaggattaaaggcgaaagatggaagaagcgctccgggcgaaatagatttgcttaaccgagaacgtatagagttaaataaaacgctgtctgaacaaagggcatctgagagaaagagaaatgaagtaaatcaagagattaacttgcttactcagcgtaaattaaaaattgatgatgaaataaagcatcttgaagcggttgaaaaatccgagcgggcaaaagaaaaaatattgcgtgttgacaggatagatggctgtgttcaaaaagaaatgcaaattgctaacacaaggcagtttcagctttttaaacacaatgctgttcctgagagggttgaaagtttgcgctcagattctgagcatattgatgaacttgaggtaaaggcatatcagacgcagcaagaacttttagctgaacaaaactgttttgcagcagaagagaaaaagagaaaaagactgttatattttttaattggagctgccggattggctgtaattttagctgtgttaggttttgtattcggagtgggaaaaaatatattttattggataacagcaggagcagttgtattatttctaattgctgcaggaattattttcggttgcattattcataacaatatagtaaaatcaaaagaaagtttaataagtgttgacaatgaactttcacttataagaaaagagatctctgaaactgaaaagagattttcagaaagtctatccattttggaatgtgatactttaaatgattttaatgaaaaatttaggttatattctgagggtaaggcaaaaataaagatggtgagagaactttatgaagaactcttaggtcaagacgattatcaggagttaaagagagaggccgataatcaaagaaagtttgttatcgaatctgataatgttgaacctggtaatattgaacgaaaactggattcattaacaaatgaaaaggaaaagatttccgggcgtattttggagctgaaacagttaaagatagacggaggtttggaaattcctttgattgatattgaaaataatataaagtttattgatgaacaaattattgaaaaggaagaggaatattcatcataccaagcggcgaaggagggacttatccaggcgtatgcaaaaattaagtcggattacactccgctgctgaatgcagagacagaaagaatattaacccggcttacgggaggccagcatgacagtataaaagtggcagaagatttttcactcagcttaaaagaaacagataaaaatattgatttgaaacaggcggagttttttagtacaggaacatataatcagatttatttggcacttagactggcaataattaaacttactttaagcgcttcagactcagtaatatttttagacgatgttttaacaacatttgatgacggaagaagcaaagacgcgcttgaagtaatcagagaaatttgcattaaagacgggtatcagtgtttattattcacttgtcatcaccgtgatatagagagtattaaaaagtatcctgatataaatataatggaggtattattatgagcggaaagtttgataattcaagaggaaatgtgaaaatagcgaacagcgtaattgctaaaatagccggttatgccgcaacaagctgttatggagttgtgggaatggcaacaagcggtggcaaggacggtattgcaaaactgcttaaacgcgaaatgatggataggggcgttaaagtaaagttaggcgagaacggtatagatatttctctttatattattgttgagtatggcacaaacatcaatgctataggcgaggttataaggagcagtgtgaaatataaggttgaggaaatgtccggcttaaatgtgaatactgttgacgtaaatgttgagggaataagagttaattagagcggattttataagaaggagaataaaatgatacagcttgacagtaaaagtttaaagttaatgatagcttctgcgtcaaatcagattctaaacaatgtcgagaaagtcaatgatatgaatgtttttccggttccggacggtgatactggaactaacatgagtatgacgttcagtgcggcggctaaaagcgttgttgatttggataataaaaaatctccggttgaagtgttggaggttctttcaaagtcagctcttagaaacgccagaggaaattcgggtgttattttgtcacagattttaagaggtctgtggcagggagctgaacaatcaggagaacttgacgttagcggagtgaagcatgctttatgtgaagccagagacaccgcataccgtgctgttatgaagccgacagagggcacaatattaaccgtaatacgtgaaattgcggagtatgcggaagctcattttgtggagtatgatgatgtcactttatttttgaaagctgttcttgaggccggtaggaaaagccttgccaaaactaaagagattttgcccgttttaaagcaggttggcgtagtcgacgcaggaggatttggcgttataatacttctcggcggcgcggtaagcgctttggaaagcggcaaggcggcggaacttgaagagagcggcaaagcgaataataaacaaattgcatctcagggaattaaaagcgctgaagcagatacttcggatataaaattcagatattgtacggagtttttgataaataaagacagcgagcgaagtgccgcccagttgatggcagccattaaacaaaaaggcgattgtatgctggtcattgatgacgatgaaattgtaaaggttcatatacacaccaatcatccgggatttgtgctggaacaggctttgaagcttggtgagcttaccagtataaaaattgataatatgaaatatcagcataatgaaattgttaacggaagccagaaagaagatgaggaattttcagacaatgaaaccgaactgaagaaatatggatttgttgccgtatcttcaggtgatggtttgagccaattgtttgaaagtcttaactgtgataaaatagttgcaggaggtcagactatgaatcccagcacacaggatattttagacgctgttttagatgttaaagctgaaaacgtttttgttctgcctaataataaaaacattatacttgccgctgaacaggtgaaagaactggctgacgtgaatgtaatagttattccaactaaaaatatgcctcagggtatagccgctatcgcagtatttaacgaagacgcagacttggacgaaaacatttctgtgatgaatgagagtgctgatttggtgaaatgcggacaggtgacctatgcagtaagagacactaagattaacggagtggatgttgaaaacggagatattatggctgttattggcagtgatttgtctgtggtaggctctgatgttaatgaggtggcaaaagagttagctgaaaagctggtagacgaggacagcggtgtaatctctatatattacggcaaggatattgaaaaggagaaggcaacagaactttctgcttatttagagaacaaatattccgatttagatgttaatttaaattatggcggtcagaatgtctattattatataattgctgtggaataagtttatttttaactataatttatatattcagagatataataacctttatatctccattttgtttataaaattcaaaatcggaaagttatgatagcaactgataaatggtgtgatgaaaaatataagacaattttagcttcgtacatatttatggtaataatttgtttggtttgattgaattagataaacgacatctattttgaatttggactgtggaatggtgaatagttttgtttgacagattggctgagcggtgagaatggtctttacgattgtactaaaatgtttattaaaaagaccttcgaaaatttcactgatttatgctgtgatgagataataaatgaacagtgcttggattgaagaataaactttatggaaccgtgtattgttgattatggctgttaaaatgcaaagctataaaagccggataaaacaggactttaaaaaataaaaatgctgttaaaaggaagatttttatgttgcttagtgacagtgtgcagtatttaaaaggaataggagaaaaaagagccgagctttttcataagctgggtattttcaccgtggaggatttgttatatcatctgccgagaggatttgaagacaggacaaatataaaagatatttcggatttggcagaaggggaaacagtttgcgttaaaggcgttttggctatgggcttaagaaagttcagagcacggaacggcacttgggttattcagaccaggctctctgacggaagcggagttatgcagctgacctggttcaatgctccttatgttgaaaaatcgctggaggacccgtctgcagaatatattttctttggcagagtttcctataggagaatgtctcctgagatggtgaatccgataattgaaaaagtggacagcggaacttccaaaatgggtaaaatagttcctatatatccggccacaggaggattgcagcagagaagtatcagggacgccgtgacccaggcggttttaaaactcggcgaaaagcttcctgaatcccttcctgaagagataagacaaaaatacgatttaatagatatagagagagctattcgttcggtacatatgccggaaacttttgatgatttttatactgccagaagaagactggtctttgaggagtttttaaaactgcagctaggtgtggcaaccgttaaagcgcataaacacaaacagtctgcggttgttatagaaaatgtgaaatgtattgcggattttgctgcttcgctgccttttgagcttactaacgcacaaaagagagtaataaatgaaatatctgcagacttaaaaaattcggttccgatgaacaggcttgttcagggcgatgttggttcaggtaaaacaatagttgcggcggcgtccatgtttgctgtggcaaaatcgggatatcagtctgtcatgatggcgcctactgaaattttggcggaacagcattttgccggtttaaagaaatattttgaaccgtggggaataaaggttgcttttttaagcggaggacagaaggttaaagaaaaaagagaaaatcttgagctgattgaaagcggtgaagcttcggtcatagttggaactcatgccgtaatcacggataaggtgaattttgctaatttggctttgagtataactgatgaacagcacaggttcggagtcagccaaagaacaaaattggcagggaaaggaataaacagtcatacgttggttatgacagctaccccaattcccagaacgttatctttggttatttacggggatttggatatttccattatagatcagcttccgccgggaagaaaagaaattaagaccatagctctgacagaagccagaagagcaaaaatgtatgagtttattctccaggaattaaacaaaggcagacaggcgtattttgtttgcgctcttgtggaggattctgacgcggttagtgcaaaagccgcaactgattatgtaaaaagattaagcaacggtgttctaagaggaaagagcgttggtcttttgcatggaagaatgaagtctttcgaaaaggaagatataatgaaacggtttgcggcaggagaaatagacgcacttgtggctacaacggtgattgaggttggcgttgacgtcccaaatgcaacaattatggttattgaaaatgctgagcgttttggactttctcagcttcaccagcttagaggacgagttgggcgcggcgctgaacagtcgtattgtatcatgtttggcgaccaaaaaagcggtgtggctaaagagcgtatggcggtaatgtgtgaaactaatgacgggtttaaaatagctgaaaaggatttggagattaggggaccgggagagttctttggaacccgccagcatggtttgcctgaaatgaaaatcgggaacttttttactgacatggatattctcaaagagacccaaggagctgcggcagaaattttgaaagaagacccaatgctggaaaataaaaagtatgatatattaaacagagaagttgttaagacatttaataaagtcggcgatgttttaaattaatatttttatatagataaatttgtttaggatttagaatatatataatatattttgtgcagttgcttgaatttagttaattgaataaattgccggaactctattaggcattataatttaaattttttgtgattattcttttgaattagttttattatttatattagaggttctgatatttttttcaaaattataaagtttagtctgatatataaaattgtcagactaaactatgtttggtaattaacttttatatttaaatgctgctgtcatatataaaatatattatgtgttttattaataaaaattgatggtgttagttaagataattttagttgaaaaaaatcgctgtctgtgtagggatggtcatattttattgataagtcttcctgactaaccttattaaacccggccttttcatagaacttgtgtgccctttcggtatttttgggagtgtctagaacaagctctttaaatttatgctcatatgcaaaatcaagtaattcagcaaatagttttctgcctaaattataaggttttccgcggtattgctcatttacaaagaatttttttaatattccaataccatttccatagttcataagtccaatagtaccgactagtttattgttctctgatgcaatccaaaaatagccgccgtttgtgaaatattcctgatttatatttagcagttcaggttggtctgcaatactgactattggtcttgtgccatcattttggcagctcagcacgaggcggataacctcatcttgatatttgtcttcgtatttttttatttcaatcatttttgtttctctccaatatcttaaaatatcaaatgattttgaaagtcctttatataaatataaaaacagttttgctaagtatatagattgttaacagtaaaattattaaataataattttaaatcatttgtagtacaaaatcggaattgctgtatttatatattagtttagcaaataaaaattaaagttttatgtaaaatgggtaatatatttgaaaacttagcatttttagattatattatttttatgtataaagattatactgtatattttattgttcacttttatatttcttctataaaatgcaccggatatttatcccagtattttttatatacataacctttggcattatttatgtctaattgatacattctaaaaataacttttatatttttaggctgccattgttcctcatatgaatacttatatttcataccgacttttttcataacctcgccgctgccgggattttttatatcatgtgttgccgtaatatacggcaaatctaaagtttttaaatatttaattaatgcggccgcggcttcggttgtaatcccttgattccaatattcttttcttacagcatatccgaggtcatgactttcatcatggctgagttttatgtatcctatagggatattattagatttcagacatattgcataggttaaatctttagagttaattatattgtttaaatattcttctgcctcatcaatactgttaagaggaaacataggcagaaatgtgtttacctcattatcacttaaaagagtgaagagcgcttttgtatcatccttattaaactttcttaaaataagccgttttgttttaattatattatatttctgcataatattttctacctttattttattagttaatttccgcgtttgtatatccctgttatatttccgtattgaattatatgtccgtttgccgccgttaaaaaatctttcttttttgaatcgggactcaaatttaaaaaacagtcaagcgcgtaaatatgaaatatatatctatgacagtttcttataaaaaattgctgtttaggtcctttgtattgattacgcccgtatcctatcccttgcattgcgtttcccaaagcagtaacaagttttccatgaggtatgttttcaggtatttcatttaccgccggtatattccaaataatccaatgattaaatgcttttataaaaggaatatcaaagtcgtccataacaattgcaatagagacagcttctttacttaaacctgatatcgtgaatggaggagatatatcttcaccaaatccggtatgccttttggggataaatgaattgttgtcaaatgatttgcttgtaatttctaaagtattttctttaatagtcatgataaatcctcttttattttttctttaaaattgtcacggcagcataatgaagaatttcgaatttttcaggagcaattgtttcgagcatttttatatgttccttctcaaatttttcaatttcagcatccgtcagtgaggcgccgataccgcggcaggctttcatacgtccgttccaggatttcctggtaaaaggcacatttatatcaaacacttcgcttttttctacttcgaaatactctgtataatcatcatcaatctgaatgttatggcgggtttcccttccgcctgtccaatctggattatattttaaaataagattttcactttttcctgctatggcgtcttcaaacggaagccacgccatatataaaattacaaacttacctgatgctttaagtattttgtgtattttaggagcaagcacagggtgattaaaataatcaaagcactggcatgctgtgactatatcaaatgattcaggggcaaactgaagttcttcggcaggagaagagaaaaattcaatattcattttatctttttcggcgagaagtttagcttgttttatctgattttcagatatatctataccggtaaattttgctccgtatttatataagttgcgaggtaaaacaccggtaccggtgccaatatccaaaacattctgaccttttgtgcagatgccgttttttattagatactgataaaattcatcggggtaaatatctctgaattttgcataatcatttgaggtccttccccaatcgaaaccttttccgccgtcaatatttttattaataatcatttttacctccggtataaatatggtattgttttgtatttattttagcttatttagtaaatgatggtatgtaaatgtctttttagaatttgattaatgttttgtgtattataggaaaaacaattattatttaaaacaaatcatttgaaattatgacgtataacagcctagtaagaatgtgagtcatattatgtgattttatatttaaaaaatataattatcttacgggtatgtagtcaatagctgattcctcatcagttgcttcaagtttgaaaataaccggccgtagaccgtcattacagctgcaaattgctactcccggcgtttttatccaatcgccgtaataaaatgtacccgctcccgcgccatgcgccagtgcaaaaacatactgatatatagctttccaggcctcgtcgcataatccatcgggttttgcataatccgcgtagaaaacctgttcttttttttacattggacaggcggttaagttatcggctccatattccattgccaattctttatctaaggtggtttttaacactgttatttttacctttttcatatttgtgtcctctttataaagataaattatatatcaaaccgacctcagcattactgtcgctgaggtcggtttaaagaagttttatttttcaagtaatgattctccggtcatttcgtcaggtttctccagccccatcatatctagcaaagttggggttaaatcagcaagacgtccttcttttaatttagcgtcttttctgccaatcagaatcagcggaaccacatttgttgtgtgggctgtaaacggctcgcctgtctcatagtctaccatttggtcagcattgccgtggtcggcagtaatcagagcttcgccgcccatttccaaaagagcgtcaactacttgacctacgcagttgtcaaccgtttcaacggctttaacagcagcttcaaaaactccggtgtgccctaccatgtcacagtttgcaaagtttaagattattgcgtcgtatttgccgctcttaatccgctttacaacttcctcggttacttcaggagcgctcatttcgggctgcatgtcataagtcgcaactttaggcgagtttatcaatgctctgtcctcgccctcataaggctgttcaacaccgccgttgaaaaagaaagtaacatgtgcatacttttcggtctcggcaatacggagctgtgttttacccagtttgctcatatattcgccaaatgtgtttgacagcgactcaggcttgaatgcaactttaacatttggcatagttgcgtcatactgtgtcatagtaacaaaataggtgttgaaaaagtctctttcaaatccttcaaagtttggatcaactattgttctggttatttctcttgctctgtcaggtctgaaattaaagaagatgacggagtcattctctttaatggtgccgagtggctcgccgtccttttcaataacgcatgggacaacaaattcgtcagtgactttatcattataactattctgaatagcctcaacagcgctttcagctgtgtttcctatacctcttacaagagcgtcataagttttttgaactctttcccatctgttatccctgtccatagcgtaatatcttccgcttattgtggcaatgtcgccaacgccgatttcacgttcctttgcgataagctccttaatatattcctcagcggaggaaggggggacgtcacgtccgtcaagaaatccgtgtacatgcacatctgtaagtccgttcttctttgccagctctagcaatccatacaggtggttttgatgactgtgtacgccgccgggtgaaagaagacctaaaatgtgaagcgaactattgttcttcttacagttttcgatagctccaataagtgcttcgttggtgaagaaatctccgtcagcaattgattttgtgattcgggtaagttcctgataaacgatacggcctgctccgatatttgtgtgtcccacttcggaattgcccatttgaccgtcaggaagaccaacgtccattcctgatgcgtgaacaatagaggtggggcattctttcatatacttatcaatattcggcgtgttggcagcatatattgcatttccgtcatgacggctgttttcgccgaatccgtccataatgattaacgcgtatggctttttgctcatattcaatgtctccttaaattcgttttgttagtcagcggctttaatgatagctgcaaaatcatcgggtttgaggctggcgcctcctatcaaacctccgtcaatgtttggcatagacaagagttcttccgcgttgcctgcattcatgcttccgccgtattgtattctgattttttccgctgtgtcctcgccataaagttccttaatagtatttcggattataccgcagacttcgtcagcttgctgggctgtggcggttttgcctgttccgattgcccaaattggttcataagctataattatattttcagcgtcgtctttctgaatattcaggaaagcaagttttgtctgccggcatacggtttccggcataattccgttttccctctcggaaagactttcgccgacgcagactattgggataagaccgccgtcaacagcggctttagttctaaggttgacggtttcatcagtctcgccgaagtattgacgcctttcactgtgtccgataatagtgtataaggctcctgcgtctttcagcattgcggatgaaagttcaccggtataagctccgctttctttaaagtgaacgttttgtgctccgacgcttatgctgcttccttccagagctgatacaacacccggtatacaaacagcggtggggcaaacgaccacatcgcattttgcatctgatattttattgcggatttctgaagctaaaactgctgcctctgaaggggttttattcattttccaattgccggcaatgattttttttctcattaaattccacagcctttcttttatatatctcaactcttattgtataaatatatatacaaataataattagaaatgttcatataattttaaaactatttatataggataataatttatttatcatcaagagcagcgcatcccggaagaatcttgccctccaagaattccattgaagctccgccgccggttgagatatggctcattttgtctccgaatccgagaatatttactgccgccgcactgtcgccgccgcctataattgttgtagcgtctgtatctgccagtgcttgcgcaaccgcaacagttcctttagctaaaatcggattctcaaatacgcccataggaccgttccatacaactgtttttgcagtctttacggtatctgcaaaaatttctcttgttttttcacctatatcaagacccattttgtttgcaggaattgcgtcagcactaacggtttcaaccggaatttcagcgtcaatagggttaggaaattcagctgcaacaactgtgtctacaggaagaagcagagtctttcctaaactttcagccttttccatcatttctttgcagtatgagattttctcttcatctaccaaagatgttcctacctcataacctttagcttttagaaaagtatatgccataccgccgccgatgatgagagtgtcgcatttttcaagcagagttgaaataacattcagcttatcagaaactttagcgccgccgagaatagcaaccaggggtcttaccggattatcaattgcgttgcctaggaaatctatctctttagccagcagatatcccgaaacacaaggactgaggtattcagtaactccaactgtagaacagtgagctctgtgagcgcttccaaatgcgtcgtttacaaaaacttctgcaagagaagccaattctttgctgaaattttcttcatttttggtttcttcaggtctgaatcttgtgttttgaagaagaacaacgtctccgtcgttcattgcagcaacagcagcctttgcattttcacctacaacattgtcgtcatcagcaaatacaacatctttgccgagtttttcagacaggcttttggcaacaggcgccagtgaaagactttcaactacctgaccttttggctttcccatgtgtgagcaaagtataacttttgcaccttcgtcaacgagtttctgaattgtcggcatagcgccgtttattctcgtttcgtcagtgatttttccgtcttttataggaacattaaaatcacagcgtaccaaaaccttttttcctttaacttgaatgtcatcaacagtttttttattcattaaaatacctccaaaaatatgttaagatttaattatttttaatttgttaaaataaagtattaatgtaattaatttatttatgcttatttactaaggataattttaccctaaccgcctaaatttatcaaccctttttttctaaaaaaacttctcaaatttgtaaaaacagcagtcaagagtttgtgaatgttttaacaaattaaattataaaaaatatattgacaaattctgtaaacggtgttatcctaaaataagtatatgtatttttagtatacattatatattttacatattagggaggatgttcttgtgagaacaaaactaaaaactaaagatttggttatttctgcactattaatagccatcggaattttaataccaatgatttttacgggtccgccgtttagaattgttgtaggaccgtacagcgcaacgcttatggctcatgttccggtgattattgctatgtttatctctccgtggactgctgtgttcactgctgttggaactactattggatttttctttacagctccgctggttgttgcggttagagcggcttcacatatcgtgtttgcaattatgggcgcatatatgttgaaaaagggtatgaatcttactgttacaggtttggctaccggggtagttcatgcagtgtttgaaggaatagttgttcttatattctttgctgtaggcgcgtctacaagcagcagttattcaaacctggcgatgatgtggataacaataggaggaacatttgctcatcatatagttgattatgttatagccgttattgttggctctgccctttcaagagctcatatgataccgtcgcttccgccgatttggggcaaaaagcagcttgcaaaataaagtgttgattatttataccgccgtgtattcggcggtatttttttctttgatgattattgttcttgaaaatacagagcaaatatgatatattaatatctgttaagaaatgaggtgaagcagtaaaatggaaaacgagtttttaatgggaaatgaggcaataggtcttggagctatgcacgccggggttaatcttgtatgcggatatcccggaaccccgtctactgaaatattggagagtgttgcaaaacgcaatattgataaatcagtttatgttgaatggtcaataaacgagaaggcggctatggaagttgccgccggagccgcatatgccggagcatatagtatggttactatgaaacaggtcgggcttaacgttgccagcgacccgcttatgagcttagcctatgtaggaataaaaggcgcaatggtggttgtagtggctgacgaccctgggccaatatcatcacagacagagcaggatacgagaacgtttgcgatgtattcaaagctgcctgtatttgacccgactactcctgaagaagcttatgagatgataggcgaagcgttcgaatattctcataagtatggaacgccggtaatattcagacctaccacaagaatatgtcatgcgtgtgcttccataaagcttaaatcaggagatgaaataaggaaaaatacacctgacggatttgttaaggacactatgagatgggtgatatttcccaaaacttcatatttgaatcatataaagattgagaacagaaataaggagctttcaaaagttttttctgaagaatatcaaagaaatgagtattctgacaatggcgatacagttttgggtattgcggcaggcggagtaagctacgcttatgttaaggaggctttgaagcttttgggcgatcctaatgtacgccttatgaaagttgcgacgccgtttccgttcccggaagaaaaagcgattgagtttatgacaggattaaaaaaagttattgctattgaggaactcgacccggtgattgaaagggctcttttacatatttgcggaaagtatcatttagatgttgatattgttgggaaagagagcagtcatgtccagtgtgccggagagaatactgttgagagtgtaaaaaaagttatagcggaatttttggatattaaacttgaagagacgaagaatgatgatacagatatgcctgaacttccggttcgtccgccggtgctttgtgccgggtgtcctcaccgcgcttctttctatgcagttaagaaggctgctgagggaaagaaagctgtgttcagcggtgacattggatgttatacgctgggaaatgccaaacctcttgatatgactgacacatgtttgtgtatgggcgcaggtattacagtggcgcaaggcctccatagaatagaagatgatgctttaaacttctcatttgtaggagacagcacgttttttgcgtcaggaataaccggagttataaacgcagtttataatgagactgatataatccttgttgttcttgataattccacaacagccatgacagggcaccagcctcatccgggaaccggaaaaactatgatgggcaatgttgttgataaagtagatataaaaaagatattggaagcagtcggtgtaaaacgcgttgagaccaccaatccattagaccttgaaaacgctgtaaaaaccgtgcagtcacttatggatggaagcggtgttagggcggttatatttaaggctccgtgtattgcggttgccaaaccggacccaagctatacaattactgatagctgtgtgtcatgcaaaagatgtatcacagaactgggatgtccggctattgtgcttaaagacggagcgccgtatatagagccgtcgctgtgttatggatgcggtctatgcgagaaagtatgtccggttggagccatcaaaggaggcggagaaaatgaaagataagataaattgtcttctttgcggcgtaggcggacagggaacggttttggcttcgaggatgattgccgcagccgctatgaagagaggtttgtttgctgaaaccgctgaaacaatcggtatggctcagagaggcggcagcgttgtcagtcatgtcagggtcggcgagaatcagtattctccgctgataccatatggaaaagcggatgttataattggatttgagccggcagaggctgtgagatgcctgccttatctaaagaatggcgggacggttgttgtaagcagcaaagcagtgctgccggtgaccgccagtcttggtatgggaagctattccggttcagaagatatgctcggctatctggataataaaacagaaaatttgatagtcgtggatacagatgagatttgcaaaagattaggtagtgcaaaagtgatgaatatggtgctgctgggagcggcagcgtcttcaggcgctttaggcattacattagacgagcttgagtcggctatggccgagagattggatgagagattccacgagcttaataaaaaagcgctccgtgccgctgtgcaggagtaaattattcggagagtgagagatttattatgaaaatgacgcaggaacaatttgatattataaaggctcagattaaaaaacttacatctatggattgtttttataaagagaaatttgatggaattgatgttgattcgatacagtcccaggaagattttgaaaaacttccgttcacctggaagggtgatttgagagaagcatatcctttgggattaatggcggtacctgaggaggagatagtaagaattcattcgtcttccggtacaacaggaacccccgttattattccttacactaaaaaggatgttgaggattgggcaaaaatgtttgcgcgctgttatgagctggccgggataaccaataaggacaggattcatattacgccgggatatggtctgtggacagccggaattgggttccagctgggagcggaacgtttaggcgctatggtaattcctatgggacccggaaacactgataaacagcttcgcatgatgcaggatatgaaatcaacagttctatgcgccacatcgtcttatgcgcttctgcttgcagaggaaatagagaaacgaggaataaaagataatatctgtcttaaaaaaggggttataggttcggagcgctggggagaaaaaatgcgcggccgcatagctgatgagcttggtgttgaattgtatgatatttatggtttgacagaagtttatggacccggtattggtatgagctgtgattctaaatgcggaatgcacatgtgggatgattatatatatttcgaaattgtggatccgaaaaccggtgaggttttgcctgacggtgaggttggggaattagttataacaactttgaaaaaggaaggcgctccgttaatcagataccgtactcatgaccttacaagaattatgaccggggattgtccatgcggttcaaaatatccgagaattgacgttatactgggcagaactgatgatatggtaaaggttaaaggcgtaaatatcttcccaagccagatagaggaatttttgagtacaatcgaagatgcttcaagcgagtatcaggttatgatagaccatcttaacggcaaagatatcttcactctgtttgttgaggttaaaaacggaactgatatgaaggtttttgaaagaaatgtagttaaagagtttaaagaccgtataggaataacgataaagtgtaaaccagtattggttggagatttgccgaggagcgagaaaaagactgctagaatatacgataacagatattaatgtgataagtcctgaacagatataattgttcgggacttattttttataattttgcttgtgcaatatgcacaaaaatatttttgaacattgtgcagttttcggttgaatgttttattaaaatgagttaaaattaaaaagacagtttggaacgtcattatgttcctaaaaagtaataaaattatagtaaatattaaaatacatattttggagggctgaattttgaaacaatacgagacatcaaaaattaaaaatttctgtttgctgggtcacggaaactcaggaaagaccagccttgctgaggcaatgctgtacactgccggaaacattgacagaatgggaaaaacgcaggaaggaacaacggtcatggattttgaccctgaggagataaagcgtaagttttctatttctgcatctctcgcttcgtgcgagtggaatggtactaagtttaatatcttggacacgccgggatattttgattttgtcggagaggttcagcaggctttgcgggtatctgatgccgctattatagttctttcaggaaaatcgggtttgacagtcggagctgaaaaagcctggaagtattgtgaagaatatggtattcctaaaatgttctttataaataaggttgatgacgaacgtgtggattatcaaaaagttttgcagcagcttaaagataagtatggtaagaagattgcccctttccagctgccgcttaaagagggagataaaataaccggatttataaatgttgtcgagcaggaggctagaatatttgacggcaaccgtactataaccggagaaatgccggcaggtattgaaggcgagctggagccgctccgtgaaatgattaaagaagcggtggcagaacagtccgaggagctgatggacaaatatttttcaggtgaagaatttactttgcctgagatgtattccgctcttcgcgagggcgttgctgaaggcgatatagttccggttctttgcggaagcgcttatcataatcttggtataccatctctgcttaatgcaataagcgcatacttcccgtctcctaatgcaaaagaagactttataatagccaagaaaaaagacggcagcgaatcccgtataaaggttgacagcaacgacccgctcagtgcgttagtgtttaagacggttgccgatccgtatgtcggcaaaatgtcatactttaaagtcttttccggagtgatgactcctgatactacggtttataatatgaaccgtgatgtaaacgagaagataggaaagatttttactatgcagggcaagaagcaaattgaggtagagtgccttaatgcaggtgatataggtatggtctcaaaattatccaaaacaaaaacctgcgacacactcagcggacttaatcacccatatcagcttgagggaataaaatttgcaaagccaaatatggagcttgctgttgttgccaaaaacaagggtgatgacgataagatagcccagggattgataaaactgatggacgaggataaaacatttgcttttgaaatcaacaaggagactagacagcagcttttaaaaggtcttggcgaccagcatattgatgttattgtttcaaagctaaagaataaattcggtgttgatatatcatttgagaaaccaaaggttccttaccgcgaaacaatcaggaaaaaagttaaggtagaaggaaagcataagaagcagtcgggcggtcatggtcagtacggtcatgtatggatagagtttgaacctacggattcagaaggcttggtgtttgaagaaaaaatattcggaggcagtgtgcctaagggatatttcccggctgttgaaaagggtttgcaggatgcaatggagcatggtgttttggctggttacccaatggttggtttaaaagcaacgttggttgatggctcttatcatgatgttgactcctctgaaatggcctttaagatggctgcaaacttggcgtataaggccggtatgcctcaggcatctccggtaatattagagcctatcggtcatttaaaagtttatgctcctgatagttataccggtgatatcataggcgatataaataagcgccgcggacaaatgcttggtatggagccggtcggcgatggtataactatgatagagggagaaatccctatggctgaaatgcactcatatgcttccgatttaaggtcaatgacgcaggctcgcggcgactttgagtttgagtttgacagatatcaggaagctccgcagaatgttatagataaaattgtggaggagagcaaataaataacataataaattcaaatgttactgaacggactcagaaaaaattaatattatcaaatggcaccttctatggactattttaccatagaaggtgttttatatgtcatgaataaatgaataaaaaatagataataagtaagatgataagctttctttaacatttttaaataataaattttatgttttaattagtgttttggaaaactaaaattttaaggtcagataattcgcatttcatgctcagatggtggctcacctaacgcgcgaacttcgttcgcaatacatcacaactaagttatttattgacattgtaggctagataaaacaaagcactttgtatcacacccaccattcaggtggggtcacgcctgccgatgttcaccattttacccacttttattatatgtaaattaattatatatgtatttgatttcgaaactaaaatttatattataaattagtttatgttgtcctattaggttggtttgagtgaattttaattagttagttttataattcgcatttcatgctcagatggtggctcacctaacgtgcgaacttcgttcgccttccgatgttcacattatacccacttttattatatataaattagttatatatgaaattatatataaaatgtcaaatttatttttattaaactattcttctagtttatgaattattaataaacacatttattaggtaaaatttaaatcttaatcttattaaatgacacttttataataaaaaatattactaataccaaaaaacaattttgtataaataaacttattaattgaataactcaacagaacacattaactcttcaaacataaaatataaaactatataaataaaattaaaataatcaaactaaacaaaataaactaaactcaatttataatataatttttgattttgaaagtaatttcatatataattaatttcatataataaaagtggttaaatggtgaacatcggtaggcgaacgaagttcgcgcgttaggtgagccaccatctgagcatgaaatgcgaattataaaactaactaatcaaaagctatcaacctgacataaaatcaagaatattaaaccaaaaaatatacataaatattaatttaaattcgaagaataaaaaaatttatttttaatacataatcaaattagccataatttaacttattcacataaaacaaaatatttaagttggatttttaacaactgctatacaactatgcaaagattatagtgcacgaagtgttggcttgacatttacctaattgaatattagaataaaaacactaggattaaatccgtttttataagaaaataacctgcactggataacataaaattcgctgaaaagatagttagtagaaaatttggaattggagatactatagtgaaaaagaaaatgctggcagtaacattaattttatttatagggctattattttcaggaacaatttattattttataaaaaatccagctttatactcactatcaataactttcggtactatcttttatcattttgctatgcgtctggcagtgggttttttaataaataataagtttcacaatcatattgattacacgctaaaatggtttaaggaaagagattttgaacaaaaattttacatatggattcaaataaagaaatggaaaaagtgggttcctgtttttaatccgaaagattacgatttaaaaaataattccatagcggaaattatacaggttacctgtcaggcggaagttgttcacgaaattatcatgatattgagttttgtgcctgttatattttcggtatggttcggagctaatgcagtatttttaattacatcgtgtgccgcatttcttatagacagcatttttgttgttctgcagaggtataaccggccaagattaatgagactgttaaaagataaacagttatcaaataatttataaaaatcattaaattttattttgaataatatcatcttaaatcaacaaaactataattgccgaactatcttttaaaatatgtgatggtaatcatttgaatatttgaaaaattttcgtttggaaaattgatgtttactattaagcaaggggatgatacaatgagcgaagaaagacaaatttataccgaatatcttataatcggcggcaatggatttgtggatggtatacgtgatgacgcacctgaggaagccaaacgtgagtttgaaaagtttctcagaaagcaaaaagaactgaaaaaggatgagcagtaataaaatggccggaaaataggttgataatgaaatgttttggtttgtacaaacggtgcaaatcggtttgattaataccaaattccggccttttacttaattatttttttaattgtgtcaccggctttgctgattgtaaactgcacggctaatccaataaatgctcctgttattattgctgcaattattagatacggcatataccagaaaattcccggggtttgtgtaattaaagcggcaacagcaacttgtgctgtattgtgaataattgctccgatgatacttgcagcccataagtttttaagaggaagatattttaaaagtatcatctctgttaaaaggcataagagaccgccggttaaactataggcaagcatcataatctgaccgctgaaaacacttcccatagtgactcttaaaatcagtataataaatgcgtctgttgggcttaaaaatacaagtgcaaagagtgtaacaatattggcaagaccaagttttatgccgggtatggcaaccaacggcggaatttgagattcaagcacaaatatcgtcagggctattgctgtgagaatgccgatagatgtaattctgcggattgttttatgtccgatttgtttttcaggagactttttcatatcgtcctccactagtatgttattttccggttacagcgtctattacggaatcatcgttttcagtctttattttaacaactaatttatgaggcaggcagataattggataaacgctgtttttaattttaccttgtttgacgcaaagcctgtccgggcagttagaatcggatatagaaatctcatctttttctatatgaacggtattaaaacctccggcgccgtcgtcaatgtttatatcatatggattatctacatcgtttaaatctattgtctcaataactttaccgttttgcacaatttcagctgtttttataggaacgttttgtttgcttgctataaagattataaaaactgatacaatcgctaaaacagcaaaaatgattatgaaaaatttgtttttcatttttatcacctaagattaaaattatttatatcatcttctatactatttctcggattaaaaaaactatttaatctctttcattattagcttaggttatattttttataagagaattttttctcatccctcagctgtttaattcacttgtaaaaatttgcagtttataaaatataaacttcggcagggcggtcttagaccgccgcgagaggtgcgcagccgcggagcggcaaaggaacggcatgtcatattatctatctcgtattgccgatctagtgatccgtataaaagcggacaaatattgctcgctgtaaaacgtttgtgtgctcgctgaaaatttttataaagttaatgatttatataacgcaagcttcggcagggcggtctaagaccgccgcgagaggtgcgcagtcacggatcatgaaaagaacaggatgtcatattatctatctcgtattgccgatcttgtgagccgcataaaagcggacagacattgcttgctgtaaaacgtttgtgtgctcgctgtaaaatgtttataaagttaatgatttatataacgcaaacttcggcagggcggtcttagaccgccgcgagaggtgcgcagtcacagatcatcaaaagaacagatttcatattatctcgtattgccgattttgtgagccgcataaaagcgaattgtcgttgttcactataaaatgtttatagtgttaattatttattatgtcttatgtattctatttgtttttggcgtatttgtcaagtttttgtctgtgctgtcgaaatcttttgttatatttctatttaaattgggtcttgtctaaaattgacgtaaatggtatactgttattcaattagaagtatgtaaagttttattgttgtcaaaaattaagacatacttttgtgtgcctgttattttggagtgaaatttttttatgaattatactatgcttactgatttttatgaaatcacaatggcaaacggatatttggaatgcggtatgggagacaggatcgcatattttgatatgtatttccgtcaggctcccgacggcgccggttttgctataatggccggcgttaagcagctgattgattatctcagcagtcttgaattttcgaaggaagatattgagtttctgcgttctaaaaatatgttttgtgaaaagttcttagactatctttcggattttaaatttgaatgcgatgtctgggccataccggagggaactcctattttcccaaatgaacctatagtgacggtaagggggcctattatacaggcgcagtttgttgagacgatggtattgcttactataaaccatcaaagtttaatagcgacaaagagtaatcgtatagttcgcgcagcgaatggcattcctgtaatggaatttggctcgagacgggcacagggttatgacggcgctatatatggcgctagagctgcgtatattggcggagttgcaggaacagcctgcacaatttcagaccaaatgtttggtgtgcctgctttgggaacaatggctcacagctgggtgcaaagttttgatactgaatacgacgcttttaaggcgtatgcaaaatgttatcctgataactgtactttgcttgtggatacatacaatgttttaaagagcggtattcccaatgcaattcgtgtttttgatgaagttttgaaaccgatggggattaaaaaatgcggtataagaatagacagcggcgatataacttatctttcaaaaaaagctaggaagatgctggacgacgccggctggacagaggcgtctgtatgcgcttcaaattctttggatgaatatattatccgtgatattttgctccagggggctaagattgattcatttggtgttggcgagcggttaattacttcaaagtcggaacctgtgttcggcggtgtttataaacttgtagctgttgaacaccagggcgaaataattccgagaattaagataagcgagaatgttcagaagattactaatccgtattttaagaaggttgtaagactttattccaatgaaaccggaatggctatagccgatgtcttaaccacatacgatgaagtgattgacgacgcgctgccgtatgagatatttgacccgcaaaacacgtggaaaagaaaggttataactgactttaaggctgttgaactgcaagttccgatttttaaaagcggaaagttggtttataagtctcccagtcttgaggaaataaaggcatatgcagaagaggagctttctttgatttgggatgaagttaagcgttttgagaatccgcatacttactatgttgatttgtctcagaagctttgggatatcaggtatgatttgctgaaagcttacaatgcgtaaattggcttaatttcaggaaagctaaaattaatttgagagttattaattattaaattttataaaggaaaggtactttatgatgcagcaaaatccggtagaattttataacttaggaaagcttggaataattggtatgaaagggtgcgaagatatcgctaagaaaatagatatgcaccttaaaaagtttaatgagaacagcatgcctaatattgaaagttttcttattcctacaaattgtcccagatttggaacgggcgaggcgaaagcagttatatcgcattcggttagaacctatgatatttatattatagttgacccgtttaattatggagtgacttacaacatgtatggcgccgagcatccaatgagccctgatgaccattatcaggatttaaagagagttatatctgctcttggcggcaagccgaaacgtatcacagtcattatgcctatgatgtatgagggcagacagcatagaagaattgccagagagtctcttgactgtgctatgatgcttcaggagctttcaaatatgggggttgataatttcctgacgtttgacgcacatgattcgagagtacagaacgctataccgctgaaaagttttgagaatgttcgtcctacttatcagatgataaaagcctgcctcaagtataattcagacataatcctggatgcggaggatactctcatagtatctcctgatgaaggagcaatgggcagatgtatgtattattcttccgtgcttggtatggatttgggtatgttctataagagaagagactattcaaaaattataaatggaaaaaatccaatagtcgcacatgagtttttgggcaaggatataaccgataagaatgttatagttgtagatgatatgattgcttcaggcgagtctatgatcgatgttgccagagaacttaaagccagaaatgccaagagagttatagtattttcatcttttggtctgtttaccgagggtgttgacaaatttaacaaggctcatgaaaatggtctgattgacgctgtgtttacaacaaatcttgtgtatagaagacccgagcttaaagactgtgattggtatcatgaggttgatatgtctaaattcattgctcttattatcaagcaaataaatgaggacaagtctataagtgagcttctgactcctatttgcagaataaataatattcttgagaaatataaaaatttaagaaatcaagattcacagaattaagtttatacttaaataagattatagaaagtgatataagatgactgataagactattaataaagcgggttctgtacgccgcgtcactgagacagagatggcggagcagagggattacatatccagaatacgcgcaatattagcacagagaaatgataaaccaaaagcttttgttgaaacttatggttgtcagcagaattcaagtgattctgagaaaatcaaaggtatgctctcggatatgggatatgaaatcactgatgaaattgacggagcggatttggttctttataacacctgcgccgttagggagaatgctgaacttagagttttcggaaatttgggagctttaaagcataaaaaacgcaggaatccggatatgataataggagtatgcggctgtatgatgcagcaggagcatattgcaaatactataaagacaaaatataaacatgtcgatatggtttttggaactcacgctttatatcgttttccgcagatattagatgaagcattaaaacatacccgggtttttgatattgagaatgaagacggagcaatttttgaagaaataagcgttaaacgtgacgctccgccgcttgctaaagttccgataatgtatggctgcaataatttttgcagttattgcgtggttccttatgtgcgcggccgggaacgcagcagaagcgcagaggatattctcgcggagtgcagaagagtggctgacgagggttataaagaaataatgctgcttggtcaaaacgtcaattcttatggtaacgatttgccgggcggaactagtttcagcgagctgttaaagctggtatgccggacggagggaattgaaagaatacgttttatgactagtcatcccaaagacctttcggatgatttgatagaggttatggcaagcgagccgaagatttgcaatcagctgcaccttccgattcagtcaggttcaaacaaggtgttaaaagaaatgaaccggggatatacgcgtgagcagtatatggaaagactaaaaaaagtttgcagagctattccggatatagttttaacgaccgatattattgttgggtttccaaccgagacaaatgaagattttaatgaaacgctgagcgtactcaaagaagttgaatatgatatgattttttcattcatatattcaaagcgcgtcggcactccggctgcaaaaatgccggatgttctgactgatgaggaaaagcatagaaattttgatgaaatgctgaaagtgcagaatgaaatctcaaaacggaaaaatgagacttatgcaggaaccgttcagaaagttttggttgagggattaagcaagacgaatgataaaactctaacaggcaggacagagggcggcaaggttgtgaatttcagctgttctgataataacgatttaagtttatccgactatgtggggaaaatagttgatgtaagaataacgtcagtgcagacgtggtctttattcggcgaaacagagaattagaaattatatggtaataccttaaaatcaaatgattttaggattatataaaaatcaaaggagaaaaacatgaacaataatgatgcgatatttgaaaaggcaagagagttaggcgagcttataaaggcaagcgacgttagacaaaggtcagaggaagccagcaaggctttgctttctgatgaaactgcaaaagggcttatagattcatataataagctgagagaagataaaatggcggagtttactgaaaagcagcctacacaggaagaagctcaggaagtaaataacgtacttcaagcagagtttgagaaaatggctgaaaatgatataataaaagaatatcttgaagcggcaagaagttacgaaatggttttgggacaaatggacagcattttgaaacactttatagttggcgagcaagaaaaccaatgcggcgagggcggatgtgctacatgcggaggctgccactaaaatatggcttatccggttggtcggccggctggcggcgtgttttgcgtttgtcagccggtattattatttatgactaaacttagagttttatttccaggctgtgacataatttaattagataatatatttgccttttaaatagtgaaagacgatattgacactttttataagtttatattatacattttgattcagtaatatttcggaagggagcggtatttttatatgataattgacagaaataatctgacgccgatgatgcagcagtattttgaggtaaaagaccaatataatgactgtatattgctttataggcttggtgatttttatgagatgttttttgacgacgctgtaattgcgtctaaagtattggaaatcgctctcacaggaagggcgtgcggtcttgaagaacgcgctccgatgtgcggagttccgtttcattctgttgacagctatattgttaagctggtaaatgccggtcacaatgtggcggtatgtgaacaggctgaagacccggccgaagcaaagggattggttaagcgtgaggttgttagagttatcaccccgggaactataatggatacctcggcacttgacgaccaaaagaataattatctgtgttcattttttagaagcgatgatggtataggtctggcttttgtggatattacaacgggtgatgtttatgtcggtgaatattccggcaaaaacatgatgaaccttgtaatgaatgttataacaagatttgttccaacggaattcattatgaatatgcgcgcgtatgaaaatacggatttagtgaaaacattaactgacaagttcagctgttttgtgagaaattattatgactggtctttttctgaggaagagtctaaaaaggctgtcagcgaccagtttaatgccgtgcgcgaaggtgacggcgatatacttgaagagcttggaattaacgagatgagtatggctgtttcagcattgggcggaattttggcgtttctgaaagaaactcagaaggctgaacttaccaatattaaatctgttgaggttctcaacgacgacggcgagatgcagattgatatgtacagtatgagaaatcttgaaataaccgaaactatcagagaacgttctcagagaggcagtctgcttaacgttctcaataagacaaagacgtcaatgggcggaagaatgttcagaaagatgataaccgctcctttgacaaatagaatagcaatacaaaacaggctgatagctgtggacgagttttataaaaatcaattgtttagagaagagattatagatattctgaaaaatatttcggatatagagagaataatcacaaaattggcatataaaactgcgaattgtcaggatttaatttgtttaagaaattcttttaaaaggcttcctgaacttaaaaaatatcttgagcagagttcgagcaaattggtgagggaacagctgaagagatttgatgatttgagcgatttatatgagctgatttataaaacgatagatgatgaagctccggcagttctgaggaatggaaaactcataaaaaaaggagctgaccctgaactggacaaaattagggaaataaagcaaaacggtcaggattggcttacaggtattgttgaagaggagaaaagaaaaagcggaataaaaaatatgaagcttggttttaataaagtttttggttattatattgaagtcagcaagcagagcaacgaaaatattcccgattactttatcagaaagcagactctggttaatgctgagagatacataactcctcaaattaaagagcttgaggaagaaattcttgaagccggtgagaaggtcaatgatttggagtataatattttttgcagaatacgcgaccatgttgctgcgagttacggcaggatacgcgagacttcagacgttatagctctgatagatgttttgtgttctttggctgttgttgcggaatcaaacggttatgttatgccgactgtaaataattccgataaaataattataaaagacggacgtcatccggttgtggaatcaataagcaaggcgaacgtgtttattccaaacgacacaagtatggataatgagagcaatcagatatctataattacaggcccgaatatggctggtaagtctacatatatgcgccaggtggcagttatagttttaatggcgcaaatgggaagttttgttccggcttcatcagcagaaataggtattgtggatagaatatttacgagggtaggagcgagcgatgacctgagttcgggagaaagcacgtttatggttgaaatgaaagaggttgcttatatactcaataacgccacaaaaagaagtcttataatccttgatgaaataggccgcggaacaagcacatatgatggtctgagcattgcctgggctgttgttgaacatatagccgacgcgaaaaagtgcggggctaaaacattgtttgccactcattatcatgaactgaccgagcttgaagacaaaataaacaatgttaaaaattattgtatagctgttaagaaaaagggagacgacataacgtttctcagaaaaatcatccgcggcggagcggatgagagctacggcgttgaagtagcggctcttgccggggtaaagaaatcggtaatcatccgcgcaaaagaaattgccggtatattagagagcagggaacagaaaactgtcaatacggccgatattaaaaccggaaccaagaaagaaaagaaaactccgtttaaggatgaacagatagacttttttgcccaggctgataatcctgtaataactcagcttaaagagttggatcttaatacaataacgcctgtagaggctttgactaaactttttgacctccaggcaaaagctaaaaatatgtgatttaaagccgctgtgcgctgtgtgcggcggcttttggtatacgctgtaaaaagttgacatcattaaattttgatgatatacttcaaaataattagagttttgggaagtgtttatatggaagaaaaaatacatgttttatctcctgatgtggcggataagattgcggcaggagaggtggcggagagacccagctcggttgttaaagagctggttgaaaatgctgttgacgcaggagcggataaaataacagttgaaataaaaaacggcggtataaaattaataagggttgcagataacggtaagggaattccgtcagaacaggttcctacagccttcctgcgccatgctacaagcaaattaaacactgccgatgacttatataatatctctacaatgggatttaggggcgaagcgctttcgagtatctgcgctgttgccaaagttgagattatcactaaaactgccgaagccgaaacaggggttcattatattgttgaccacggtatttgcggagaagctgatgaaatcgcttgtgcggacggaactattatgatagtcgaagatttgtttgctaatgttcctgccagaatgaagtttttgaaaaaagacagtacagaggcaggatatatatctgaccttatgacgcggctggctttgtcaaaaccgaatatttcatttgattatatatgtgacgggaagcctgtgtttaagacgtcgggagacggggatttgactaatgttattttaaaggtatacgggcttaagtttgcaaaggctgttatgccggttgattattttgaagacggagttaaaatatcaggggttatcggtaaaccggaactgtcctttggtaatcgtaccaaacagacgatttttgttaatggcagatatataaaaaatcatgtgatagccaaagttgcggaagaagcgttcagaaacgctgtaatgataggaaagtttccgttttttgtattaaatatagaggttccgccggaaatggtagatgtcaatgtgcacccggctaaaactgaggtcaagtttgcaaatgaaaaacagctttacgatatagtgtatcatgcggttaaaaactcaatgtatggtattaaggttagtgaagtaaaggctgaccagagcgctaaaactatacaaacaaataaaactttttcaaaaagcaaagaagcgcctaagctgaaagattcagcggtcttaaatgaaaaggtaatacatgattatcttgagtataccaaacctgttataaataaatctgaaattttagataatactcctttagaaaaaacgcctgatgaaaatatggatgaaaatgctgctgaaagttccgataatggcggagttttagacaaagttgtggatataatagataattttttggaacctgacaaagaagaagtatctgataatatctcaaatgatgtaaatgaagcaactccacaaactaaaaaagagtttaagcaaaccgagttcggagatgttgataagatatttgataattcagacagtatttttaaagattataaaataataggacaagtttttgacacttatgttttgctgtcagcgccggacaggttttatatgatagaccagcatgccgctcatgagagagatggttttgaaaagctgaaaaaagcgtattttaataatgaacgattatctcaggttttaatgtcgcctattgttataaatttaagccatgttgagtatgacgcggttatgtccaatcttgatgagtttgaacggtttggttttgatgtcggcgagtttggctttaatacggttgtagtaaatgagacgcctataatagccggcgacgagcagataaaggatttgtttttggaaataacagacgcgcttgtggataatattaaacatccgatagcggattttgaagaaaaagcgcttgatatgatttcatgcaaaaaagctattaagggaaatgataagctgtcgctgccggaaatgactgaagtcattaaaatagttgaaaatttgtattctaaaggtataaaaacctgtcctcacggaagaccaatcatggttgagtttacaaaaaaagagatagagaagatgtttaagcgtatcgtataaaatgatacaaggattatatgaggtggcgtagatgaataaacctaaaatattgtgcgttgtaggccctaccgcttcaggaaagacagactatgctgttgagcttgctttaaaatgtggtggagaagtggtttcgtgtgattctatgcagatatataagcacatggatattggaaccgcaaagccgactgctgatgagatgaaaggcgtcaagcatcacatgatagatataatcgagccaaacgagagttttagtgtagcgcgtttttctgagatggcaagggaatgtatagacgatatacttttaagaggaaagatgcctgttttatgcggcggcacaggactatattttgacagcacaataaataatataaattttatacaaatggacacggatgaagagtatagaaaagatttggaatcggctgcaaaggaatttggaaatgaatacgtatataaaattttaaaaagggttgacgaagaatctgccgaatccattcatcctaataatttaaaacgtgtgattagagcgttggagatatataagactaccgggaagaaaaaatcggaactggataaggaacagctgtcagaaccattgtatgagcctgaaatcacagggcttatgcgtgacagggaagtcctctatgacagaataaataaacgcgttgatataatgatggaaaagggacttgtagatgaggtttcagaccttattaaaattggtatagatacagaagctacatctatgcaggctattggatataaggagataatagaatatttggacggaaagacaagtctcagcgacgctgttgataaaataaaaagagaaagccgaagatatgccaaacgtcagctgacatggtttaaacggaatgaaaaaattcattggataaatatttaaatataaaattaatgcggtgtatgaactctaagtttgtatgccgcattttattttttggaataattttacaggcagcgacatttttctgttacaattaagttacatttgttctacaactcgtggattgcggtttacatactttttgacagagattataatagttattatgtagaatggatgtgtatgtttagcgctataagagatggactgttgattggaggtagtcttgtggcaaacactactgacaattcaaatataagattacagaaaagacgcaaaagagatataaaaaagaggctttttttaattcccaaattgatttttgtgtttttggtggtctttttgcttatcagtatatttttcagatcaggtaatagtgtaagcacttatactgctctgaatggtaaaattgaagaatatgtcctggctgacggttacattttccgtgaccaggagctcatatcatcaccgtcagacggttattttgagtgcctggcagatgagggagaaagggttaatgatggaagcacaattgccgccgtgtataaaagtgctgtagaccctgctgttactgaagaaatatcacagcttaaaacgaaaattgccgatttggaaaaggacgaggccgctgcggatatctattctgcgaacgctgtgaaaatagagcttaatatttctgaggaagctcagaaacttacgcaggttagggataataataatttctctgatattgtgagtataaaacacagcgttgatgattatattgcaaacaaacaatatgcggttgaaggcggcaaaacaaaagaggacaggctttcggaaatgaaagcaagacttgatgaattggaatcaagcatagacggggaacgcgagtatatatatgctccgagagccggaatattttcgtcaaagattgacggatatgaagacgttttaggcattgagatgatgggagacgccacgccgagatatataaacggcatttctaaaaataatgtgacggttggaaccacagtcacaaacggcgaaaacgtctgtaagataattgataattacgagtggtattttgtcggtttaatttccgaaaaggaagctgaaaattttaaggttgatcaatctatcagcataaaattctatgatttatccgatagtatggtatccggaaccgttaaggctatctctaagcctgaggacggcaaggtcgctataaccgtctattccacaagatatattgattcaatttatacgaccagcaaagtgtccgcagagctgctcactgagagttcggaagggataaaagttccgtcgtcttctttgagagttatagacggacagcagggagtttatgtcgttcgtttgggagtggccagatttgttccggtcgaacttctttacaataataaagaatgggctataataaaacctgttattagcacaagttatgaggaacatcttgaagtttatgatgagataatcattaatactaaaggtattgaggatggtaaggttgtgagacaatgagtgaagttcctgatatcagaaaaaattatatagacgttttgaactcggttaataaaattactgaggaatgcggcagaaagcagggcagcgttcgtctgattgctgtctctaagacaaagccggcggaatatataaaagaggctgtggaagccggagccgcagattttggtgagaacaagccccaggagcttgccgctaaatatgagcaggtgagcggagtgagatggcaccaaatagggcatcttcagaagaacaaggttcgccatataataggcaagaccgctttgatacattctttagacagtattgagcttgcaaaagaaattgataagcgcgctaaggctgttggaatagttcaggacgttttgattcaagtaaatatttcaggcgaggaaagcaaattcgggataaaacccgagaatttgccggagatgctggaaagtttaaaagagttcagcaatgtgaatacgacagggcttatgacaatatccgttaaaggctattctcaggatgaaaacagaaagttgttctcaaaactcaaagagttgggcagcaaatatggtcttagagagttttcaatgggtatgagccatgattataaagaagccatagagagcggggcaacaatggtaagagttggaacctcaatttttggcgaacgggattattccctaaaataatatgtgaaatatgaaatctattatatacaaaatactgataaacttaggaggaagaaaaagatgggaagctttatggataaagtgtacagcatgatgggtgttgacgttggagatacatatgaagaggaatactatgacgattatgcacagggcggatacgatgaaccggatccaaacgagagttatatgcccagcagaagaaattcaggaagaaacgcaggcagagtaaatagatacgaggacaaccctcagatgaaacttgttatcatgcagcctgtaagctttgaagaggcaagggatatagcaaaccatttaaaagagagaaagccgatagtaataaatcttgaagctgtagataatcctacatccagaagaatagttgactttttgagcggttctgtttatgctttggacggaagtattaaaaaagtatcaaacggtatttttctgattgctccatgcaacgtcggcgttatggatgaggaagaagcatacgaagaacgctggagctaaaagtggatacagatgataaactgatagtctctaaggcttttgataccgttagtatcgctgagagacagtatatttgcaaaactatggggtttttaaatccccatcaagcggctgtagtccgcagggaaatttcgagaaaaataccgtcggatattggcgttgaattttatggcggatataaagacgcggagagatgtttgtttatatgctttccggaatatttggaaccggactatgacagtattatctcagtgctggagataacagcccgtgacattgataaaatgtctcatcgtgactatcttggcagtcttatgggtcttggaattaagcgtgagaatattggtgatattcttcctcttgaagacaggtgttatatttttaccaagtctgatatatcaggatatataattgacaaccttttaaagataggccgccatggagtgaaaatttgcaaaagaagtctttctgagataacggtgcctgagaaaaagaccgagcaggtcagaaccactgtttccagtctaaggctggattgtatattatcaggagcgcttaatatgtcgagaggcagagctgcggaactaataagagcggagaaggttcaggtcaattttgaaactgcggacagtatatcaaaaatattaagtcctgacgacttagtttcggtcagaaattttggcaggtttaaagtggccgaaatagggggtctcacaagaaaagggagatatggtatcataattgagaagtttatttagtatatatagtagagtatagatttcgtgagaattgttaaacggtcaattgattaaagttagaagattgggaggatggaatatgcttacacctgctgatatcgaaaataaagagtttaaaaaagagatgcgcggttataacataaccgaggtaaatattttcctgaaagaagttgcaatgagctatgaaaagatatatcaggaaaatctttcggctatggataggataggtatgctgtcagacgctgtaaaacaatacaagtcgatggaggataccctcaaaaacgcattgtctgttgctaagggcgcaggggacgagataaagaacagcgctcatgggcaggcgcaaatgattattaaggacgcggaaaacaaagcggttaaaataatcaatgaggctgcaaaggaagtcgctgatataaattataagtatgaggaaatgaagagaagcgttgaggtgtttaaagcaaaagtagtgtctcttttaaattctcagcttgagattattaaggaatattcaaatataaatgccgacactgacagagaaataaggtcaagcgccgaagcggttgaagtgattaaaagcgaaataaacgatatccctgatttgccgggggatttaagtagagacgctgaatcaaatctgatgtctcagctcgaaaaagttactcaggaactccctaggataaaactgaatgaagacggcgaatatgttcctgcagatgagaattaataaataaaattttaatatttaaggttagggctgttctgcgtaatgcgggacagtccttgacatagaatgctgaaatttggtttgaaaggctgatgttatgataatatattttataataggtatactggttttaattcttgacatagttactaaacactgggcttcagcggttctgatgggaacatcggggataccggttatagacggattttttcatttgacttatgttgaaaattccggagtggcttttggaatgctccaggataaaagaataatttttgtcacaatgtcgctgttgatactttttgtattggctatgtatttttataaggcaaagaagagggatgtttggcttaaactgggaacggcgcttatctttgccggttctatcggcaatttgattgagcgtgtgacaaatgggttcgtagttgattttttggacttcagagtaataaattttccggtgtttaacattgctgatatggcggtgtgtatcggcgcggcggctttggtgatacactttttgacttctgatacagagagtaaagataaactaaatgagaagaaagaataaaatacggtgagaatatggagaacgatgagataaagttgttgaaggtatccgagggagaggagggaaggctcgataaatatctttccgataagcttgaggatatgactcgctcatatttgaaaaagcttatttctgatgataaagcggtattggtaaacggcaatccggcaaaaccgaactataagcttaaacccggggatataatagaactggcagtgccggaacctatagagttggaaattaaggctgaaaatattcctcttgatatagtatacgaagataatgatatgctggtagttaataagccgcagggtatggtagttcatccggcggccggaaactataccggaactcttgttaatgcgcttctttatcactgcggagattcactttcgggaataaatggtgaaaaacgtcctggaatagtgcataggattgataaagatacaagcggactgctgcttgttgccaaaaatgataacgcgcatcaaaaactgtcgtcacagataaaagagcacagtcttacaagagcgtataaagcgctggtgcatggaaatataaaacaggattccggtcgcatagacgcgcctatcggccggcatcccagcgatagaaaaaagatgactataacggacaaaaattcaagggaagcagtaactaatttcagggtgcttgaacgttacggccgctatacttttgtcgagtgtattttggaaactggcaggacgcatcagataagggttcatatgtctaagaacgggcatcctattgttggagataagacttatggggtaaaaaaggaagaatttaatttggcgggacagttgctccatgcgtataaggttgggtttatacacccggtatcaggagaatatatggagtttgtgtcagaattgccggattactatatgaacgtgcttgatagattgagaaattttatttaaaagctgtaaaaatttgtagacaaagtgagtttgttaggatataatagtagcaagggtgtctgggctcagagcgtagatggtcttgctattttgtctgtaaggtgggattaatatgagaacagtaattcttgaaaaagaagagattgacaaaaaacttaaaagaatggccagccaaattgttgaacgaaacgtaggtgaaaaaagcatctgtctgattggtatagtcaggcgaggtgttaacgttgccgaaagtttggcagaacacatcatagcaagcggtgaaatgaacgttgaagttggaagccttgatataactctatatggggcggaccataatcttatagccaaataccctgtattaaacgatacggatatacggttttctatagataataaaattgtagttttggtagatgatattttatataccggaaagacaattcatacggctattgacgctcttttggatattggctctccatcagaagttcagctagcctgctttgtggataggggaagaagaactttccctataagcgcggattatgttggagtgagagttccgagttcaggtcttgagcgtgtggttctgcatgttgaggaagtagacggcgaaagctgcgtaatgatagagaagcgtgatagttcagcagcgtttaaaatataaaagaataggcaaagatgaaatagagggttagtccctttatgtaatatacagcggaccaaaattccgcgtaaatctaatattataaatagaggaattacgatgattgataacttattaggtttaaaagaaacatcaagagatgatattacagcaatattggatgatgctgtgaaattaaaaaacgacgttttggagcaggacattaaaaagtcaaatatcctttctggaaagagtataataactctgttttttgaaaacagcaccagaacaagggtctcttttgagttagcttctaaatatcttggagctactgccgcaaatatttcagcgggaggaagcagtattgccaagggcgaaactttgatagatactgcaaaaactttggaggccatgggtactgatgtcataattataagacacagcatgtcaggttcacctcatcttatttccaagtacataggctctaaggttattaatgctggtgacggaatgaatgagcacccaacgcaggcactgcttgatattatgactatcagagagaagaagggaaaagttaaagggctcaaggttgctatagtcggagacgttaaacacagccgcgttgccaggagtaatatttacggtttgaataagctgggagccgaagttgttttagccggaccgtctactttgcttccttccaatttggaagatatgggcgttaaggtatacaccgatgttgaaaaagccgttgagggcgctgatgttgtaatgggtctgcgtatccagcttgaaaggcagaagaagggactgtttccatcaatcagagaatacaataagtattttggaatagatgagaggcggctctcattggcaaaacctgacgctatattgatgcatccgggccctgtgaaccgtggcgttgaactgaacccgcaggttgctgacggaagtcagagcgttattaatcagcaggtcaccaatggtgtttgtgttcgtatggctgttttaaatatgctggcaaacggtaaaagatatgataatttagtataaataatcttatattaggttgataaggcaaagtgttataattgtacaagtaaggggaaatgcagattgaaatcaaattggattttaataaaaaacggtcatgttgttgacccggcaaataatatagatgaaaagcttgatattttaatcaaggacggaataatttcggaagtaggcaaggatatacaaacaaatccttttgtgacagtgattgacgcagaaggtaagattgttgctccggggcttatagaccttcatgttcatttcagagaaccgggatatgagtataaagaggatattgaaagcggaagcgccgctgccgcaagaggcggagttacgactgttgtgtgtatgccgaatacgaacccaactattgataatccggctcttgttaaatatgtgaccgataggggaaaagaggtcggactgacgcatgttctgactaccggatgtataaccaaaggacagaaaagcgaagagcttgcggaaattggagagcttaaaaacgccggagctgttgctgtttcggatgacggcagacctgtgctttctccatcgcttatgagaaaagcgctggagtataccaaaatgtttgatattcctataatgtctcacagtgaagatttggatttggttgacggcggaagtatgaatgaaggatacatgtcaacttatttagggcttagaggaataccgaaatgcgctgaaagcgttgctatttccagagatgtgctgatagcggaggacgtgggaggaagactgcatgtctgccatgtgagcacccgcaattctatagacgctatacgccaggctaaaaaacgcggtgcaaatataacttgtgaaactgctccgcactatttttctttgactgataaagcggttgacggttttaatacaaatgctaagatgaatcctccgctgagagaacaggacgatgtcgacgcggtaatcgagggcttgattgacggcacaatagacgcgatcgcgactgaccatgcgccgcatgataaggatgaaaaggaaatagaattcgcattggcaatgaacggcattgtcggtcttgaaacttctttggggctgggtgttacaaaccttgtcaggactggaaaattgactatggctcagctgattgaaaagatgtcggtcaacccggcaaaaattataaatatcgacaagggctctttatctgttggaaaagcggctgatattgtggtttttgacgctgataatgaatatactgttgatataaatgaatttgcttcaaaaaataataattgtccttatgatggaatgaaactgtatggacgggttgattttaccatattggatggaaatgttgtgtttgaaagatagagaggagtttttaatatgatagactcattaatcgaaaagatacaggagaagaaaaatccgactgttgccggccttgacccaaaactggattatcttcctgaagaaatggtaaagaaagcgtttgatgaatatggagaaacttttaaaggagccgctgaggcaatttttgagtttaacaagacgctgattgacgctttatatgatatagttccggcagtgaaacctcaatcggcttattatgaaatgtatggtatagacggtattgagtgcttgaaaaaaactattaattacgctaaagaaaagggcttgtatgttatcttggacgcaaagcgcggagatattggcgcaaccagtgaagcatacgcaaaagcttatttgggaaaaaccgatataggcgaaaaacaggagcctgcttttgatgctgacagtttaacagttaacccatatttaggaacagacggcgttcagccgtttgtggaacagtgtttgaaatttggaaagagtatttttgcacttgtaaaaacgtccaataagtcttccggtgagattcaggacttaatcagcggcggcaagccgatatatgaacatatggctgagctcgttaaaggctggggtatggataatttcggaaagtatggttatacgcaggttggagctgttgttggagctacttatcctgaacaggcagaagttttgagaagggttatgcctcatacttatttcttggttccgggatacggagctcagggcggtaaggcggaagatgttgcaaagagctttaacggagacggacttggggcaatagtaaacgcttcacgttctataatgtgcgcatataagaaaaacggcggcgaggtcggtcaggcggcgagagatgaagctataagaatgcgtgatgatataatgtcagccgttggcgctgtttgattaactatagaggattggagaggttaagatgctgtgtgaacttgtagcaaaaggtcagataaggcgcggcctttttgactatattgtagactgtccggatatggcgatgaaggcaaagcccgggcagtttctccatgttttatgcggtggggatacatatttaagacgtcctataagtatctgtgatgtgattgaaaacagacttgtaagatttatatttgaagttcgtggaaagggcacaaaagaactggcaagagctaaagaaggagacagactggatattttaggtcctttgggaaatagttttgatatatctttttcagatgaaactgttgaaagcagttcgtctgttcccgagggagatatagttttaatcggaggaggaattggtatatttcctcttttatatctttcaaaaagtcttcccaaaaaacctaaaatattattgggattcagagatgcagaaagtatggcgctagtcagagagttttctaaaagctgtgaggatgtttttatagcaagcgacgatggcagcgtggggcataagggctttgtaactgacttgcttaaaaactctatagaatcgggaaataaaatagaaagaatatatacttgcggcccaaaacctatgatgaagattgtggcggaaaccgcagtcagcaatggaataaactgtcaggtatctatggaagagagaatgggctgcggagttggggcctgtgttacttgcacatgtactttaaaagatggttcgagaaaaagagtttgcaaagacggacctatatttaacgcatcggaggtggatttcgatggctgatttgagtgttaatatagcaggagtagagtggaaaaacccggttacaacagggtcgggcacttttggattcggaagagaatatgctgaatattttgacctttcgaatattggcgcgatttgtcttaaagctatatccaccaaaccccggctcggcaataagtcgccgagaatcgccgaagtaaccaaaggtatgctgaacagtgtggggcttcaaaatccaggagctgaatattttcttgaaaatgaactgccttggctaagacaatttgatacaaaactaatagctaatctgtgcggttcaactattgaagattatgtagaagtcgcagaaattttaggtaataagcttgatatgtttgaacttaatatttcatgtccgaacgttaaagagggcggaatggcctttggaactgacgcgaagatgatagaagaaattacatcaaaagttaaagctgtatcgaaagtgccgcttatagtaaaattgtcacctaatgttactgatattgccgagatggcaaaagctgccgaagcaggcggcgctgacgcaatttcattgattaatacattgctgggtatgaaaattgatataaataccaggagacctgtcctgaataataatatgggcggaatgtccggacctgcggttatgcctgttgcggtcagaatggtgtatcaggtgcgccgggctgtaaagcttccaataatcggtatgggcggaatcactacaggagaggacgctgtggaatttttgcttgcaggggctgacgcggtttcagtaggaacagccggtattgttgacccatatgcctggataaaagtgagaaatggaataaatgactatcttgataaaaacggatatgaatctgtaaatgatatagtaggaaagcttgaaatgaataattaataattggaggtttgacaaatgacaaatgaacaaataattgatatgcttaaagaggcggaagttttgctggaaggacattttcttttaacatcgggaaggcacagcgataaatatatgcagtgcgctaagattttccaatatgcaaagtatagcgaacctctctgtgccgagcttgcaaaacaatataaagaagataatgttgaattggttatagggccggcaataggcgcaattcaaatggcgtatgaagttggaaaacagcttggtgttaaaaacatatttgctgaacgtgaggatggaaaaatgacgctgagacgcggatttacaatcgaaaaaggtcagcgtgttctaatcgtagaggatgttgttacaaccggaggaagtgttcgagaggttatggagcttgtcaatgaagccggaggaaagatagtgggaataggttcaattgttgacagaaccggcggtaaaattgattttggagttccttataagagtgcattttctatggatataacatcttatgagcctgatgactgtccgatttgtaagtctggaacaccattggttaaaccgggcagcagaaagataaaataatgaaatcgaataatacacatgacggtcacagaatcagaatgcgtgaaaagcttgagagtggaaatttagctgatttacctgaacatgagcagcttgaaattcttttattttcagtgataccgagaggaaatacaaatgaaatagctcatgagcttctgaaaaaattcggttcaatttatggtgtattgtcagcagatatcagcagtttgctggaggttgacggcataggagcgcgcgttgcggattttctgcataatcttccggctgttttaggagttgttatgcgttctaaaatctcgtatgaaacagataataaatttttactgaatgatattaacactttaaaagattatttgttttctctattttcggatactgtttcagagcgggcgtatatattatttttaaataagggttttcggcttatcaagtttgagaagataagcgacggctctttagagcaggtatacatagatatatcaaaggctgtacggcgcgccatattaaacaatgccgcatatgtggtgctgacgcataatcatcccagcggctcggttatgccaagcgacgctgatatttcatcaacccgagagcttgacgaggccttgaacactgtaggaataggtcttttagaccatataataatcggcggtgacagctattatagtttccgtgaaagcagacattattaataaaagaatcctttaacccgatgaatttgtcgggttagaggattctttattttaaaatataaaaccaaatttcttataaaaaacggtgaaagtgcttgtataatatcatataatgtcgtataattactataaagatatgtgaatttaaagaacatattaaaaagaacatatttgttgggaggaattatagtatgcaagatatgcagaaaatatataaactaaaaatagataatatattttcaaatagtaatgatattatacatgaaatggattgccgatttataaaacagttggcatatggtaaaaaaatatgaattcaaaaagttcacatcatggtcatagagatagaatgcgggagaaattggagcatggaagtttggcagattttcctgaacatgagcagctggaagttctattattctctgtgataccaagaggaaatacaaatgaaatagctcatgaacttttaagaagatttggttctatatatggagttttatccgccaacaccaatagccttatccaggtggaaggggtaggtgaacgagttgcagactttttacataatttacctgctgttttgggtgtggtaatgcgttctaaggttctctatgaaacggataacaggtttgtgcttaaagatacggacagattaaaggaatatttgttttcattatatgcggacactatagctgaacgcgcttatatcttatttttgaataaaggatttcgattaataaaatatgaattgatatgtgagggttcaatagatgaggtttatttagatattaaaaaggcggttcgcagagctttaatgaaccatgcggcatatgtagtgcttacacataatcatccaagcggtcttgtttttccaagcgattcagatattatatctaccagagaactgagcgaagctttaaatacagttaaaattgggttttgggatcatgtaatagttggaggtaatcaatactacagttttagggagagcaggaattactaagagaaaatttgggaggaagacatgccaaaatcagcaaatcaaaagttaagattattatttgaaagagaaattttactaagagaaacggatgaggagaatcctattactacaaaacagcttatatcacgtttggaggattgcggcgttcaggctgaaagaaaaactatttatagtgatattgaggctctttccctatatggtatggatataattaaggttagcggaaaaaatggcggatattatgtaggtgagcgagactttgaacttcctgaattgaaactgctggttgacgctgtccaaacgtccaaatttataaccaaaaagaaatctgctgagcttataggaaaaattgaaagattaaccagcaagtatcaagctcaggtattgcatcgtcaggtatatgtatctgcccgtattaaaaatatgaacgagagtatatattataatgtcgacaaaatatatcagggtatagatgaaaacaaacagatagaatttttctatatggaatataatcttgataaaaagcgtgttcctagaagaaatggaaaacgatataaaataagtccttatgctttgacatggaacgatgataattattaccttataggctatgacggacagtccgatacaataaagcattatagagttgataaaatggagaatatagttgttctcaaagaaaatcgcgaaggagaaacaaatattgatataggagaatattctaaaaaggtattttcaatgtttggcggtagtgaggagtccgttactcttaattttgacaataggtttattggagttgtaattgacaggtttggtaccgatgttccggtaataaagactgacagtgaacattttgagaccagtgtaacggttaagataagtcctcagttttttggctggttggcgtcattagggagaggcgttaaaattatctcgcctatcagtgtgaaagatagatataaagagcatatacagtcgattttagaatgagaaagataatttaaacttttttaatagttttatattttatttggttgagataattggatagtaatcatattattaaactgtaattgataataaagttctattgaatttatataagaaatttatgtgaataaaaatataagtgctgcaaaatatataagttaaaacacagctgctatttattatataagcagctgtgttttaattggtatgcccgacgggattcgaacccgtgaccttcagagtcggagtctgacactctatccagctgagctacggacacataactttttttattataacataatttagctttatattcaataccttattctaacatttcataattcgttttgtaggtttgtcaatgatgtgttacaaaaaagattaaaagagttcgccgaaattgataaaagagttgatgtagtcaatgggagatttccaattaagcggacgcatcgggaatttattatagttacggttatgcacctttaattgctttgcaaaatcatcaaacgagtagaatttatgtgttgcataaaaatactcgttatccttacggtgtgaacgctagcttcaccgacaatgcaagcttcaggaacaaacttaacgtctatctgtactctctgaccgggatagagcatttgcttgtaaggctttggtatgtatttgggattgggtggtttaacaggcatttgtccctgtttgctgtgtatgcggtaaagacctgtaacagaacgagtatagcctctttgacgaagcttaacccaaaacacaacaagtccggcattggggctacggcggcgcatatcagtaatcaattttaactcatcagcggtatgctgattgggatgatggtggtggggtttatgtgatttatcggctaaggaggcgagcgtaccgtcgtagcgttttcgccagcgatagacatactgacgatttaccttatagcggattattgtgcgataataggactaaatcagaaagaccttgaaaaccaaggcattctggcttagtcccttctttttttgaccgaaaacaaaggactttcacaataatcaagcaagccggagggtgccgctgcacacttccggcagaaggaggatatagtgggtgctatcaaagtcttcttgaaggaagttgtgcttccaatcgcgcttgcgttctgcctcgcgtcatttctcaagccgatctatatgcctgacggcgtatgcgactacttcctaatgtggatctgcgtcggcttgccattcggcatccggaggatgtgcctctggctcgttccaagcggttacggcatctccggctcagtcggcattttcgcattgaacttaatcataggcggtctcatcggaggactcgccttcttcatcgggctgctgctcggtatcattcataccatccgagaaatcatctgaactacatcgtaaacgaagagggtttgtttcttctccaatttggagtaagaagcaaaccctctttttttgttgcccaaaagccggagtatttgctggcgatgcggcgaaagaaaggagtttttaagcatgaaacgcatgacagccggtgatcttcaagcactggaattgctgatgcagaccacacccggctttgagcattttgacagcggcgcggatggcattctccctgagtgccgaagctgccgctttcatcgccccttctggaaatatcagtcctgcgtgtttgcagagtgtccctactgctgcaatcccgtttctaccctcaaaaaccaaagtggcacatctgctgccggaaaggaagtcaatcatggataacaaaatcgaagtcttcaagaatgaacagtttggagaaatccgaacagccctgatcgaaaacgagccgtggtttgtggcggtagacgtatgcagggctttggagatcggcaattcgtcacaagccatttcacggctggatgcggacgagaagatgattaccctcatttcaaatgagggtaataaacgaggcaatcccaacatgacggtggtgaacgaacctggactttacacgcttattctgagcagccgtaagcccgaagccaaagccttcaaacgctggatcacacatgatgtcatccccatgatccgcaagaccggcggctacatgacggactcccttctggaacgtattcagaaggaaccagcggtcattgtggagtttgctcaggcgttgattctggaaaagaatcgcgtaaaggctcttgagtgtgagctgaacacggcaaagcccaaagccgattactacgacgccttcatcaatccggatgactgcaccaatatccgaacgacggcgaaggaactgaaaatcccggagcgcaagttcgtccagtttcttctcagggagaagtacctgttccgatctccctccggtcagcttcttccctacaacaaggacagcaatgccggactgtttatcgtccgcgattttgtgacgtactgctacaccggttctcagacctacttcacgccgaagggcaaggatgtcatccgaatgaagttccagaaaaagtgcggcgaagagctgctttccaagatggcaaggtgatttctgtggcagtctatcgcgtaaacaagaatcgtggctatacggtcatggcgaacttccaccttcgagacaagagcctgtcactcaaggcagtcggtcttctctcaaagatgctctcgtttaatgatggctggaagttctcaaccaagggactttctgcaatctgcaaggaaggtccggatgccattctctccgcgctccgtgagcttgaaaagcacggctaccttgtccggcaccggcagagagacggtaaaggcaggatgagcaacacaatctttgagatatacgaagagccgcaggagtctacaccagaacgggaaaagccacacacggaaaatccatgtgtggagaagccagatgtggataatccacgcggggataagtacgcacaaataaatactgatcaagtaattacccaagaaagaaatactctctcaaagaactatcaatccatcaatcttgatgggatggacaggatggatgagcgaagcgagtatgaagagattatcaaagagaatcttgattacgacattctctgtcaggatccgaagttcgataaagaccgcttccgggagatcatggacatcatgctggatgccgtctgctctaccgctccgaccatccgtatcaatggcgaggatatgccgcagcaagtggttaagtcccgctttctcaagctgaatagcagccacattgagtacgttctggaagcaatgaacaagaacccgtcagacatccgtaatatccgggcgtacctgttgaccgctctgtataacgcctctctgacgatagacaattactactccgccctcgtcaaccatgatttctacgggcaggacagatcagcagggtcaaagaagccgaagacctacgattatagcctttgtgaagacactctttaatgaataccatcgtgagcattgctcggaaaggaggacagtgtaaatgaaaatcatctatcgccggattgtgccgccttagcgtcggcagcagtccccataatcattccaaggaaaggaggtaaacgcagcaatgcaggatgaagtcaacaccaaagttgttgcaatcatgatcaagggcggtaaaatctccgctgaggtgctgaaaaaggctctggacaagttcgttcaggagatcgagaaggcgcagaagcagatgaagcagcctaaaacctatcgcggcaagcagtccatcaagcatctgatgagccagaatgccgccatctccaacatcgaagtgacggatggcaacatcaaatcctttgagcggaccgccagcaaatacggtctggactttgcgctcaagaaagacgtttccgttgagccgcccagctatcttgtcttcttcaagggacgggacgttgatgtgatgaccgccgccttcaaggagttctccgccaaaacggtcaagcagaaggaacagccgtccatccggcacaagctggatcaggagaaagcccagagcaaggcgcagcacaaggagaaggtcaaggtcaaaaccaaggatcggggtgtggagctgtgaacaaacccgatgtgaagaagctcattcttctgaaccttccgtatgtcttcgccttctacttcgcggataagatcgccgccgtgtttcgtctcgcccccggcgcagcgttcatcgacaagctgacaaacggctttgccgtgttcggctctgcctttgcaaatccgctgcccagctttcatcccgtcgatcttctcatcggtctgtcggctggcgtgctgctcaagctggcagtctacgtcaagggcaaaaaccgcaagaagttccggcagggcgaagaatacggatctgcccgctggggcaagccagaggacatcaagccgtacatggacccggagttctccaacaacgtcattctgacgcagacggagttcctgaccatgaacagccgtccaaagcagccaaaatacgcccgcaacaagaacatcctcgtcatcggcggttccggctcaggcaagacgcgctttttcgtcaaacctaacctgatgcagatgcacagcagctacgttgtgactgacccgaagggtacggtgctggtggagtgcggcaagatgcttgaaaagggcggctacgtcatcaagtcgctgaacaccatcaatttccggaaatccatgcactacaacccgttcagctacattcgcagcgagaaggacatcctcaagctggccaatacgatcatcgtcaacacgaagggagacggcgataagtccggcgaagatttctgggtcaaggcggaaaagctctactacacagctctcatcggctacatctggtatgaggcacccgatcacgagaaaaactttactaccctgctcgaaatgatcaatgcctcggaagccagagaggacgatgagaccttcaaaaatcccgtggatgtcatgttcgatgaactggaagcccgtgacccggatcacttcgcggtcaagcaataccgcaaatacaagctggcggcgggcaaaaccgccaagtcgattttgatttcctgcggtgcaaggcttgcgcccttcgacagtgcagcgacacgttgtcgcatataaactctgcgtgggattttcctgcaaagaggtaaaagtgacggaaaggctatagcctttctaactgatattccgagaagtggaatggcggggtaacgccctgaaacgcttcccttgatactgcgttggaagaaacgggacgtatttcccgcgactgacacagcacgctgaagtcggctgtctgcacccgcgactgtcccctttgggggataaagcaaagccgagccagaggtggccgggggtgttaggccggaggtctataaagtacctatgtccagaatgcggctgactaccgctgacaaaagcccgaatgtacaggtctataacgggatatggcagaaatgccatagccgtgaaaacggcgtatgtggggtaaagtaagatttgtcgatatgaaattccctatggtgttacaggcaccatcaggcatacaggcctaaagggcagggttaagggtattatgcaaagataggaatatcggaacgtggaaagccccggatgtggagtggatacgcatgatgaagcaatgggcgggaaaatcgtgccgccttttatgggaggtgcggtataaccgttcttaatccgggaggaaagagcagccatgctacctgtgaagccgtgaacaaagtaagcggtggagggacgggctgtagtcaggaacagaaacaaaatcatattcaataaacacgcataggttcgagtaggactaagaaaggcgaaaatccaaacgaaagtggggataagtaaccgactatggcaacaggaaaggcaaagaagaaagataagttaaggcacgccgagtattatgacttccaggcaattcaagataagctgtatgccgacagcaataaaggcaaagttttcaaacatctggttgaaatcattgcattacccgaaaacatacggctggcataccgcaacatcaagaagaaccacgggagtacgacgcccggcacagatggaaaaacaatcacagaattatcagcactctctgatgaacagcttatatgcgccatacagcgcaaattaaactggtatgtcccacaaagcgtccggcgggtagaaattccgaaaggaaatgacccaatgaagaagcgcccgctcggaataccgacgattatggacaggctgatacaacagtgcgtattgcaggtcatggagccgatatgtgaggcgaaattccacgaccacagttatggattccgccctaaccgaaaccaacagcacgcaatcgcccaggttcacaaaaatatgcagagaagcaatctccactatgtcgtagacatagatgttaaggggttctttgacaacgtgaaccacggaaaactgctgaaacagctctggacaatgggaatccaagacaagaagctgcttagtattatatcagctatgctaaaagcggaggtggccgggataggattcccggaggtgggtacgccgcagggaggtattatctctcccctgctatccaatgtagttctaaacgaattggattggtggcttgccagccaatgggaagaaataccaacggagttcccttacaaggaatcggtcaattacaacggaagcgtgagcaagagccataaatttgccgcactgcggaggacaaggctgaaagaagtcacctgcgtccgatacgctgatgattttaagatattcacgaacagctatcaaaatgcggtgaagttattccacgcaaccaaaagctggctccatgaaaggctttctcttgaaatcagtcctgaaaaatcgaaggtgattaacctgaaagagcagtattcagagtttcttggtttcaagttaaaggttatcccccgtgggaaacggagcaacggacgcgccaaatatgtagtagagagccatatcagagagaaatctattgcgaaaataaaaccaaacttaaaacggctgatttacgacattgagttcccgtcacaaggcaaacgtactgaatatcaggcgatttgccgctacaacgtttatgtaatgggaatccatgactactatcaattagccacaaaggtctgcgatgaccttacgccattcgccttatctgtccacaagagcctgcgggcaagactgaaagaacgggttaaaactgcaaaacaggtcagaaaaaggaagattccgtgtgaagttccgaaagttatcagggaacggtatgggaaaagcaaacagctccgatatgtagccggacacgcagttgtcccgattggctacatacggcacaagcccccaaagtccatgaaccgcaaaatcaattcctatatgcccgagggcagagccgaaatccataagaatctggacagaatcgacatgacggttcttcattacttaatgaggaacccggttctgtaccgtactatcgaatacaacgataacaggctttcactgtattcggcccaaatgggaaaatgcgccgtatctggcaaagtgctttctattggcgatattcattgccatcacaaagtgccacggtatttaggcggcaaggacaattatcaaaatctggtgttggtatgtgaagatgtacatcacctgattcatgctacaaaccctgatattatcagaaagtatatggaaatcctaggccttgaccaaaagcagaaagaaaaactcaataagttaagaagccttgtccacgttgagagttattgagatgaaataaattctgttcctgatggcaagccgggtgagctgaaaggttcatgcccggtttagggcgggggaaaatccggagataacatcaaaggattacctatcgctattttagaagcttttgaggagcacagcagctattcttctgcggtattcctcgaacaccttgtaaaagcctttaaattccctattgagtgcgttcagactgataacggacaagagtttaccaagaggcttggcagctcccaaaagccgaccctaactatgtttgaaaagcggcttaaagaacttggaatacaacataagctcataagaccgtacacacccagacataacggcaaggtagagcgttcacaccgtaaggataacgagtatttttatgcaacacataaattctactcgtttgatgattttgcaaagcaattaaaggtgcataaccgtaactacaataaattcccgatgcgtccgcttaattggaaagctcccattgactacatcaactcttttatcaatttcggtgaactcttttaatcttttttgtaacacatcattgacaaacctacattttgtcttaatttgttatatattatataaataaaaaccggacgcacttaattataaagtacgtccggttaattatacagaaacattaaactgcttcaaatccaatatcgtctattacatttttaaaaatgctttcttctgttttggcctcatcatattcaactgtcgccatttcgttttcaagactgacatcaacactttttacgccttctaaagctgaaagggctttttgtatagaagcaacgcaatggttgcagctcatgcctttaattttaatctctgaagttttcatattaacacctctatatttttattttatctttattcttttcaaaagtaatgaattagtcacaaccgaaacactgctgagagccatagctgcacctgcaattgccgggttgagaaatccaaaggctgcgaacggaattcctattccattatatataaaggcccaaaatagattttgtcttatctttttcatagtcattttagaaagataaattccgtcacaaactgcatttgggtctcctctcaataaagttatatctgcagcttcaatagcaacgtctgtcccatcgcccattgctatacctatatcagcactgactaatgcaggcgcatcattaattccatcgccaaccatggccacaacattgtcttttgacttaaaagacaatattttttctgatttttcatgaggcaatacgttagcaaacactttttttatacctaccgacttagcaattgctgcagcagtcgcatcattatcacctgtcagcatacaaacatcaatatccattctgctcaatctgttaactgcttgaacagatgtttccttaactgtgtcagaaagggctacggctccaataaaattcgtgttttcggatacaaacattacagtcttaccctgcatttcaaattcagacgctttttttaaatctatattgcttatctcaatattagctgaattcattagtttcctatttccgattctatatacatttccttccttattttttccctctatacccattcctacttttgcttcagtttcctcgagctccagcaaaccattaacatttttaacacaatgtgtataaatagccttaccaagcggatgctcacttccaaactccaatccgccgattattttcaaaaatgtttctttatcttcctgattagctaatattaagtcggtgacatcaggcgttcctttagttatagtaccagtcttgtcaaatacaactgtgtttatttttgaggatatttctaatatttcaccgctttttacaagtattccgtgattagcacagagccctgtaccaaccataattgctgttggggttgcaagcccaagagaacatggacatgcaataaccaaaactgatactgcgtttatcaaagaagtttcaaagtttttagtaataaaataccaagcaaaaagagttatcagagctattatcataatagccggaacaaaaacagctgaaaccttatccgctatcttttgtattggagctttcttgccctgggcatttctaacatatgtgattatatttgataacgttgtttccttaccaattttttcagcttctacttgtataacgcccattttattaattgtagcacaaaatacattgtctccaatttttttgtcaacaggaagactttcgcccgtaagcatagattcatctactgttgaccgtccgctttttataacaccatcaattggtattttttcgcccggattgataacaactacatctccggcattcaacatagagagcggtactgtagttataactccgtcacgaagaagatttgcattttgcggctgtagttttatcagcgactgtatagcttcgcttgttttaactcttgctcttaattccaaatattttcccagcaatattaaagtaataatagtcatggacgattcaaaataaagaccatccatctgtccatgtactatattacctgctatcacattatataaactgaaaaaatatgcagacagcgttccaatagaaacaagaacgtccatattagggctttttgattttatagcataaaacgctggtttataaaatctataacctattataaactgcactggtgtagctaaaattaattgaaaaatcggatcgtgaagaaacattatatgaattccaagccacgaggcaatcattcccaaaatcagaggggcggttaatattatagaaaatataagatatatttttagatttctaaactctctttgattggaattttcttttgattcgtcgtaaacctcagctccgaaacccatttttttaattttatctattatttcatcatttgttataagagtttggtcaaaacttacagttgccgtttcagttgttaaattaacattgatttcttcaataccgttcgtttttgctaaaacacgttctattcttccgctgcatgcagcacaggtcatcccgtcaatttttagctcagacctcataacaacagctcctttcaataattggaacatttgtaaaaagttagcaattcctaactcataataatcatagcatatttattttataatgtcaataaaaataaggatgagaattactcatccttattatataaatctaatagaataatatactacgcttcattattaaaactttgcagattttttatacaagcataaatttcagggtatttcttcaaaagatttagtggtttaaattgtctgtcagtgaaaccatgagtggtatatcctgtggctaataattcaccgtcatctctaataacgttatattcaaaaacgcattttgcaacgcccaatttttttaaattaacctcaatccaaacatcatcctgatacttagcacccttaataaacttacaatagcagtcaagcaaaggaagcaaaacgccgttttcttcaacttctctgtatgacatacctgaagttttaaagaattcagtgcggccgacttcaaaccaaggaaaatatctagagtgatgcactactcccatactgtcaacttcacagtatcgaaccgtaatttttgttttaaacaattttatctctccttatactatctttgctataccggagtaaacttgtcctcttattccgtctatagtaaccgtggtaccattttttagtatctttgtcgcatttttaacacctaccaagacaggaatatccaaagtcattccaacaatggcagcatgtgacgtgcttccggaaacttctgttataatcgctgaggctttttttaatatagaaattatagaattagatgtctcaggtattaccaatatatcgccgtcttcaaaatattttaaagcctcattgttattggaagcaacacaaacttttccgcttattgatttatttgaaagactttgtcctgacgctagtatatccccaaccaacagaacttttaaaatgttggtagttccgcttatacctaacggcgaacctccggtgagaacaactacatcaccttttttaaccagtttagtttctcttactgcacaattcacagcatgttcaaaaagctcatcgcttgtgctcttaacttctgtcataataggagtgacgccccatgataaattcagctgacgccatatttttttatttaaagcacctgcaataatagggcatttaggacgataagcagaaatctgacgcggagtatatccggactgagtgacagttatgattgcagctgcgccaatatcatgtgcagtcgtacatgacgagtggcttatcgcatttgaaacactggttgtttgatttaaatgcaaattttcaaacctcttaacataatctatattctcttctgttttaatacagattcttgccatagtttgaagggccaaaaccggatattcaccgacagccgtttcgcccgaaagcataacggcggaagttccgtcataaaccgcgtttgccacatcagaaatttcagcacgggttggtctcggattatgtgttatactttcaagcatctgtgtcgcggttataacctttttaccctctgtataacattgttttatcagctttttctgaatggcagggagttcgtcaaaggatatttcaactcccatatctcctcttgctaccattattccttcgctgacttttaatattgattcaatgttgtcaacaccctgcctgttttctatctttgaaatgatttgaatattttctccgccgttttgttccaatatcctttttatgtcaagaacatcaaaagctgaacggacaaatgatgctgctataaaatcaaaatcctgttcaattccaaatttaatatcttcaacatcttttttgctcatatattccattccaagctcaattcccggaacatttatacttttatgattgctgacaggaccgccgtttaaaacctcacatattacgtcagaacctttgatgccggtaaccttcatttcaattaatccatcgtcaatcaaaattttggcgcctgcatatacatcttttgccaaatccttatatgtgattgatgaacgagtgttatcgccaactatatttttaggagtaagagtaaagctctgtccttcaacgagttcaacttttccattttcaaaatctccggttctcacttcagggcctttagtgtcaagtaaaagggctattggaaggccgagttcatcacgcattttcttcactgcatttatacgaaccaaatgttcctcatgagtaccatgagaaaaatttatcctggcgcaattcatcccattcagcataagctgctttaaaacttctggctcatctgtggctggaccaagtgtacatattattttagtttttcttctcattgattatttctcctcacctatgtttattactcccatttttgtatataattttgatttacctctaatttttattgcagaagtattctctgtaaactgagcaatataaacctcacctttatctaatttttcagtatggtgaaaccgtgtatcttttcctctggttaaaccaataatagttactccgtcttcctctgcaacgattgtgacatattcaccaaaagtgtttacatccatatataaacctccagattttatattgctattaaaaataacatatatatttacttaaggcattatataccaaagcgataaaaaaatcaagcaaaattagtttaaatataaaatattaagcgcaaaattaaagagatttaattaattaaagtcaagatatgtatctggaacatcgccaactatgactgattctgcaatgggtacttctgtaactatgtcttcaaggtctcctcttacaggcaaaacaacacccagtgctgttgtaacttttacttttattaaatgttttgtttgattaattccagcggaaataaattcattacaaaactcaacctttacattctcatttgttaaaacacgcaacgatacaggtattccgtacccggaatagaacttactcgaaaacatagaaagtattggaattgatatatcgacgctgtttattttatcaattctattctgaacatttacagcaagttcagattttaaaaggtttatctccctgtaattggtttcaagactttttacatttccgctgctgtcttttgtcatatttattattgaatcatagttaatatttgattcatttattaattcgctgacagctgaattacattcttttgtaacttcactgtttaatactgataatgacaaatctttaattactggatcaatatggttttcaattgaattaaataaaaatacacatgaaactatgactaaaattaggataatataaaatttaatttttgaagatgattttctattatagtatgttctgtgacgtttacacctttttcctgataatccgagcctatactttaactttttttgccaaataaacataagaatcacctattgtatgttacgctatactctaatttttgttacaattataaatttatttataaataaggtaaatttaacgtgacaatgatggtttagtatagtataataaacaaaagattaaatttgtatattattttgatgaaagtgaggaatagttatgtggtatgacgaaagtgtattttatcaaatctatcctttgggattttgtgacgctccaacagaaaacgatggaatatataaaaatagaataaaaaaagttgtggattggataccgcacataaaaaaggttggatgtaatgcggtttatttttcgcctatttttgattctgataatcatggttatgacacaagagattataaaaatattgactgcagactcggcaataacaaagactttaagatggtagctcagaatttgcatgaaaacggcataaaagtggttttagacggtgtttttaaccacgtaggacgcggcttttgggcttttaaagacgttatagagaaaaagtgggattcacaatataaagattggttttatataaattttgacggtaacagtaattataatgacggattttggtatgaaggctgggaaggacattatgagctggttaaattaaatttgagaaaccaagaagttgtaaattatatactggaatgcgtagatttttgggtaaatgaattcgatatagacggacttagacttgatgtagcttattgtttggatcaagattttttaaaaactttaagatatcattgtaatcaaattaaagaagattttgttttaatcggagaattactgcatggggattacaatctattcgtttcagatgacaaacttcacagctgtacaaattatgaatgctacaagggactatattcgagctttaattctgagaatatgttcgaaataatccattcgctaattagacagtttggaccggaaaattggtcgctttataaagataaacatcttttaaattttgttgataatcatgatgttactagaattgctgatttgcttaatgtttcagaacatttaccccttatatatgggttattatttagtatgcccggagttccatgtatttactacggaagtgaatgggaagcaaaaggaaagaaagaaaatggagacaacgcactgcgtcaaagctttgaagctcctattgaaaatgaacttacaaagttaatttcaaaattatcaaaggcacatatggaatcaaaagcgctctgttatggaagttttgaatctgttctgctaacaaataaacaagcaatttttcagagaaaatttgaagatgaacgtgtgcttgtcgcaataaatattgatgattcatctttcaccgcacactttgacgctcaatgtggaatggctgtcgatttaattactgacgaagtacacgacttcggcggcggaagcgagcttcctccatacagcgtgcagtattggaaaatggaaagataatttatatttttataaattttaaatattatatgttttaaaaattcatatgtataaatttcaataaaaactgacatcagataaattatatgcactccaaaatgaactatattgattactaacaatgacagaatattattaaaaggagaaatttataactattataatattatagcatatatttttgattacaagattaaaattgataattaaatatgccaaacaggcttcttgtaacttttttaagaagcctgtttctacttgtttaaaaacatatattctatttccccactgaatcttcaggtatgtatccagctttaataattttttctacaaataaatttaagtctattccgccatttataattatattaattaaactcttaaatgacggtagtcttttcccattttctaaatctatgtattgacgcggggagagacagcatttttctgccattttctcttgatttaatttcagttccattcttctaaagtataatgtctttccaaagcataattttaatatattcatcatttcactcctaatatacaaaatgtgtaaattctatcaatttttattccaagctatatgtttaattgctgcatatgaactttacttgctcatactttttataaagtatgagtaataattgcataataaattttataattaaataaaaaaaacgcggctttaaatgccgcgcctgtcggtgcaaatatagttgttatcggttcaggtataatctccagcgttttttaatttttttataaactcaccggggtctatatcacaaataattaatatgtttataaaagttggggttgacggtatacttacagcgttttctaaatttacatatgatctgcatgtaatatggcacttatgagccatagcctcctgagtaagtttatattcctttcttttagatagtaagatttcgctcaatacagtttttataatctgttgattgtttttatttatcacaaaaaacacctcccttcaatatactacagatggattgtatcagaattttatatattttgaaacgaagtgtgattcatgaaatgcgaatcccaaaatcttcttaaattttttatatcaaaccttactcagtatatagtaaagatatattaataagttttaggatatttatctaacaataatatttttctttataatgtataagtttaaagattaattatattatcattatatataaacctattaattaatcttctaatttcttatttctaaataatactctgaagtattgatatgttggtcaaaaaaatttgcagttatcaggctatagtaacattttctttattgaaaatgtcatagcaaaaatataaaagggtatgttttcacacccttttaataatctaatatagagcacaattttttatatcaaaaattctgttgaatatatatacaccaaaaagatatatattatattaagtttatgatacatatgctgcagcagtaatatcgatgtattataagtaaaatatttgtttatttttatataaataaatacgcagttgtcaataatagaaatatttatacttattatctgtatgatgtattttataattataaagtaattatattataatttgcatttaggattactagattttgtggaaactcccgcatgagattccagtagccaattcctgataaattgtaacgttcggcaagctggagtttggcggtaatacttcttggatcttcaaaccaaacttcatgaagccgcccttcattatctgtgtatctgaaccacggtgattgcgcaacagtatcaaattgtatttctgcattatttgcttccgctatcctaatacattctaccggtgataaagacgttgcttttgttactccttgttcaaatggcaagggccagtcataaccataagtcggaacgcctaaaagtatttttgaagaagatatacgggtcagagcatactccaccacttcattaactttatttattggagccacagccattggcggtccatatgtatatccccactcataagtcataagtaacactttatccacagatgaggcaatagcgccataatcatgaccttcatataaagttccttgctgtgtgtcgctaacttttggagcaagcgctgaaaataaagggtatccaagaggatttatagctttgtacatattctggagaaatataacataatcatatctatcttccgggtatataaattcaaaatctatatcaagaccgtcatatccttttcgttccatgttaccaatagtctcattaattaatttactttgtatatttccatttgtgaatacaagatttgctctttcattgctgaagtttccagcttcagttaatgttgaaaggtgcattaaatttttggttccaaagctgtttgccatagcaatcatccactcatcgttttctaaattaaccaatccgccgtcttctcttatcccataagtaaatggagtagagtatgtcatataaggcagctgttctctaagaagttcgcgacttatgaacggataagcatatccgttggttataaatgatgttgttctgttttcatcttgatatttaattactattgtttgacccggtgaaatgtttgtactgccttttaagaaataattgtttcttaataaagttttaatgctgacattatatctgtttgctatacctgtcagagtatcgccctgctgaactatatattgtgtttcgggttgcagtataaccaatgcttgaccgataacagcccttgagttggtgtttaaaccattatcagctaaaaaattatttaaatttacattgtattcattagcgataccggttagtgtttctcctggtttgacgacatgaataatcatatttatacctccgtgatttatatttatttgtttacattaaaattaattgttaaactactaattaaaaatatgtcatgaatttctgcctattatgtttttaaaagtatatagcacatttcacataaacaatatattggtcataaaaatataacagatatttattttttaatatataattaataagtgtacacagattaaaccaacaaatggcagataattaacatgaatgtaaatcttactacgacatatcaattacaatatataaattgtgattaaaaaataataaatgtttctaataaatattattatgaatttatctgcacttatcttcaaaccattaattccattgacaaaattattttatcaaaaaatttttatataaaaaaattctaagttttataattcacgcatcagatggaaagactgcattagatttaaggttccgtatccccattgttcattgggataatccattgcaatgctttttacacatccgcgtatcaagtaagcccgtatttgataggtgcttaatgatacatcgtttccatttacaattccccattgcattaaaagtgcgcatgcaccactggttattgctgcagcagcacttgtgccgctcatttggccaaatccatacggaaagtacccgcctatattaacgccgggagctactaaatccggaagagttacctctgcccttgatggaccccaagaggatttttgataaaggctttggcttaaactattataagctccacagcatatagtgccaattgctgtccctggaatagttgtggtgtaatatggtgaagcagacaggaattctacatctggagacacaaatcctgacattggaagccatgagtgataaacaccattaagaataatgtcaccatgaacgataatggtccatattccgggagtagcatctaatattcgcacaactgttaactgaccgccgctgccttccagcggcatataatattctatagttactctggtattttcaagaacaagctttacctctgtgcttgtgcccgcttttgccggtacacgtccaactaattctccggatggtgaccgaattgatacagaaagcctatcggatacagtattccaaagcgaaatacatatgttaccggcgttgctgcctactcttacatcaacattctgagtttcaccaactgtgttgagttttcctgatgtatgatggcgctcctgacattcatttccggctgcattacaaatacaaactccttttaaattagatataccgcttaaatattcttcaaatatactgaaaccatcgtgacttccaaagtttgtacctagaccaagacaaattactaccggccttttcaattcatgagccttttttataatatattcaatacctaccattactgcacttgattcaaaagcgtattcctgttggtctggaacgcaaaacttttcaagataaaatggccgggctttttttaatttaacggcaattatatcagcctcaggcgctgctcctgaaaaatcatctatttctcttcctgcagctaccgaggccaaaaaggttccgtgacctgatttatcatgttcaggaactatatcatgaggattttcagaatataatgcggagttaatttgttcattattgtattcatgtccgaaaaagaaaccatcaggaggatctccttcagctgtttgatcatatataaattgaattttacttgttccgtcttcataaataaagctttcttgcatataatcaatacctgtgtctacgataccaactaaaacgcctcggccttttaagtcaagatacggttggttatgaaccggtataattccggctgaatcaagcggaggacggtccagtgttcccaatattacgggtgcagaacttataaatgatgtgcttaaatatgaaagcaaatcatcatagtgacttttatctatataaccgataatatatcttccggatagagtctgtgtaattgttatattaggatttttttttataaattcatcaagataatcggaacttctgactataaaatcaagagtgtcgggcgattgtataaaatttttgatctcatttgaaagttccatattaaattctccttttatatagttccaaatcatcgatggtgtcacaaagacttagttttccatatccccaaagaggattgggataggttaaatatgtatttcggactgcatttttgcataggaaagctttaacacgctgtccaaaaagaaaaggatcattcccttttacaattccccattccatcataagagctgctgctccggaaacaaatggggcagccatgctggttcccgtatatgtatcaaaaccaccgccggattttgctgtatagatgttttcggcaggagctgtcaaatccaattgaggcagtccaatttcatgtattgtgccgcctcttcctgaaaaggtgcaaacagtgtcagtttcgggtctataaccgccaacagaaattggagtaaccgcagtggccggtaatgtcatcgtcatgtctggagtagattcaagaaatgaagtacgttcagacacttcatcaattgtagggagccaaacgtcaaaattaccgtctactattttttcaccgtaacatattagagtccaaataccgtccattaggtctgatgatgcttctaaattaacgtaaatttcctgagctgcactatagtgatttggttcaccaaaagaaaaagatattttaacattgtgtaagtttaaactaatatctcgaaccaatggtgtaattatgcctgtagacatcccgctgggattaactaattcaaaattaacaatatcggaaaaatttttccaaagtgataagtaaacattatttttattagaggaaacgttaaagttcaaatttagtggattattttctttaatatttcctttaaaatggtggccgctatatccttcgtttccggaagcacatacaattactgttttccaaaatcttgatatgtcatcaatataagtttcaaataaagattgacctctatgagaaccattattcgtaccataacttaagttgattacgcagggcatattataattaattgctttatcaattatatattttatacctctcattatgtcggttgtgcgagtttctgaactaccaagctttactgctataattgatgcttccggagctgctccgctgattcctgcagcaataccggcaactgcagttccgtgtcctataaaatctttgcatacaaacttatctgcattaatatcagaaaatgtatattctgttcccttataaaaaccattaggtgggactccttcagttgtcatgtcccatacagataaaattcttgttgttcctgcagtgttcataaattcggagtggctgctatcaataccggaatctataattccaattataactctagaaccggtcaaatggtaacttgtttgattttggaccggagatatacatgttgagttgagaccgagtttagttgataaaaatagtttttttgttggttcccaatattcaatttcttttaattctctcagatatttgatttgagatggttctatatcaataattgcataaccggcgcttaatatttcaattttatctcttatagaatcaaggttgccattatattttataatatattccatatgaacacagccttaaaatatatttttgctcacgtaccaacgagctgtacatatattattatgagaaaggatgtgatattatgagaacagattatatagataaaggaattctgcaggtatcggtctctacagagaaatttgtaataccaacagataatgctttggttcgtattactgatcctcttgacggttctgtaatagaggaagttaaaacagacagttcaggtcagacgcccgctgttgaattgcctgcaccgccgcttgaatattcggttaacggtggagatgaaagaccatatgcattatataatgtaactgtttcagcagcagatacagaggttcttcatattgatggagtacaaattttacccactagttcagcgatacaaaatgcagttttaagaccagccgttccgggaggcttcaatgttcgcaatacgttgattaactctcattctctttggacgaattatccggcaaaaatacctgaaaatgaagtgaagccaatagataatgcaagtgggtttgtagtactgcctgaaccggttatacctgagtatattgttgttcatcttggtaatcccgatgacatatctgccggtgacgttgaggttccatttaaagagtacataaaaaatgtagcaagttgtgaaatttattctacctggaagactgaaacaataaaagcaaatatacttgcaattttatcatttactttaaaccgtgtttatacagaatggtacagaggaaagggacatgattttactgtcacaaactctacagcatatgatcaggcatttaattacggaagaaatatattcaaagaaatctctgtagcagtagatgaattattcacgaattatataaccagagaaaatattgaacagccattgtttacacagtattgcgacggcaaacatacgcagtgcggcggtttgtcacaatggggttctcaggcactcggggagcagggatatgatgctttaagtatattaaaaacttattatggttcagatatatatattgaatcagctgaaaaagttgaggggattccatcatcatatccaggagaacctctgcaaataggaagcttgggagaagcagtaagaaccgttcaaactcaattaaataaaatttcgaacaattacccgttaattgctaaactgaggatagatggaagttatggtgaatcaacagcgaacagtgtaaaaacatttcaaaaaattttttatcttccggaaacaggagttgtagatttttcaacatggtatcaaatttctaatatatacgtagctatttcaaaaatggcttcataaattaggttttaaaaaatagcattgtataaaatatttttgctgggtgacaaactaaaaatatcatggttgacattataaaatggttatagtagaatgtaagaaaaacttataggacatgatatatatggataaaaaattgttggaatatatctccgaaaaatcacaagagctaataaattcttcaacatgcagtaatggggcaaaatcagcagcagaatcctggctgaaagccgttggcacagaaaacgaagcttctgagacaaagaattattttgctgaattggaatctgatattatgcctattgatagtttaattaattttgcagaatcagataacggagtaaattattttggggctgacgccgcaaaaagcatagcaaaacatgcaagggaaattaaatcatcaggggcaaaatattgcgattgtccggcttgtgctgcagcagaggcaattctacaaaaaaagaatgatattcttaaataatagaacactgttgaccgattataataaaatactccgccgctcagtttatttgagcggcggaataaatatttattcagttgttattattgcagtgttagtaacttcgtcccaattcacattatatcataagttttcagataagaagctaaacggaaccattactctacacgattataactttattccatccatgcttctttataccatggggttttacgccatgcttctgaaaacacttgcggttcaggtttgtcaactactaccctctgcaaattttctacataagttactttggcgtcaaatgcttctgatacagccctaagaggtaccattgttctttctccaactattttcggggctgtatcaagcgtaaagacttctgtaccatttcccatttcatagttgtctatctgcattactactgttctttcgccatcgttcgccgttataaccccgtctccatcgtcataacttacttctgctccaagtgattcaaatattgcccgaaccggaaccagtagtctgtcgttctcctctatcggctgctggtctaagtttaactgtttaccctgtgaaaatacagctatgccttcttgaccatatccgtcgattttatatgggtcgttctctgttcctgatccagattttattatcatattatcttcattcagataaaatgccggacgaactccaagttcatacatgttaactattttcccactatatgtattttctccgtatattgatgttacatctgtgcttcctcctaacgttcctgcatgcatagttgcaacactacgaagccaatattcataatacccattattaatagttgagtttggaattgagctatcggttcttttggctcctacaattccaaagtttttccatatattatatatctgtgattcattgagtaaaaatacagtatcagtctctctatacattgcgccttgaaatgcttcacccagttccgaaacatcaaccgtatgaagcactctaggattacgcccactgcccaccataaatcctcgcatatatatcctattacatccgttttcagataaatcaagttcacttccgtttaaggtttgccattggctgactgttttcatcactctacgctctgataatgttaaattatcaatgtgcaaaaatcctttttcatccgcatatggatacttaccttcttcatattgaacagcattattatttccatgtatctttttagcggttggaggattgtttctcggccatattatatcccctccctcagcatatgaattcaaccatgtacgtatattactttctttccatttatttgttccatatactaaatgtccatctgcatttgcatctttaacagatgcgtcaaacgctttaaagcatattatcttatcgctcactattaacttgccattttcatcatctgccatatacctccataaaattggctcattattatactttcccatttgaagatatgtacctattgaaaaatcaattggttctgcgtttactgttattgtcataccagcatataaaactgttatagtcaaaataacagctaatattttttgaatttttaacatttgtttctcctccgtttctaattttaattatttcattgcattcctaagtactgcttaactctagtatccccgttttctccccatacattatataacaaccctctagttatatcatatattaatttaccataatcctttatattatatctattatcagcaaatgtactaataaattgatcatatgcaaattcgtcatgactatcactccaagttttactactatcgttataaacaccataaacagaaggatggttaataaaattatgaatattattattagttccatttaatgtttgagtcaaatatgcctgctcatttggaccacctgaatatataccgtacgacgtcatatcatcatagattaaactataatattttcccaatgttctcataaagttttgcgctttttgtttcgggtatacttttgcattgttgtcaaatccatgaacacggcctgtcacaagagatatatcatattccatttcaaacgaaattattgtgtttgtattctttattcctcctattacactatctccatctacgactgtgttgtttattgaactttttagtatattttcaaccttattttcatataacattttctcatctgccgccatatcatcattataatccgaaaaatacaatccaggttgaatcattactatatcaaatatatcgctgttatcagtgcattttcctgtattcgctatagttccgatgttctcccaatgttcagtatctacatcgcaataaggtatccatatcagttttttgtccttgccatgtatatatcttgatatctgctccatattcgcataacctgtatatgtgtttacgtttgattctaagcatataggatcttcacgcccgtaatataaacctgtaataatattttctccaaattcatttgctatactgttatagatattctgcgttgtatcaagatatagatttaaaaagtctgttctctgtgtggcatcatcaatttcgtatctccacatatgcggagttcccaaatatatttcaggcatttgtattttatctgctctgtttccatttactgcggttaatgcactctgcatattctgcaatatattcttatatttatttacaactatactcaaacgattgctcgtttctccgtacaaactgctgctatcccaaaattttgataggtttcctaaattattttgttctaccttaccattgttttgcatgtaaccgtcaaaatcaacatctctaactgatattacaaacgctacatttttgtttcctatcaactcaaaatacttttcaaaaaactcttgtgtatatacgtaattgctaccatcagaatttttatatctacttatattcgtatcagcatttacacttcctactccgtcagaatcataaagcataatatatacagtcttttcaccgtcctttacaactcttacatttttcaaaccttcatacagcgtaaataagcagctcattattgatttacacatctcggctcttgtgattgtatcttctggattaaagctatttccgtctcccaccattattttattgcagtataactgccttactgcctctaaataatactggtttattttccatttatcactcaatcccttattgctgttccaattactcatttggtcgcatgacatgttttcactatatgtatataacttgtttggtacttttgtatcttccactgctcccataaatactgactttattatatatgctgactcatctcttgggatttcactgtaaaaataactgtcgtcgattgctttccctgcatatatatcaatattttgcgtcatataccgtatatagtttctcgcccaatactctgcatttggatttgcattttctaattctacgtctgcgctttccagtaatattttaaataattccgctcttgtaaccgggtctattgcatttacttttccttggtcgtctcctcctattgctcctatatttgttgccttaaacaaataggggtagtaccatgtttctgttttttcttgcaaatcttcatacttctttaccttatatttttcatttgcattatatatatttggcactactccgtcaaactctgttctcactcctcttactatttctaaatcaggctccggcgttggtattacataccattcctgttattcaacaacatttgttttactccaacctgaatccaacttttgatatacttcaacatcattcttatcataaccatatggctttgtaaaccttatattatcatacagattttcgccttccgcaacatagtttactatatttgttttatttgctattgataacaaatacgaatatgtatcgataatattatatgttcctgatattgcagaactcgttccatttatacaataacttccctgactattttttgaggtgattatacttgctgtattatctttatacactactacagggaatctatactgcaggtttttatcaatgacttgctgaacatcatactttgataaatccgcattcttaatcgttatattactatcattcgtgtactgtcctaacatttcctgataatattcagctattgcgtttgattgcttcacttcatgagcatttccttgtgtcaagttatatacatcatccggttcagtgaataagttatagcttttagtatttcccttgattttactagcaatagccggcaaacatccataaatatttaagacagaagcaattgacgcaccaaattggttggcagtaacattagcaaaatcatgttttcctgctctgaagtcgctattatatatattaccgttcgaaaaagtgtatgtgatattatggtgatataactataacacaatttatgagttttccgtattctttttttctctttgtaacacatctattgtaatcctacattttactttaatttattctattttataatttgactttatctgccaatccgtatataatgttgagtaactctcagttaactatatatccgagattaaaccgattaacactcggtataatcaggactgaatcaataaaaacaaaaacagaaaggagatacccaccatgcacacacttaaaaaatttataaaatactatggtccatataaaaccgtgtttttcttagacctcatctgcgcaactgttatcagcgccgttgacctggcctttccgcaaatcctgcgcacattgactagaacattgttcacacgtgacaccgccactattgttaacgccctaattcctatagcgctggctctgctcacaatgtacataattcaaagcctttgcaaatactatgtcagctaccaaggccatatgatgggcgcaaatatggagcgtgatatgcgtcaacagctttttgaccattatgaaaaactttcattttcatattatgaccaaaacaactccggtcaaatgatgagcaaactcgtctctgacctttttgatattgccgagtttgcgcaccacggcccggaaaacctgtttatatcattaataaaaatagtaggttcttttacctttttgtttattataaactggaaacttgccattcctatggttgtgttggtttttctgatgtttcttttctctatgagccaaaataagcgaatgcaggcaacatttatggagaaccgccgtaaaataggcgacgtcaacgccagcctccaggataccttgtccggaatccgggttgttcaggcttttgccaacgaggaagttgaacgcaataaatttcaaaagagcaatcacgctttcttgatttccaaaaggaataactatagctgtatgggaaactttatgggctggaacctattttttcagggcatgatgtatcttgtcacacttgtattcggcggctatctaattgctcacggacaaatgcaggcaggagaccttgcaatgtatgcgttatatatcggaatatttatcagccctatacagatattggttgaactcaccgagatgatacagaaaggtctgtcgggattccgccgctttttgtcagttgttgaaaccgaacctgatataaaagacagccccggcgcgaaagtcctggaaaatgtgaatggtgatgtttcctttgaaaatgtgtcgtttcattacagcgatgatgacgcgcttgtattgtccaatctttcattcaaaatccccgccggacgttctatcgctcttgtcgggccgtcaggcagcggaaagaccactatctgctctctgcttccgagattctatgacgtaacggacggacgtattactattgacggtcacgatgtacgcggtctaactctaaaaagtctcagaagccaaataggcattgtgcagcaggatgtttatctgttttgcggaaccatccgggaaaacatctcctacggaaaacctgacgcaactgcagacgaaataatagaagccgcgaaaaaagctaatatacatgattttatagaagaacttccggacggctatgacacatttatcggtgaacgcggaaccagactttccggcggtcagaaacagcgtatatcaatagcgagagtatttttgaaaaatcctcccattctgatattagatgaagccaccagcgcccttgacaatgaaagcgaacgatatatccaagaaagtctcgaagaactcgccaaagaccgtacaactatcacaattgcccacaggctgtctacaatacggaacgctgatgaaatatatgttattgctgaaaaccggattgcagaacgaggcacatttaaggaactaatggatcaaaacggaatttatgctcactactatgaaatgcagtttcagtaatacaaccggagggttccgctattcaatacatacttacaaagcatatataaaattacacgttgcaacgagtatttctaatattggaaacaaaaaaattgtcataaataattgggggataaaactaaaggatagttttatattaatattgactgaaggatttggaaaagaactgtttgacaaattagtttctgtaaaaaaaccttatgtttcggagccggaagaaaatgtagtatttttctatgataaaaaattatttatacggttattaaatgataacatcaataacaaaactattgaccataatagtaaaataatgtttgtgattcatgattccacaggaaggtcttataccatcagaagtaaatataatgcaggtaaatacatacataataattataatttaactgtgaaattataatacctttaaacctctacaggtaaaattcaatacttttatttgaaaaaagctgtcccagtaattagatataataacttaaaatcctaataaaccaataaataaagttctatttataacttatagcattttttacctttcggattaactactaaaaagtgatatcatttagaatttaaaaaaacttataaaatataactacttgaaaattttatattaattttataactttaaatttttcctgatagaaaatcactgagtttcttaatcaaaccaataaaaacaagtaataatcttaaaaactattatggtaaagtaagccatagtagttttttattttgagaaaaaatatataatagtaagaatttttccaaagttaagtgtatatcaaattaaatcattttataaagatattacagttattttaatctctaaaacaaccgcataaaccgaaactgcatatattgttccagtataattgtatactaattaaacaagagcaaaaaaatttattttgtttcaaacataataataaacacaaaaaacttaaaatacagaaaattttatcgtcaagtttagacatcataataatatgtatttctgttgttaacgtaataattctttaacttaattcacagttcaataaaacgcagtcaaaataaatcggtaaaatttctaagacatttcattgaataaatcttcctgacaaatacaaaataaactttattaataagtttatttgcgtaaatttatgtaaccgataggtctaatgaatacatatggttacttctacaaacaaattcggcaaaataaaaactgacaccgttttttaaacgatatcagtagtatgtctgcttaaaacgtaatatttactgccgtatatatttttataataataatacaattaataaagttcatatttattaaggttcaattatctcggcactaatttttgtatcattctattttatgtagcaaccaaaagttctaaatcacggcctacagctatatctgcctttgatattccaaattttacagtttcatacgctagcttaggataattattttcttcacttaaatggcccaaaattattttttcggctcccattcttacaagaaactcagttgccttagccgcgtcatcattcgatagatgacccagcttacctaaaattctttgcttcagaggatatggataaggtcccacctcaagcatccctatatcatggttggattctaacaaaaccgttttacagccgccaatctcacgaaacacctcttcagtcagaaaccccatatcggtagccaccgccgcccggcaccttccgtcatcaaaacaataaccaaccgggtatgctgcgtcatgaggaatcggaaacggctttataccgatatctccaatagaaaatggctcaactccctcaaaaatctttattttatcatcattaagctttcctaaatcattagtcatgattgcggaccaagtcattgagttcgcatataccgggacgttataccgtctcatcataacgcctattcccttaatatggtcagcatgctcatgtgtgacaactatcccgtcaagatccccgggctcaaagccaatatcagccatagcggtttttacagcttttccgcttataccgcagtcaactaatattttggttttgtctgtatatacaagactggcattgcctttactcccgctttttaaagaatgtattttcataaaatcaccatatttagtcttctaaataaaaaggattggcgcggcgcaccgcaatcaatccccaatatctatcacaatttatacgtttacagcactcaaaactccgggcataggattaacatttcggcgtgttatctgcgccccaagcgctctcagcttttcttccaggttttcataacccctgtcaatatactgaaggttataaatctcagtaactccgtctgctatcaatgcggctattaccatagctgcgccggctctcaggtccgttgcgcacacaggcgcgcctgtcaaacggcttccgccctcaacaacggcaacatccttgccttcaacattcacattagcgcccattctattaagttcatcaatatatttaaagcgattatcccaaacgttttctttcattatgcttgttccttttgccacagtcagcaaggtaagcatctgaggctgcaagtcggtaggaaacccgggatatggctgtgtttttacattagcgcgctttagttccggcttgtctacataaatccttatcgcctcgtcatactcctctacgcccacgcccatttcttccagcttagcactgagagattccatatgcttaggaataatattggtaaccataacatccccgcgggttgcggcagcggcaatcataaaagttccggcctcaatctggtcaggtataacgctgaatgttccgccgtgaagttctttaacgcctctgattttaataacatcagttcctgcgcctttaatattcgcccccatagagttcaaaaagttagctacatcaaccacatgaggctctttagcggcactgtctataacagtaattccgtcagcaagtgcggctgccagcattatattgattgtggcgcctacagatacgacgtcaagatagactgtatcgccaacaagctcgtctgctgtaatattaaccatcccatactctatatcaacttttgctccaagcgcttcaaaccccttaatatgctggtcaatcgggcgaactccaaaatcacagcctcctggcaaagctacgctagcctttttaagcctgcccagcagagcacccataaggtacgacgacgcacgtatctttcttacgctgtcatatgacgcaacataatccgtcaaatcagaacagtcaacctcaaccgtatcctctccgacaaattcagccacaccgcccaatccgtttattatgtcaatcaaatcaagaatatcacttacatggggaacgttttctataacacactttccctttactaatatagacgcgacaagaatggcaacagcagagtttttagcaccgcttatcttaacttcgccatgcagtttaacaccgcctaaaattaccattttctcttcattattcattataaaatgcccccaaataaatagcattaattatgtaaaccgaagctgcaaatattcacgtttctatttataaaaaatttataaaccaacaaatattataacacaaataaattttttggcaagagcatatctatgtttttaaaagaatttgacaaaaagccctgtcaaacactataagatttatatcttttgcatagataaatccctcaatcgcattgatagcgctatatcttgtatctgtaaacagacactgatacaagacgcacaaaaaacgccggctctataccatcgtcacatatattgtaacacaaaaatattacgtattgattacgcttgctttaaaaatcaaataaacactaaaaatttgcagatgacacggtttgatatattttttcatgtttcaccaaattcatacatattaatataatgaagtgagagatattgttccggcacaatttctgatttatatttaggaggaattcatatggcaacaaaaatatttgtagacgccggacatggaggaacaaatcccggcgccgttggcaacggagtgattgaagcaaatgtcaatcttgctgttgcaaccgctttagctaacaatcttagaaacatgggatatgatgttagagaatacagaaccacaaatgatgaaaatgttataacacccatagctgctgatttaagaaaacgtgcacaaacagctaatgattggggcgctgattattttatcagcattcacaccaatagctcgctggatccggcagtaaacggctttgaaacctatgtatacaggcttggcactcgttccgcccagcttgcgcaatcgatacaagactcagttgttcagcggttaggagtaaaagataatggcgtaaggcaagccaacttctcagttctgcgaaacacaagaatgccggctgtgctggtagaactcggatacctttcaaatccgactgaagcactgaatcttaacagccctctctggcaaaataaaatggcttccgccattgccgacggaataaataattatataaaacgatagacataaaatctaaagctaaaagccgttccaaataatttggaacggctttaataatcagcactttattttctaaagtattttattcagctttttgctgtcctataaaattcgctaatctttggaataccaatgacgcctcggctctgttagctgccgtttgcggattgaagttattgttatcgtctccgctcattataccgattatcttattatatgttactgcttcgaatgcgtaatcggaaatactgcttacatcattgtaatctaagttaatcatccatgatcctacaggacccataccctttgaaacaacataacggtaaatcattgccgccatttgttcacgagttataatttggtcgggagcaaactctgtgtctgtataaccatttactactccgttcgcagacgcccagccaatagcttctctatagtaagatccttccggaacatctgtaaatccaaagtttgtcatatcagtcttaggctgattttccattctgtggagcactgttacaaacattcctctagttatgttttcatacggaccgaatgtatctgtttcgataccattcatcaaaccgttttcatttacatacttaactccgtcatagaaccaatcagatgtgttaacatcattaaatgggttagtccatgaagacgggttctttgtcggctccggtgaagctgaaacattaggatttgcagtctcagccggcttaggtgttgaagttcctccggtactgtgtccgctgtttccactatttccgctgtttttataaccggttttatcgaatgtatatgaaacagtcatagtttttccgtccggactaatctcattaacttctgcttcattaccgttaactaatgcttttgcattgtcagcaaaactatatccgtcttttgccgccaatgttactgttgctgtatatactgtaccataatcaaactttccgccttgttctacattaggactccaagtaataatacctgaataatagtatgaaccttcttctacagcagctgcaaacgttgccgcagcatttgatttcggcgccgtaattttaatctcagcactgttcataacgaatgttacattttgatcagcatatttgttgccataaatcactcttacataggtatcgccgacataagcgtccgcacttggaagagaaacatctaatcctggcttaaatgtaaacccgctctttgtagattcatcataagctacatcttgtgatgttccgtctttataatgaaccgtaataactaaacctgccggattgaatgttgaaccttctgtatatgaaaccgtatcaggagcatttttaatttcaatataatcaatgctgctttcctcagtagccacaactacagcttctgttttatcatcattaacctttaatgaattatcactttgagctacgtcaacttctttaccgcttacggctttagccacgatttcataattaccctttggagctgaacccacaaatgtaatttcacctgcttctgaaacttccatatccaatacaattgtttcaccggtagccttatttaccaataaaacttcagaaatctcttctgacgcacttatctgaacctgatactcaggcataggtgttgcagttggtgcgtttggttttactgtcgctgttggatacggggtcggtactacaacaggtgctgatgttggttttgctgtcgctgttgcctcaggtgtcgctgacggctctgttgttgccgttgcctcaggtgttgctgatggctctgttgttgctgttgcctcaggtgtcgctgatggctctgttgttgctgttgcctcaggtgtcgctgatggctctgttgttgctgttgcttccggtgtcgctgatacttccggtgttgctgatacttccggtgtcgctgatacttccggtgtcgctgatacttccggtgttgctgacacttccggtgttgctgacacttccggtgtcgctgacggttctgttgttgctgttgcctcaggtgttgctgacggctctgttgttgctgttgcctcaggtgttgctgacggctctgttgttgccgttgcctcaggtgttgccgacggttctgttgttgctgttgcctcaggtgttgctgacggctctgttgttgccgttgcttcaggtgttgctgacggctctgttgttgctgttgcctcaggtgttgctgacggctctgttgttgctgttgcctcaggtgttgctgaaggctctgttgttgccgttgcctcaggtgttgctgacggctctgttgttgccgttgcctcaggtgtcgctgatggctctgttgttgccgttgcttcgggtgttgctgacggctctgttgttgctgttgcttcaggagactgagtcggcaaaacatcatttgtaattgatactgttggtagtttttcagcgtcagttacgaaatcagttccattccatacaacaatctgctgcactccgtctccgtcttctgccacctttttattactctcgtcgccataatataagtttttaaagttcagcacatatcctgtaacatcctgttcaggattaccatttttatacacggtctgtaaagttgcatatccttcccatccttctgttgggtcagttgccttataccactcattttctatgttaaaaattgcatttactttatcaaccaaaccgttgctaagccttaaagcgctagctgatatttcgtatatattatcctttatagtaatcgtagcattctcttcaacattatatatactgattccattatgagttatctttccaaaatgattcccggatatttctgttccatccgctactttaacaccatttttatttacttcactgcctacatcaaactctacagcattatagtaaacaccatcattttcagttccaaatgtgttgttctttactatagtctttccataatttttaagattcaatggtgtttttactccagcggcagttgcttcaaatttacaatcagtaattgtaaatgctccgtttccgctcactgtaagcgctccaccgtctccgaaattaaaccctgatactgttatatcattagcaaggactgcgttctctgcagttgttattacaactgagcctgaagcaggagttattgtctcgtttacctttgcatcttctatagctgctttaagggatgtataatatacatcttttccatttctgtttatcttagcaacattgtctaccgcagtttctccaacatgataagttgttccgttaacaacaatttccttagcttcagttcctaaaactgctgccaaagcctttgttgtttccacaaccaaagcgtcgtcatattttacgccgccgatagtttgtgctaaaggaagatactcaattccgttgtaagtaatataattgccgtctccaaaatattgagcttcattattcgggtcaaacttttcaaaagtatcattaaccgaagaagtattatcaaaaacaacagctgtagcagttgaagaaatagtaacaccaactatagcgttataataataaagcgctttaaatgtattattatttgacgcacagtctgtaaatgtaagacctccattagaaccattttttagtcctaaaaaggctgcgacctttgtgcatccggaaataacagagttctgaacaattacattattaaatttgctgtctcctctggcttcgccgatcacaacggcagcgccgctgctgtaatcctgaacaacagtatttcctttatcttctacattacaattatcaaacactatattgcttatttcaacatcaccattcatgtgtccaataaaccctgtgtaataattataatttgccgcatttgatgccggggcaactgtgtcaataatattaagaccggttattgttgaagattctgaaccctttatcacaaaagttccgctccaagcagtacaatttgagccgccggtatgaggacctgctcctgaacacgcggaaatgggaacccaataatgagctgacatatcatatgtagagcctgttaagtttatagttttcccgccaaagcttacattttgattatttatcaaataagcaagacctgcaagatcggcagaatcagttaaatcatatgatccgctattttcgtttcctgtataccagcttatatcataattatctacgtcagtccaatatccatttgatgtaacatttgaagactgaacgttgttataatcatatgacttctcctcgtctgcaaaaacaggcaaagatacaaacatagaagccatcatagcgactgttataatccaagccaaagtagaacgaactgctctcttttttactttcattaatttacacatccctctaaaaaatttatattattttattttttgcaattattatttaaaactatagaataaaaatatttctatagtttccgcttctttttacgaaacgcttttcttgttcgcgctgcgcaaaactgtgtattaatccatattttgcacactgaattcgaattattcaaaacattagaatttttaaaccaaaaagcgtgtataatagggtaagaaaaaagcggccaaataccgcccagatactcgcgtaggaggcagctgactgacatattgaaacttccataaaagcatattgcttataatggtcaacttagtctctaaagctttgcgacctattttttcaaatagtttgccaatatttaattcttttgttaatatccaaagtaacagtatctcttggatttgtgtatacattatacaacgaaacgtcgaaaaagtcaatattctatctctagaataatatataaaaaaaatactagtgatttagtaaatttacacaatacacctgttcataaattggcacaaagttccaatcgttttgtggttttttatgcaaattttattccattaattattatttgattacatttgttacaaaacatttaatgatatacggctaatacacccatgtcttaaaaactcaataaaataatcatcttgattattaatattaaataatatataattaaaatatatttactttggctttctgtgaggtgttaaggatgatgaaaaagaataaaaacagagttttaagcgtagttttcaggagcgcagtaattatcttatgcgctctctccataatgtatgcttttattcttacttcgtgcacacagccagcccgctcctcaaacagcgacagtaaagctttgactgttaaagataattctataataaggattgcttttaccgccggatatgaaccatttgaatatatagacgattcagggaattatttaggatttgatatggcactaggatacaaactttcagaatcaatgaacagaataccggtttttcagaatatgaaatcaaattctctgcttgattctcttaactgcggaatatctgatatggtaatttcagctgttgaagtaactgatgaaagacaccaaaaagtcgatttttctgattcttatattactctcagttcatcaattataacgtataaagacaatactgatgtgaccaacataaacagtcttaaaaatgcacaaaatgtggctgttgcttccggcagcgattcaggttattatttaactaataatcttggtctggcaaatattaaagaatataggaacgaggccgaggcagaactggcagttttaaacggcgccgccgatgtattatttactgacagcaaaattgccgagacttttgtaaatcaaaatagaaagtttactataaaagagacaaatattaatcagcgtaaattttgtatagcggtttcaaaaggaaattctgatttgctgagactgataaatgagaaacttaacgaatttaaaaaagatgacactctatacaacctgagatcagcctatattagcggaaacgcagaacttagaacaacatttgacgatgaacttataaatattcagcaagacaggacagttcctaataccaaaacttcaactgattatgcagagtaaaattccaaaaatttaaaataaaacaaagagacaggggtaaaacagaattaattaaaaatagatggaaaaaaccttctatgacagaatgcaatgaaactgtcataggaggtttttgtatgcagaaaattacaaacatattgaatattgccaaaatttattattttctaatatcaagtaaaagtcgggcgcaagataaataacaacttttactaagttaaattttatgatcttttatttaaatgatataaaattacttttatttcacaaaaacgcctaattgcgttttatatcttatttatatcagcttatctgcgccgcctaaattatacacattttcaaatcccatagctcttgccttttctacagccaattctgctttaaacccatttaggcaataaaatataattatcgtatttcttccatacgtcaacaaactctctatactgtctaatggaatattaaccgctccttggatatgggattccttatattcatactcttcacgaacgtccgccaaaactgctccgtttgaccgcagcaccattgcctcgtccggttcaactctatcagatcccagcgataccatttttattgtcttactttctgtatcgccggttatattcattactccgccgtctatttttatatctttaatatcaaaaccgcaaacttttttcaactgataacatttttgacacaacggcaatattaacattattccattgtcgcagccggcatataagcggcctttatactcatcaatactatttattttcagcgggttttgaatttcttcaacatcacttttcgcaaaataatccagctttacttccgaccaaacggaacctgagccgcttgaagacaatttggtttttcccgtgacgctttctttttccaattttgcaaaaccgtttccccactttgcactctgaattgtctcaaaagttttactttcatcaattccgtttatatattctacaaaaacagcataaatatttttatttccgccgttgccatatacgtatacaggctgagttatatccgatatttttgccgttacatcagatttacattcaggatatgattttccgccagccaatattgttcctccttggacaatataaatttccctgtctcttcccccattgccgtcaaacagaaccgtaatatagcattcagcttttggtctgtataacaagcagctttcggtttcgcttccgtcgcctatctgccaggcagttgaaaagacgtattctttgtcgccatatacatatttaaacttctttttttctcttcttaaaactgtgccatatcctgtaatgcaatcaatctcaggaagtttatccattcgtgtattgcagaacaataccgtatacgccctgttatcaccgctgtatacctttactttcctttctgccggttttctgtaagtatggttaaatatatcagacgcttctgtatccatattgtatacgcaaaaactcacagaatccccgtatttacaatttgtggagatatcatacctgccccctgctgtcacctcaatagatttaatttcctttgagacttcctcaccggtatacacttttaaaacgcccgaagtgaaaccgctgcccaaacactttatatcaaccgacatcaaaccgttctcccggtcatgaacatcagcaatactatatggaagacctccgtcatattcctcataatccagcttaaaaaagtctatattggcagaattagcttggagaaatatcgatgaaagtccgttcccatctacagaggcattatacaacactgaactgttaactttaaatacagcttccttccaaatctcacttccgcctgtttcttttaaaatattctctgctaaaatacagttgggagccgcacttctattaacgctgaattttatattgacgcttccggatttaagcgcatacctcacagtaattttccttagattttgaagccttattcccttatactccagccagttcacgcttgtattgccggtactgttggccctttgagctgagccgctggctccgcttctgttgtcgccgaaattattttcttcactgtcactgtcctcagcctcaatctgagtattaatatatataagcgtttctccgccgactaaacttgatatatctataacccgcactctcacaagacctccggtcattaccgtgagttctcctgtatttctgttgatttctgcagaatcacgctttgaactgtccagtttttctatctgccaaattaaatttttgctatcaattctattatcgccgtcataagcctcaagttcaataccatgataaggattttcagtatttactgtacccgaaactccgtctttgcttgttatatatgggggtattccgcccatgcggtaatctattactccatcaaccaaataattgggatttttagaagctatcgtataccgattttcaatattattcatttccaccgaacgcagtttcttaatcgattcagccaatatcttggtcatatccgtatacttgaccgctgattctatctctttgacagcggaatcatatatcgcttctaacttattccaattattatccgaaaacgctcctttaggataaaaattcttttcgtatgtcaattcttgtaccgctttatttttatcactagttccggccttatattcaagtatatttactattgggaacccaaccgatttggtctcattattcacagtaacttcggccgttatcattgtgactcctgaaaccggaccggatttaacaacgcctctatcatccactgcagcgaccgtctcattaccacttttataagaaactttcacctttgatatatccaaaattttctcgtctgtcataacaacagacagattagctgttacagagcttatttgctcaagttctccgccttgtccgtttattaatccgcgcaccgctataccgctgggcagaacagatacggttttcaacttgctttcaagctctccggaaacactgaactcgtctgctaaagattcatcagcagaatttctgccaatatacaccttatattttccctctaagacataggctttttgttccttctcactgaaaaacgacatttcagaaatatcaagctcaaacgaaacactcttaatctctccgggcagcagttctattctttcaaatccctttaattgttttttaggcttattctctccgtcagcccccggaacagaaacgtaaagctgaactatttcagccccgtatactgtaccaacattctctatatcggccgaaatttttattttttcattagcacttatatatctttcagataattttatgtttgaatatctaaaatccgtgtaactcaaaccgaacccaaacggataaaccggcgtaccgctgtaatattgatatgtacgccccggaaatcccgaacggctttgtatgttataatcattaaaatatcttgttataccgtcttctccctttaccccttctgtttcaatcggcataagttccaaatcttcagatttataccaagtggcagtaagcttacctgacggattaacctgccctgataatatttttcctagagcggttccctgagtttgaccgttgtatgaagtccagattattgcacgggcgtccttttcaaacggttcaacatttacttgcccgactgtttgcattgcgactatagttttttccggatacgctgatgttaaagcctgaacatgcgactggctcaaaggcaagtctatgctttttcggtcatacgattctgccgaatctgaaagattagtccctgcataagcgattataacatccgccgagtccagcttctccttatatttggttaccgagaattcctcctggtttgcctcaaaagataaatataaatcttccgttccgcaataccctccggacgttccggtatattcgcctatacagtctttaaacgaatttaagctgttagttttaacgctgacaacttcggccacctgcggtcctccatcgccataacataattttacctttcctcccgctaagtccccggttgatacctccgccttaacttttaaaacatcactgaaatctatatttttaaatacggcggtaccctttctagtaatatcttcaatcaaacttccattaagcgtaataccgcctgaaaccagggcagcagataaatctatctttcgttcttcgccgcttttaagtataaacgacaaccctcttatattcattaatttggtttcgtctgtagctccgccaagataatctacattaacatcaggcattaccctccttaattctgttacaataccattataaggagtgactgtttgttccggagaccctgaataatcacctaaaacaacttcgtcagccaaattccccaccagcgcagcatttttaattccattactcaaaggcaaaatattattatcattcttcaaaagcacccaggactgctccgccgcttcttccgcaacagccacatgttccgccgtttctaaaacgtccggtttgatttcgaaatattttactccggaatcaaactctcctgtccgcattctctgaaggaacaatctgtaaatatttatatccaactcgtcttcagtaatatatccattttttacagcgtccaaaacatttttttgaacgccggcattgccgcagtctgtatccgcgccgttcaaaaaccccttagttattgttgcatactgaggaacgttatttatatcttcatcagtaaacagagcttttttatacgccgccgtattgttcaagtctccaaaggctccgcagtcccctgtgacataaccgttaaacccccaatttttccttaataaatcaagtaatatgtacggatttgcagtagacggaatataatcaaaaatcttttctccgttcctgtatactgtagttgcattatatgaactcatgactgaagccggagcggctttttcaacaatatcctgaaaggctctgccgtaatattccctaagtgttttttcatccataaccgacgagcccactcgacgctccttttcacagttatttgcaataaagtgttttatagtggctatcgttttaagatatcttgtatcgtctccctgcattccattaacaaattctataccatactgagccgtcaaatatgggtcttcgccatacgtctcttcatttcttccccaacgcgggtctcttgccatattaatggttgggctccagtaagacaaatttgtctttggatttttgcctcttgcctccgttgccgttatatctgcagctttataaattaacttgcggttccaggtattagacatcgccaaacttgttggaaaactagtggcctttccctgtctcgcaactccgtgcagcccctcgcgccaatagttatattcgctgactccaagacgcggtataggttctgacatatttgatacttgcgcagctttttcttccaaagtcatcctagctactaaatccgctgcacgctcctcaaaagacaaacgtgaatcctgatacggaagtttatttttactccctgaaatatcaatttcattttcattcaaacttgaattagtttctgcactgtcatttaactttttttccattcttaacatatatctcttcctccgattttactcaaatatatctttatccgccgatagtatccgcaattccgtaaaagtaaccataaaatgtcacataacaaaactataacctatttataacttttgtcaagaataatttaacaataatacattctgttaaaattattaattaaactctacaaatattaaactgctgtatcactcaatatttaatgtaaatttcatgaaacttcagctgcttaaattattagttatttgataagcttgtttaaatttttatcaactcaaatttattaacatatctttttgcatgagacaatttatcgaccaagattttaactgtaaaaattatttaaaactctctgttaaatatagataaatattcggattgattctattttacttttttatcctgctaaaggacatgaaagattttctataaacaaattttgtattttacttgtattctaacataatataagatataataaaagccagtaaagataaaaaagtggtcaaaaaatgctgcttattatttggatatggaggaactgatatggtaccgttttatgaaatacagccttctgacttaacagtaattcataattaccgtgaaatccgttttcatgctcatctgcatgagtacattgaaattgcatatgtttttaaagaaggtcaacatatagatattgacggtatagaatatgaaatcaaatccggacaggccgctgttgtatttcccgatattgtgcattactattatcggaatgaagtcagacctgctgacgaggtgttggttatatgcagtcccaagctgtttaacggcatgttcccggatatgagttccgtacgccctaaaaatccgattattactgatgttgatgaaacaacaaaactggcgtttcagcagattgccgactgcacctccttccccgaaaagttgggttggtcgctgattataatgtcaggtattatgaaaaaaataagtttggaacacggcaagcatatacccgttgagagtcttacccaaaaaataatacaatatatgactataaattttaaacaggatatttctatcgagacattggcagatgagttttccgtcagtaaatattacatctcacatatcttttcagaccgtataaaaattagttttagaaactatctggcgctgctcagaacagaatatgcagcaagtctcatgaggacaaccgacgacagcattacaaacatttgcggctgtgccggtttcgccagccagcgaacctttaacagagcctttaaacaaatttatggtgtgacgccacgcgaatataaaaataatatcagcgaactttacaaagaataaaaaatacggattttccatcggaaatccgtatttttgataatctttaaatcttatcaaattactgatacataatattcggcatcaccgtattgattttgtgtgccgccggcaattttatatctcccagtaaacttccgtaagtaacggagttctctccatacatatctttgatatattcaatagaacgctctaagctttcccgctttaattccttatttatatcttcaaacatatttaattgaacatcaactttttcagacacaaggtttatagcccgaactgttacagccctaacgctttgtttccattcataatgctgtttaaaaagctcaaaagccttttcagcaagtccaaacgcactatatgacggctttggcatcttcatttgaaattcctgataatgcaggtctttgtctttaatggcgaccgcaatcccttccggcatcagcccttgttttctcagacgtcttgatacctttctgctcaattcaaatattactttccatacctctgtttcatcattcaaatcctcaacgcaggttataccgtttccaaccgactttaccggcggtatatactcatacggagctatttgagtcccccctctgccattggcaaaattccatagtttaacaccgtttatccccagccaatttcttaaatggtcaggatttgcgttggctatatcacctatagtacttactccgtgatgaagtaatttatccgcagttgccctacccactcccaacatttctgatgcaggcagaggccatactttatccttatacccctctctcgttatgcaagtgacggcgtcaggctttttcatatcagagccaagttttgcaaaaatcttactgaatgaaactcctatagatactgtcagacccaaagtctcctttatctcttctttaattttacaagctatttcataaccgtttccaaacaacagcgtgctgccggttacatcaagccagcactcatcaagaccaaacggttcaataaggtccgtatacttataatatatttcatgcgctaatttagaatatttcatgtaaagttcaaaatgcggttcaacaaccactaaattcggacacttttgtttggctttccaaatttgttcccccgtgctgacgcccatagattttgccttttcattttttgccaacactatgccatgtctatcgctctgcctgccgcacacagctacatatttatttcgcagattcggatttagcatacactcaaccgaagcataaaaattattcatatcactatgcaatatgattttctcattagttctgtctattttcatacctgcacttttcattaccgcatatcctcccatctgtaaaaaaccaaatacgcaactaattttcacatatacattatatgcaattataatgcacttgtcaataacaatattgcaattatatttcataatatttaacatatttcttaattataaaataactactacaatcaaattaactcaaacgtttgataattttaaacataaaaaacccgtcaagacaatgttgtcttgacgggttttaattgggaagaaatctataaataattttaattatttatcagttataaaggtcttaataatttgtcagataatcaaatcatagataaaaataatatatctgtctgcaaaacagaataaataattattatgttttaaattaatttacaggtgctgaattgaagctgtatgccaaagttagagcggcttaggcaaaaacagcttcattcagaagggtataatttaatcaacacctgaccaaatatataagtaaaacagtcataactcttatcaatccagacaagatatactgtttatatcaacattaataaacctttcttattattacataacatattttatcaaatactctgattaaatgatagtcaaaacaagtaaacttttagtcaaaaagtgttaatttcaattctttggctgttaattcttacatattcaaaatataaaaatcatcgatattatactttactctaaataaataaaagatgtccatacttgaagtgaaccccaaagtatagacacttttatcgtatcagaatctttgttctcaaataaccaaaaactatcctgtaagattaaacattgctttttaccttaaattaatcaactatgaactgcacttttacataactaaccgattttaatcagtatataaaaaaataatattatctatttctaagaaaagatttataaaaaacgacaataaaaattacgtacaaatatcagtacaaatattatattcgaagttaaacaggatattatagataaataaaaatataaataaagcagttacaaaaagttgtttttaaattgtatatcactcttaaatttatatcctctgtgattcatactttcaattttaattccaaccaaattactgtccgtatcaagagcgttggcagtttgattaacatcataattgtatatattaacaagttccaaaatctcatcatccgaaattagtaaatcagcagcaaacatattagcctcatattcaggtcttgccgtcatatcatacagcataaactcctgaagcgttctgttttccgccaggtctctatgaagcatgtcatgccctaattcatgagccaaaacaatcctcttcttttctcttgacaaattattatttaaaattataacacgcttacgtaaaattattgtataaataccgcacaattttgaaaaatctgaacttgttcttaccataattcctaaatacttggcaatctcaaatgggtcagaactaccggaagaccgaatcagctttttagttttcaaatagatatcctcagctgtcaagctattcaacctcctgtcctactatatttataaaaattattttatgtattttttaggtgtatattttttattttcatctttaacggaaaaatatgcgtccgaaatagccttcatagcagcgtccatatcctccctcggcaaacttccgccggcaaacaatccgcatacgccttttattagcccctcaacatctctcatagaacctgtgccgccttttttataagcgtcaaaaataatctcctcgtcctctgtcaacagataattcacatccacattcaaaacctcggctaacctataatacaaatcacgctgtttgggatgcatacccgatttctcataattctgaacagtacgcagagatacgccaatagcagccgccaattcaccctgactcattttattttttttacgcaggttcctcaccttttcgccaaatttcatattaatacctcctgcttaatgcaaatataattctcatatcatacataaaacgaataatatcttcatacaaataatactattttacaacaattttgtcaagcattatcaatagaaataatataatcttctatttttattttaaaccactatatattattttttataatttgtcatattaaactgatatactattattagtactaaacaaaataattaatttatattttgttatatactttatttcactatcaaatttgtaatataaaaaatactatatataaactttaaattaagtttgattataatattattaattctatagaattaaaactttgattaattgatatattagactacttattttagccaaaatgctaaacaacaaatacaaacttttaatataaattaaatttttacttacacacttaattcaaaatctcccatataaaattgatatgtaaagcaatagtgctgtttctaataatatctattgttggtttccataatattttttctttaaaataacttatttttcagcttacagcataactaaacaaatccttcaaaagacataattaaacaacttctgtcttaagttctgtcaataatattttaatgttctgtgataaaacaatctaataaaatattattgtatttttacttttcataacatcactaataatatttataaataaattttatataatatatttcctcaataaaacaaaccgactaaaattgagtaattttttaaattatataattaactaattacagccgaaaatagtacaggctaagctcaacctaatttaagactttatttcgcttgattacttatattgagctaagaagaaaaaagccgttcctatatagatgaattcaaataaaagtaggttcaactataacataacgtaaggcgaaaacgatatatcttacgttaagataatatccccacctcaccactgaataaatggcttaggcagcagcagtaacatgctccttctgtaaaaaagataaccattccgccgaggagcaggaattattagaactgcgtaaaggtaaccgattattggagactaaataaaaatggtaataaaaaaacatctgaactttataagttcagatgtctaaatggtgatcccgaggggaattgaacccctgttaccgccgtgaaagggcggtgtcttaacctcttgaccacgggaccaaatggctcctccagttggactcgaaccaacgaccctgcggttaacagccgcatgctctaccagctgagctatagaggaatatttaaaatccgcaaaagggcagaaaaaatctgctcttttgcaaaattgttttggcagcgtcttatgttcccgggcagtcacccgccaagtattttcagcgctgagaagcttaacttctgtgttcggtatgggtacaggtgtgaccttctcgctattgccaccaaatgcgactacactttttttaaaagtgtatgtaataaaactaaccagttttatcaaaccttaaatgtcaataaatcacttagttgtgatgtatttgcgactactgtgactacactttttctaaaagtgtatctgatgaaactaacttgtttaatcatgccttcaatgtcattaaatcactcagttgttatatactgtggctacacttttatttaaaagtgtatgttatacaaactatctagtgtcatataatccacaaatgccaataattaacttagttgtgatgtatattattaaactaatatattatgtttttcaattgaaaagagaaagtaagaagctttcttactcacaacatagttcataaaactctcgccttatacttcctatgtcttttaggtcaagccctcgacctattagtatcggtcagcttaatgtgttaccacacttacacctccgacctatcaaccacatagtctacgtggggtcttacttcttttaaagaatgggaaatcttatcttaggggggacttcacgcttagatgccttcagcgtttattccttccgtacttagctacccagccgtgcctttggcaagacaactggtacaccagtggtacgtccatcccggtcctctcgtactaaggacagctcccttcaaatttcctgcgcccgcgacagatagggaccgaactgtctcgcgacgttctgaacccagctcgcgtaccgctttaatgggcgaacagcccaacccttggaaccgactccagctccaggatgcgatgagccgacatcgaggtgccaaacctccccgtcgatatggactcttgggggagatcagcctgttatccccagggtagcttttatccgttgagcgacggcaattccactctcttaccgccggatcactaactccaactttcgttactgctcgacctgttcgtctcgcagttaggcttgcttttgcgtttgcactcttcgtacgatttctgaccgtactgagctaacctttgaacgcctccgttactctttaggaggcgaccgccccagtcaaactgtccaccagacattgtcccccgaccggtttcacggccgcaggttagaattccagtatcacaagagtggtatcccaacattgactccacacaaactggcgtctgtgcttctcagtctcccacctatcctgtacatgcaataccaaaatccaatatcaagttacagtaaagctccatggggtctttccgtctagtcgcgggtaaccggcatcttcaccggtactacaatttcaccgggtgtgttgttgagacagtgcccaaatcgttacgccattcgtgcgggtcagaacttacctgacaaggaatttcgctaccttaggaccgttatagttacggccgccgtttaccggggcttcaattcagaccttcgcttgcgctaagtcctcctcttaaccttccggcaccgggcaggcgtcagcccctatacttcatctttcgatttagcagagacctgtgtttttgctaaacagtcgcttgggcctattctctgcggcctgcgctagcaggcaccccttttcccgaagttacggggtcaatttgccgagttccttaacaacacttctcccgctggtcttaggattctctcctcacccacctgtgtcggtttacggtacgggcacctcatcaatccacacagcttttctcgtcagtgtacaatcatccacttcgctacttaattttcgctccctttcgccgcactcgaccatcggtgcggttggattatgttcctgcgtccctgtgcttaacaatttcggtggctacggaatttctaccgtatgtgcatcgactacgcctttcggcctcgccttagctcccggcttaccttgagcggacgaaccttcctcaagaaaccttaggttttcgaccattatgattctcacataattctcgctactcattccggcattctctcttctatctcgtccacatgtccttccggtcatgcttctccctataatagaatgctcccctaccaacttgcataactattagatcacacattccttttttccttacttcaatttcccgtctgcttcacagccggttttctttctctttctcatatgtgttctaatagttatgcaaattcccaagcttcggtataggttttagccccgttaaattttcggcgcctattcactcgactagtgagctattacgcactctttaaatgtatggctgcttctaagccaacgtcctagttgtctctgcaactagacatccttttccacttaaacctattttgggaccttagctgtgggtctgggctgtttccctttcgaccacgaaacttatctcccgtagtctgactcccggacatcatttttgcggcattctgagtttgatagggttcagtaagctatacgccccctagcccattcagtgctttacctccgctaaactaatccgaggctagccctaaagctatttcggggagaaccagctatatccgagttcgattggaatttctccgctacccacagctcatccccgcatttttcaacatacgtgggttcggtcctccaccagattttactctagcttcaacctgtccatgggtaggtcactcggtttcgggtcgtatacatgcaactctttcgccctattcagactcggtctccctgcggcttcgaaccttaagctcttaaccttgctacatacatacactcgccggaccgttctacaaaaagtacgccgtcacactttaacgtgctccgactgcttgtaagcacacggtttcaggttctctttcactcccctcccggggttcttttcacctttccctcacggtactgcttctctatcggtcattaggtagtatttaggcttggatagtggtctaccctgcttcccaccgggtttctcgtgtccggcagtactctggatcctgctcgctcttcgtcaatttcgtttacggggctcttaccctctttggcttgacttcccagtcaattctactatcaactctgaatgcgtttcgcagtcctcaaccccgatagtattactaccatcggtttggcctctttccctttcgctcgccgctactcagaaaatctcttttgatttctcttcctccgcctacttagatgtttcagttcagcgggtctccccacatatacctatttattcagtatatgctgacaaagtattgctttgccgggtttccccattcggaaatctgcggatctatagtcatttgcaccttcccgcagcttatcgcagcttgtcacgtccttcttcggctcctaatgccaaggcattctccatgtgctcttcttcgcttgacctcgtcgtcgttcccttcgcttatcgactttatgaattctcataaagtctcatcgcttcgggactcctcctctcaaattaaaagtaaacttttaatttgctttttaaagcccttctgctctttttgctctgttcacaactcttgtagtgaaatatttctatttcacggtcgctatttagttctccttagcgattaatctttcgattaattttaatcatgtgagtaagttttgttaatactttcttagaatagtttttttacagctcctatctctagtcgccgtattcccagttacccttgtatgaatctcttcatacgcgcgttctttctgaaaaaacctgatcttgtatctattttcataaatactcatcatttttccgtaatatatgacctgtatcatatactacgtcaaagtatctttcataattatttctaatcattactccttactcttctctttattcaattttcaaacatcttctcaacctatccaggttcaaatcctgtcacctcgaccatttattaaaagccgtaaatgcacatatttagcgcatttacggcttttgtgttatatacagcacttttttaaatttagtataattaattaaaattcattataaatgtcagtcaaatgtcagtcagaaatataagcatattatttacattataaaaaaaggatagcttgtatactatcctttttcattttaaaattatttagttacaaataattattgtgttataattattgtgttatttcttagactttgtaactctgtcattaggcacataacctaacttttgaatatcagaaacaaacttatttatatctatctcgccatttattataaagttaatcaggctaatagaagatggaaacctcttaccgctttcaatatctgcatattgtcttaatgacatgcagcatttttcagccatctttccctgactaatattaaattcttttcttttaaaatacagaatattgctaaaacacatttttaaaatgtcaattggttccataattccacaccctttgataaaatatacaaatattttatcaatttatcttataaacatatatgtgatatgtctcacatttttgttttttaataaatattttgatgttgaattatgaaaattaaaagaaggtagacacaaaaaatgtctaccttctttctgtcaaagccctatcttttttgttacttactttcccgtttatttatttggccaaaaaactaaatatatttctctaactgattctagcaaaacgataagaatatgagataaaaaaaatatatttgtcgccaataaaattattattaaattatcacatactagatattgtaaaaatatttgtattattaaaaataaaaaataaaaaacttcaactactatattgtaagtaatatttatcatcaataaattgaatagagttatcttaatattatttcttttagatttgtttgtatcaacatgctcttttctaagttgaattatattattactgtctgatgtaactagaacagttataacagctatcgaaaatgataacaatatagcaattgaatttatttgaatgtctataaatgattgaaacaacttaggtaagtatattttatctctagacagaattacaatcaaagtaagcactaaagcaattaaccctgagattaacatacctacccatattttgtccatatatttgtaataatcgtacaccggtaatagtatagttttttttacaaatgctttaaacctcaacactttcacctcattccaattttaattgttctaataattgctgagccttttgaaagaagtcagcgctgtctacctcgttagtatcagatgtagtttcaacaataattttttcttttttcttaagttgttccgtatctaaaattgtatctccacctgattttacacataatctctttacttcattctcgttattatcaataagattataatatctctttatagcatctttagatatatatggactttttcgtccctttcgtttaaaaataatatcaacatattcagacatatcatctctatcagcaaattgtaaatacttatcatcaagagaatttctttcaacagttaactttaaaagagtaaacttttttgcaatattaagtttagctaaaaacccttcatccggaataaaatcactcgaaaaactatacctatactcatgattactaatatctgcaaaatttttcattttatgatataaataatttacaatttgacttattcctataccgttataatttttttcaaacatacataaaaatgtattacaccccttattatgtctaatacataaatgagtgcgttcttcatcaccatcaaattcacctttgagtattcctaaattatccatagttgaattatttcgaacatttcttctataattatacttaagtgacttaaagattatattataatttctgttatccaatgcctcaaaagagtccatccatagagtcttatttttatttggatattctattcttctttcgaccaatgtttggttagacaaattattcattgcatcaacaaaaaaaggtataaaatcctcaatagtaccttctggtaaatcaggcgaagtagccgtaatagttaaatttaagtaataaaaaccgacagagacatttttattcatacatatatcctccaaattaacaaaatattatttatctagataatacaatattttaaaataaatgtcaatatatgtaaaatatatcttaaactctataaaatatttattatagtacattatataaccaatcttgtgtcagtgcgtgccaaaaaaataaaggcgtaacaaatttatttgttctgcccttactattactccccatatatccccgcgcggtcgttaattattaacattctcatcaagtcataggtaagccccagcttgccttcctcatcgccttttaaaaatcccttgtcaaccaacttagttattgtcggtcttgcccactcaggcatattgtcatctatgtaatcataaattttagattttgcagtgttcctcaattcctcaagctctgttcccatttgattaattatgtcattctgacggtcgttttctgcctttaattcttcatattctctgctcattagttcgtcctcgctttccaatttatattctatccccaaatagtcgcatatacctttgtatatcgctgttgcgcacttatattttccgtcctcgctggctaaaaatctattgtcgtcatagttatctataaatgcagtctctaccaatatagcaggcatatttgtgtgttttataaccgcaaagttagcagatttaacacctctgttatacctttccgtctccgcggccatattcggctgtacacattccgctaacgccctgccctgcgtgctgcctgtgcaataatatgtctcacagccatacgcttttgtgtttgccgcattgcaatgtattgatacaaatacatctgcattccagctgttggcactgttatatctgtatgcaagactgccgtttaagctgcttgatactgtatcggtaatactatcacggctcatcttaacagtttgtccgctaaccaatagtaattctcttagtatcactccaatctgcacagatacatcttgttctttcaatccataccccacggctcctgtatccgctccgctgcagttatgtcccgggtctatgtatatctttgccattcttattcctccaatctattatattataacaaaaaaagaatgcccctagatgacattccgtaatgctattttaacttgattttttatgtatattcttgtataatactgtcaagcaggtaagaggaaattgaaggacggttgtcatctccatatgctgtttctcacagctgaaaggaggtgtcgcttatgtggaagtacttattaaaagtaattgtttcaatcataatattacgctacgcgtgagatgtctgctcacctaacgagacgcgcaagcgcgtccttccgatgttcactaaaaaactccgcatataagaaaatatttaaaagttatataaaatgcggtgtagtaagcatcaccgtgatgcaactgtgaccacatccttgcgatgtttactaaaaacctcatatataagaaaatattttaaataaaatttaatttttacactgtttccagacatattattttaattcaaatcaattaaactgtttgcaataaacgttaagtttgctattattttaaatgtataaaaagtttatataaattacttacggaaaaaatttttgaagtttattatcattgttaaataataattaaaatatattaaaaaggagattattaaaatgaaacttaaagataaaacagctattataacaggggcgtcaagaggtataggttttgccgttgcagaggctttcgtgagagagggagccaaagttgcggtgtgcggaagccgggtatcttctgcacaaaaagcagttgataaactaaaagaatcattcccggaagcggaactgattcctgtaggcgttgatatttccagcagtgattctatagctgaaatggttaaaaccgttttagcacagtgggacaaaatagatatattggtgaataacgcaggggtgacctcagcaaaacatatatttgaaatgtcagatgaagattttgattcggttataaggataaacctatcaggtccgttcaagtgcataagagaagttgccgctgttatgaaagagcacggcggcggcagtatcataaacaccagttctatggtcggcagttacggcggcaagatgcagacagcttactcatcctcaaaatttggcataaacggtctaaccaaatcatgcgccaaagaactcggtcagtataatatccgggttaacgcagtagcgcctggcgtggtattaaccgatatggtagcccattcggtaaacgaccaaatgatggaaggtatgcgccggattacacctctcggacgggcggcggaaccgaacgagcttgccggcgcctatgtatatcttgcctctgatgattcgacatttacaaccggaactatcatacatgttgacggaggactggttatgtaatttagtgtttgctgtttggataattaattatatacttctattgctcagacatttcagttaataatttcagtcaaacagctaggtcaaacagttctgtcaggaaccttatgcaaacatctttgtcggtcacctcggtcaggaacctcatgcaaacatctctgtcagtcaccttggtcaggcgcctcgctcaagcttctcggtcagacgcctctgtcggacgtctcattcggacattactgtcagccagacttgcaagtttttatcgattttaatttttatataaaataaaagccggacatattgtccggcttatttttattttatcttattgtcaggcagtatcggttttactcctcctttgacagttggttttcccctgtcaaggcaaaaactgaactctgcatactcgccttcaacactctttacctttatatccttgccgtgggcgccgagcatactctttacaatataaagacctatgccggtgccctctttgtttatacttctggacttatccaccttgtataatctttcaaatataattttttgctgttcttctggtattcccacaccggtattatgaactgatataaacacttcgctgcctttaggacatgtggttattgttattgttccacggtcataagtgaactttattgcgttatctataagatttgttataaccatttttatcttatcagcgtcggctcggacataacaaacatcattatcaaaaaccaaatcaatatttaagtttttcttatctattttaggaccgagaccgattataataaggcggataacctcatttatatcaaaatctgattttacgatattcaccttatccgactgcattcttgttatatccaagaaagtattaaccagtctggacagcctcgtcacctcatctttgacaatgctcaaatactccttctgcttctcaggcggtatagtatcgtctaaaataccgtcaataaatccgcctatggttgtcataggggttctgagttcatgagaaacatcggaaataaaactcattcttatatcctcagacttttcaagttcgtcagccatgttattgaacgcgtcagcaagttctgttatctccgtcacgttctcgtccaccctgtctatagcaactcgtgatgttaaatcaccgccggcaaagtcgctggcgctcttactgactctttttattgggttagccaaaatcctggaaagcatataagaaagaataaacgaaaccactataaccacaatagccgaaaataaaaggattttaaacagctcaaaaagcatgctcctcctttgcggtatcggcgtgcttaccagcacagcgccataaaccgctttgttttctcctcttataacaggaacttccagggtgaacatcgtttcattgaaagcgccgttcatggttcctacaacggttacacgcttgccggacaatacctcacgcagatgatctagctctaatgattctcttgactcgttcgcccagtaaccgctttcagtagtgttaactatcaccctgccgtcaacgtccgtgattataatatgactgctgctgctcctggaaaaaccatttaaaaccgagttcagattctcctgcgatatgccgttgtttattaaactcactatcgattcagcatttttggcgagtgtgctctcgttttgttttgaaatatagttgctcatcagaaccatttgaagcgacgccaaaatgattattccgataagaaccgtagataaatttgtgaacaatactcttgaaaatatagttttgccaaacaattagctcacctcaaatttatatcctactccccaaaccgttttcagcgcccaggttctgttttcaccctcaagtttctccctgatacgctttatatgaacatcaactgttctggaatccccaaagaactcatagccccatatctcgtcgaggagctggtcccttgtgaataccttattggtatttttagcgagaaaatataaaagttcaaactccttaggcggcatctcaacctttttgtcgtcgatataaacttcataagtagactggtttattttcaaaccgtcaaaactcagctcgtcctcgtccgctttctcatcaactgagtctgcgcttcttctgagaaccgctcttattctggctataagctccttcggctcaaaaggcttgaccacataatcatccgcgccaagttcgagacccaagaccttatcaaaagtctcgcctttggcagtaagcataattatcggaaccttactctgcgctctgatttcacggcatacctgccagccatcctttattggcagcataatatcgagaagaattaaatccggtttctccttattaaatttcgccacggcttcttgtccgtcattggctataatggcgtcaaagccttccttttcgatatatagacgcacaagctcacatatgttttcctcatcgtctactattaaaattttgggtttactttccataacaaacacctccgcatttaattctaatcaaattttaagtatctataaaatttatagtataaatacttttactttatttcaatattatagcacaagttttcataaatgtctaaataatttatgaacaatataaaaatattttataaaagtttggcgtttcgggaaaactagattaaacaactatgtaaggaggaaaatataaatatgagccacgcaaaaacagcagccgtaaccgcaaacggaatggtaaaagcaaacagctcggttaaagtcaagcccgacaaaaaaattttaaaacatgagcaggcggcgtattcaagacttagggctgaagctctcgacgctttggacgattttagacgctgtcagaacaactttgattttatttgtgaagacaaactaatagacgtatgtatatatgatatccaaaaaacaatgagccgatacgaatatttggttagtgaactaaaaagaataaacggcggcagccgctagaattatttattgatttataattagaattatttgttaatttacaatactgtatttgattttctcctaattaaaatttaaagcgtccggattataaacttcggacgctttgtatttttaatatcagtctgtctccgggctttgcccttgacataacaaacggctagcggtataattatttagtatcgctttggttatcccagggcggcaattaaaaataaaatgttgtttaaacgataaatatatgaggtgataaaatgaaatatgttgttgttttggcagacggagcggctgacacacctgttaaggagcttaacggacagacgccgcttgaaactgcaaataaacctactatcgatagccttgcaaggcacagcgaagtcggtatggttaaaacggtcccgagtaatcttcctcccggaagcgatgttgcgaatctagcagtatttggatacgaccctcaaaaatactatacagggcgttctccgctggaggctgtatctatgaacgttccgcttgaactcactgataccacattcagaaccaatcttgttacattatcggacgcggagaattacgaagataaagtaatggttgactacagctcagacgaaatttctactgatgaagcccgagagcttataaaatacgtcaatgaaaaacttggctgtgacgaatacgagtttttcggcggattcagttacaggcacctgatggtttggcacaataaagagaataatttcagccttaccccaccgcatgacatatccgaccgggtaatcggtgaatatctgccaaaggatgagaccatacttaatttaatgaaaaaaagttatgatattttaaaagaccaccctattaataaagaaagagaagcaagaggattgcaccctgcaaactccatttggatatggggaaacggaaccaagccaaaccttgacacatacaaggaaagatttggaataaaaggcgcggtagtctcggcggttgaccttattaagggtataggttactgtgccggacttgacgttttagaggttgaaggcgcaacaggaaatgtaaacacaaactttgacggcaaagcagaagccgcaattaacgcccttaaaggcgataatgatttcgtgtatattcatcttgaagctcctgatgaagccggacaccgtcatgagatagaaaacaaggttaaagctattgaacttattgaccaaaagatagtcgcgcctgttttggattatttggttaacagcggcgaagatttttctatccttgttatgcctgaccaccctacgcctcttgccaccagaacgcattcttcagagcctattccttatcttttgtattccagcaaaaataagattatcgacagcggatgttcaagatatactgaagaagaagccaaaaagaccggtatatttaatgaaaacgggtacacacttataaataaactgtttgaaaaataaaacttgcatttattgacactttctgttattatatctttgtgtgcttactcagcaacagttttactaaataagagcaaagagccggatttttattctccatctctcagcccttaattattcaaggagtgattattatgccaacaaaagtcgtgattggtgcccaatggggagacgaaggcaagggaaagacaattgatatactggccggaaaggctgacgtcgttgtcagaacttcaggcggcaacaatgcgggtcatacgttaaaggttgacgatgttacatataagcttcatgttatgccgtcaggaatactttatccggatactcttaatattatcggatgcggcgtcgttgttgaccctaaggttttgcttgaggagattgacgggtttgagtctaaaggaatcagcaccaaaaacctaatgatagattccagggctcatgttatcatgccgtatcatattgaacttgacggtttgtcagagattgcccgcggtaaaggcgatattggcaccaccaaaaagggtatcggaccatgttatatggataaagccgaaagatgcggtatccgtatgagcgaccttattgacaaagaaaaattcagtgaaaaggttagagaaaatctggctataaaaaacaagatgatagagctcgtttatgggggaacacctcttgacgcagacgctattataaacgaatataacgagtatgctgacaggctccgcggttatgtatgcgatactataccaatactttatgaagctgttgaaagcgacaaagaagtattgtttgaaggcgctcagggtatacttcttgacattgatatcggaacatatccctatgtcacttcatcacatccgatttccggcggcgtatgcgtcggcagcggtatcggcccgaaagctatagacgagtgtatcggaatactaaaaggctacacaacaagggtaggaaacggaccgtttccgacagagcttgacgatgcggtaggcgaagctataagacaaaagggatttgagtttggaacaacaaccggacgtccgcgccgcacaggatggtttgacgctgttatagccaggtatgcggttcgcacaagctcgctgacctcaattgtatttaataaaattgaccctctcggcggtcttgacaaaatcaaactttgtgttgcgtatgacaaaaacggtgaaataaccaaagacttccctccaactcttgaagagcttgcagagtgcaagcctgtatatgaggaaatggatggctggaaagaggacatcagcaatattaaagagtttgacaaattgcctgaagccgcaaagaagtatattcttagagttgaagaattaataggctgtaagattacttctatcggtgtaggccccggaagagatcaaaatatagaaaggtaggttatgttaatggcagctgctaccaataaagaaaatgaagagaaaaagacggatgtaaagcctaaaaagaaaacaacaaaaaagaaggttcaggaaaccggcaacgaatatcttgattacaaaggcaagaaacttgtcagagtaggcaacgagatatactacggcaatcctgatgaaccatatatagttaccttccgtcttgaagacagcgaggacttgatggacttatcaatatccaaaagggttataatagagcttaagaccaacgagggaaaagcttcaaagctgattcgccaggcagagcgcgacggattatataaagcttttgatattggaatgttttggcttgaccaggctttagaatcaaataaataactataaaaaaactgatgaagcgtttaactgcttcatcagtttttattttgtacattagttttctcagtttcaacgagccggctatggaaaggttaaaacggacagaaaaattaaaattatgtataataaaaataaataaaaattatatacaaatgtggtcacaaccctgacggtattcattataaacatcgtatattaaataattatttaaaaatgtgatttgcaagcttctttagacgcgcagtctcggaatagattttataaaaggattatgtcaaatgttataagtatgttcgcgcttcgcgtgagatggttgctcacctaacgcggtgtgcttacgcacaccctaccgatgttcaccaaaaaatactgttttgaagatattaattcctaaaaatttcttataaaaaatgtgatttagcaagcttcggagggctgtgaccacacttttttaaagtgtgtgtgatacaaatcactttgtattaataaacctacaatgtcaacaatcaaacttagttgtgatgtgcaaacgtagtttgcctcgttaggcgcgcagtctcggaatagattttataaaaggattatgtcaaatgttattagtatattcacgcttcgtgtgagatggttgctcacctaacgcggtgtgcttacgcacaccctaccgatgttaaccaaaaaatactgttttgaagatattaattcatccctttcggaatgttgtccccctcctaaaggcaggttactcacgcgttactcacccgtccgccgctttccatccttatcttctccccgaagggatccgttaaaaatttctcgctcgacttgcatgtgttaggcacgccgccagcgttcgtcctgagccaggatcaaactctcgattattattgttatatatccaggctttcgccttccaatatactcgattgtttgttagctcttatcgaatactaacgttcgtcgcagcccgcttcgcttttcccataaatttgtaaacaaatttatgctcttcgctccgcagcagctcctcttaaatcaaaagcaagcttttgatttattcttaacccccgcagaactttgttccgcagctgcaacttgtaaagttcgctaaaacttttttggaattgacaaagtctccactcttgcgagtttcttaccttgtgcaattgtcgtaataagtacatctaaatgtatctttattaccgctttttcactatttatttttcaaacatctgctttctgtttctctcgaaacagcttgactataataacacatttaaattatcttgtcaagactttttttaactttttttgaaaaaatttttaaaacttaaaaattgcttcttcatcaagttatgtatgtttgttcttcaaaacatataggtcttttcgaacaacttgtttagtatagcagagacaaattattttgtcaagacttttttcttcttttttttatttattttttaaattagctgatttttcccgtttttacgttgtttattgtcctacttccgcttcccgcattatattatttattagtatatttctaaaatacttataataacttacgttatatttaatactatatctttacagttttccattctcattccgttaggtatttttcataattcaaactatgtataaataataaaaacaaaagatcagagaatgccttcaagcattatttatgctatgattgataaatcaaatttattactcactctattacactattgctcttttaattcagtatcactttttttaagaaaagtacaaaactgttttaagtaatactgaaagtactttctacttaaaaagcgataaataaaagaggggataattaccccctcttattaatatgctattgttttaattttggaactaaaatctcatctctttctatttttttactttatcttcaacaatacttccggttagcttgtcattttcttctaatactgcatagctgtctgattgactttcattttctgtttgtgttccttctccttcatatagtactttatcctcagcaacacttccagttaacttatcattctctcccaaaattgcatagatatctgctttttcactattcaaaacattatcctttccttcagaaattgataaaactctgtcttgaactatttgaccgagtaactcaccatgatttagtgtttccatacggttatccgctccggcggcaaaagctgatcccgctgcggctgtcactgccaatcctaaaactactgatagtacttgtttcttcataagcaattcaatcatttttcggatttgccgtatttttatctttggcttctactgataataaagtctgacctcatttattacttatcataccagacttatttttgtctctctttttagtccgggaattttaacaatgcatccggctttattcccaatgcatcagaaatacaaaatagcatttctaaagaaatcggcttaataatgcttgccgcttctataacgctgataaatgaccggctgatattcgccttttcagctaattccaactgcgtcatgccgagcctttttctgtaatgcgaaatatttaatccaagctctatataataatccatatgctcaaactttattggctttgatcttgacatatatatttacctcttgtgtagtttaataatattttatattattattacaaagcataaactttctattaaaaagctattgctttttaatagaaagcatgatattatttatatcagaaagtgttttatattacatttttattattgattttgttattatcaagtttgtttttccaatgttattctgttatagatataatgaaaaaagtccgaaagaacttttgtttttattttgtctataacaaagcctatatttaaggcttaatgtattaaaaattaaaaatatttaggaggagtcaattatgaagaaaaaaacattatcggttttatttgtatcaatttgtattatcttgtcaacatttatcactgcagccgcagctgaaaacccatacaattactcatcagagccgtcgagagccatttattatgtattgccgactatgaagggcaatgatgtcaaatgggttcagtcggcattaaacgcatttggtaattatggtctatcaattgacggaagtttcggtccggcttgcaaaaaggcaacaaaaaagtttcagtcttcaatgggtatttcccaagacgggtcattcggtccggcaacaaggagcacaatggttaattggcttaaacaaaatggttatgcttccggtaataatttaagctcggctgtttcacaaaaggctttttacagacagtcttccggcggatgctatacagcaagtgcggcaatgataatgactaatctcaacgcatggtggaatggaagcacagccacatattggaacgtatatacagccaatggaaatactgcatatttacaaggagaaactccaggaaaatttggctgcagccgctggaatatttccgcctctaaatcatctgtaatagatgctgtaaaaaaatatcctcagggagttatggtagcgtttaatcagccaaacaaaggatgggcacattgcatggtagctgtaggattaaattcaagcggagaaccactgttttttgatccggctatagacaatggtaataatggcggttacggatacaccttgcctgagacttctgccggaggttcatacggaggagcaggttggggaaacattattcaagtttctgttataacgaaataatttagaattaatactttcaataacattggaattacaaaatatatatacgctgtgctttttcaacaatattgccattaaccgacaacaaattaaatacagccgtattttttattaacctaaacctgcaataaagtaatattataaataattaaaaaatagttatatcaaaaagggagagaagatcatgaaaaataacagaaatcttgtggctttgttattgtcatttattctattatttagtttttctacagtaagcgcagaagggtttaacctgcttagtccaaatttttcatttaatgatgtaaccagtgaaaatcctaattatgattccattactgcgcttgaaagcatgcagttcgttattggaatagcagaggacatttatgcaccggatgatttaactacgcgctctgaatttttaaaaatgttactgtatgctacagaaaatcaagacagtaactgtactgctgaacctcaaataagcgacgtaacaaaagagcattgggcatatgactatataatgattggaagccagctcggcatatttagtttagatgaactgtatgataataatttttatcctgatgattacatagacagagaaacagcagcagtctggatagcaaatgccacaggttattatgttgatactgacgcagtctttgccgacgagaaggatattcttaatttaaatgatgttaaaagtattgttgccttaggatttttagatgttcagaacaaccagttcagacctaaagataactttatacgttctgaggcagcggttataataaaaaaagtatatgacaattacaccgaatcacagaaagaaagggatgaaaccgtaaatgtcgagtatcaagacaacgtaaaattaattactgttgacaaaggtaacaatatagagaatgacacggaaagtaaaacagacttttctaatatcaccgatgaaatgcgtagactgaacacaggagatataattttaatactaccgtgtgaaacccttgcagacggatatatcgcgttaataaaagatattgtaattaatagcacaaacgccacaataaccaaaggcgaattagactcaaatgatatcttcaaaactatagacatatataaaaaatattcagttcttgatgatacttccggtttcactttagccgacggcataacattcaacaaacctgaagaaataaaagttttagataacaacaacatcaatattggtgttctggctgattctaagccggttggtcttaacgttattggcttacaagtcggaaaatttaaattaaacggaaatattaatataaacgactttaatataacacctgatataaaaggttttaatgactataatataaacgctgatatttcaattaccgaagatttaactgccaaatataatatagaagaagatgcagatgtttatggagcaggcggatattggaagagttacaattcctacattaaccaaagctatagcaaagacgaatttagtaaagatttagaagaagcaaaaaaagatattgctgaaacaagtataattatacacggaactccatttattatatatgtaactatttcagtttgtgtatcagctgagggaaaaatctgctttgaagttaataatactactaaagtagattttgaaattgaaaatttgaacggaaatctttcttttaaaaggaatattaataataatcctaatatttcattggctgcaagcggaattgtaaagtcaggtttagaacttcagctcggtttaagcatatgccgtctaattggtattgagggtgttgttcaaggcggtattggagcaaaatctgagataaatacgaatgataacaacccaaatcacctatgttcactctgtttagacggcgatttatatacatatttacagcttggatatgatattgagcttgcttatttagacccaaagcctgtttatttaaaaccatggatgtcgaaatttgctgattactattattcatttgattacggagattttggctttaaaacttgtcctcatataaaacaaaataatcagcccgttatcggcgccgctaacgaaggttcggctcccggagttgtaacaacagacggcacatatatgtacttcccaatagatgggaatatatggagagaaaacattgacggaagcaatagaactccaatatttaatataaacccagaaactactccaatgaatatacattacagatacaaatataaggatttacagtataacgatggatacttatattgctatggaagccatgattcatatatttcagcagcaaaaacttacagattcaaactctctgatttactcagagaagaatctgaatataattcaaacaattttacgcgaagatatttcgatgattcaatgaaagcccaagaatccggacttacgcaaaaatacggcggcaaatcctggcacatagaaaaagaatatctgttcggcagacaaccgctgaatttatattgcgaaaatgaatcaggagataaacaattgattattaaagatatagaattatattgtgtatataacggtttcgtctattacatacaaaatgacgcattgtacagctataatctcgaaagcggagaaacgcagctgttgaacagcactccacttaactttgaaggaatattcagcaataatatcacttcaggttcctatcaattaaatacagtaggtgaatggatttatttatatagaaagccaaaaggtctaacaggcgatttaggcgaactttaccgtgcaaaaataggagaatatagtttcgaactgctgaaagaaagcgaagaggacaaaaataatttcacatctaactatacactaaatgacagcaatataaacgataataacactagtacaaataatgaatccagtaatagtttaaataacaacggcgtatcaaacgagaatacctttattaaaaataaccatggcgggtatcagctcgacttcaacaacgacggtattcccgaaaatatttacattgaagaaagcgatataaacagcggcacatacgctgtaactatttacaacagcgcaaaaggagagggtgaatttggcctatgcggtgattttgtgcagaccggaaaggcaagcgaatgctatatagtatatgattctaatacaaacttatattatattaaaacagtgacagctttttccgacgcgagagacataacaaaaatatatgcgttaaacggtgttgatttccaatgtattgacacttggggaatttttacaaacaaagatatacccggggactataggaccttatatcgcacaggttttgaagctgtggaattaggctatacctccaatggttcttatgaagcttctgaaagcgaatatgaagaatataaaaatcaatatagtctggatgaaatatactattttggaaacgatataaaataatattttataaacagcaattattttttaagctgttttcagataaatataaataaatccgaaccggcgctgtttaaacaaaaactatattaatataatatttcagcggcggattaatccgccgctgaaatataagagcatttgaatttattactcatataaaattatatcaaaaacattttatacttcattttatttcttttattatattaaacatttgtttcttcccaatacagacttactatgaataatttaagtttaaagcaaaaattaacacccaccgggcgcctaacccggaacaattaaattggaggattgaaaaaatgaaaaatttaagaaaagtattgtgcagtattttaacctgtgtactggctgtgaatctggtctatggcttacagcctgccattgtaaacgccgaaaaagaaatgactgtttctgctgaaacagctcctgaaaatggaaaaaccataactgaaaatattcagcccaacaattcagacgagtacaacttcttggaagatagtgctgcggctgaaaaagaatcttctgaaacagtaaccgatgaaacagccgaacttgcagctgcaaattccaactggattacagcggaaaaattaagcgaaaatgaaaaaaagcaatttacaattaatagtacagatgaagcgctatggtacaaagttaccctgaccggcaatgatgaaactataaaacttaccatagacaaagacggctgggcttttaacgaattaaaatatcgtatttatactgaacaaactctggttgaaggaaaagacaatatcattggttatgattatttttctaatactttcattaaaaacttcaaaacgtctcagcccggaaactactatgttaaaatatatggcgacgttaacgaggaacctttaaatatcagttacactatagttcctcccgatgaaaatgaaaataatgacacctggcagaatgctgctttactatccgaaaatcaagctaaacaattcactataacagccaataacggtatcggttcaattcctgactatgactggtttaagatatccgtgcctaatgataatcaggcaataaaaattaaaatctataacgacgatggttctgattttgaaaacgatttacagtgctcgctgtatgacgaaaaaactcttaaagctaacgggtcatcttatattgcgtacaaaaattacatttcaaaatacaataattttaatatggccaaagtggatgccgggaattattatcttaaaatatatggcggaattaatttaaaaccggtgaatatttcctacgcccttgttccgcctggcgcaaacgaaacaaacgacacctggctgaccgccacatcgcttcagaccgatgtatccagtcagttcacaatcaatgccccaaacgacacagactggtttaaaataggcgttccaaaggcgggtgaaaatgtttcgcttaccattcaaagtctggacgggctggattttgataatcagattttctttaatgtatatactgaggcgactttaagagccaatggttcaagcacagttaaatcaggatacagaacaaaatttatttctgacacatttaccgcggcagattccggaaactattatataaagataaccagcaatgttcatgaacggccattattgattacatactctttaggctcagtaattaccggggtgaccggcgtaagccttgacaaacaatctgtgacactgccgcttgatgaatctatccagctgtatgcacagaccattccggcaaacgcaacaaacaaaggctttgaatggactagctcaaacgtgaatgttgcgactgttgacgcatatggcacggttaaacccaacaatacaaccggaacatccagaataacagttaccacaaaagaaggcgggtttactgcatactgtgacgttaacgttgttcaatcctcaattgtaaaggtaaccggtctttccattgataaaacatcagccgatttgcggaaaggcgaaacactaaatcttaaaacaaatataacgccttcaaacgcaacaaacaaaaacattcgatggaacaccagcaatataaatgttgcatccgtatctaacggaactgttacagctaaagcgcagggaaccgctgaaataacagcaacgtcagaagacggcggctttaaatcagtctgcctggtaaacgtaacagccccggacgcaaaggctgaaggtgtacagctggacaaacacactctctcaatagccgcaggcggcgctgcctcattaaatgtaacattcattccgatttacgcctctaaccaaaatgttacttggagttctgacaatacagccgtagtttcggtagacaaaaacggtaaaataacagcaatatcagcaggaagcgcaaacgtaaccgtaaaatccgaagacggaggcttcacggacacttgttctgtaactgttaacgaatcgccgaaaacatatgattacagtattgaagatttggaaattctgtcagaaaccggagaagcactttcttcaatccccgaaaacggcaatttcataatacaggcatcctataaaaagaacacaaaccgaaatacaaacgactattttattatcgcttattatgatacaaagggctcaatgattggatttaattactctcttatgaatcccgtctcaggaaaaaatgttgctttcggaactttaataccgcagaaggataaaaaagtgtcaaaagttaaggcttttgtgtgggacggtttatcttcaatgaattccttggcggaaagtattgagagataaagatgctcatatttaaatttctttgacatagaaaatagaaaaacgtgttgaagattagatccaaataaagccgcttaaactacccaactgcatccgccctgcaacgcaagtaaccgactgtgttttccgagcatcagcttttctctgagctgtgttgtaattgcctagaattacgtaacactgacagatattttttattttaatattttatttttaccataaatatacgaaaataaaactgctcaaggcttggaaatattttaacttatcgtgacgctgaataaaaataggacttcattataattgaacagatatccaaaggttagaccaaaaatctaacaattggagggtcagctcatattatttgaagccctatttttgtcgctgttatataaaatgactgccattttttgtccatttatacaacggctcttttcaacgttttagccaacgggtaaaaataccagcaatgtgcagacaaaacagatgtgaatacctttgctggataatgtaaatatcgaaactgcatagtgtaaataccggagctggatttaaatctgtattaaataatacataatttgttttttaaatttgtcccatcttatttaacacctttgtctttttcagcgcaaaaagaattacggcggctatcacagttcctcctgctgagctgacaaagaacgggagtatgtacgtccacagcaccgcctcttttcccataagcagagccgcaattggatatgcgcagattcctcccagaactgatgtgccgaacagctctcctatacacgttaaaggtatgtttttggaatatttatataccagtccgcaaagcagcgctccgcacatgcttccgggaaacgccagcaaagtgccagtccccattaagacccttatcagagatgtgacaaacgccattcccactccgtaaaacggtcccaataaaaccgccgccaaaatattcaccaaatgctgaaccgggaaacatcttgaagctccaaccggtatgctgagaggcgaacaaaccacgcatactgctatcaatactcctgctaccgccatcttccacgctattgtctttttcatacaaaacctcctgattttaattttagacacaaaaagggaagcacctcaggtggtgctcccctatatctgtatcagatgaaagaattttatcataaactcacgattatgtcaatagattttttcacttaacaattttagtttcataaataggctgtttatagccgcatttcttacaaagaatatttaaactctttctgtctgaattcacagttaagtttccattaaacttcattccatctttacacctctcttttgttcgttttcaaattcttttatgttattgtcactgctgaacacagctgcaataattccagatatatcagcacctgctttttcgagtatataactttgcattttctcttgatattcagacggcaataccattccgccgtttatgcagacaataataccgtttacagcaaacactctgcctgggttataaaaattctgaaatattttttatatcaaacagtacagtctgataaatggaccgatattatcttctgcaataacagacaatcaaattgtttgtttcctcctttactttaacagcagaatcttcaaaattttctattttctctgtcttccttaatccgattcgtaatctatttgaattaatccaatactaaaatttttatttcaatacattttacaaaaattatggtcgtactaaataagtaattgtatattaacttaattgttttatgttggaacaggtgctataatataacaatataaaattttattagaaagagaaatcaaacatgaaaaacaaacttacatcaacctacactatttgtttcggggctatgctcagctgtctcctatggggaagcgccgctccatgtataaaaatcggctattcgctttttgaaataagcggaactgcgtcccagctgctgtttgccggaatcagatttattatcgccggaattttaacaattttattcggcagtatattgagccgcaaaattttaataccgcaaaagtcgtcaattcccgatgttttcaagctcgccatggttcagaccgtgctccaatacatattctactatatcgggctggctaacacaagcggcgtaaacgcttctattataaacgcctcaaacgtttttgtttcactgcttttctcatgccttctatttagattcgaaaagctcacaacgcgaaaaatattcgggtctgttatcggattcctcggggtaatacttatcaatataagcggcgcggcaataaacggaaacttcagttttgccggcgagggggctatttttatgtcctgcttatcctacgggctttcatcctgcttgataaagcggtattcacagcgtgagaatcctgtgaccctaagcggatatcagttcttcacagggggaatagtccttaccattatcggatttttgtgcggtggacggattactcatgtttcaacccaagctgttatgcttttgatttatttggctcttgtttcctcgatagcatacactttgtggggaatactgctgaaatacaatcctgtcggaaaagtggcggtttttggtttcatgaacccaatttttggcgttatactctcagcatggcttttgggcgaacaaaatcaagcattcagcataatcggagttgtttcgcttctgctgacctgtataggaatttatattgttaattcaaattcaaagattaaaaatttatcatagacttcaacagctcatataaattttaaacgctgggatagcaacatgaataaatactgtcgttttagcactaagcagattttgttaatcacacagattgaaaataataatgcagtattacttgtcaagatataaataagtcagtatttacacaagtattctgcaataaattttatttttaagaattaaactatttatcctcatttttggagattataattatttgtataaattaaagcggaaaccatgcggcttccgctttaaatatgttatttataaaattatatgataagtatctataatataataattaattttatttaatccttatcaacatctaacatgcaaaatacactattagtataaaatccgtcatattattttcttatacataaaatacgtaaaacaagtttattgatatataaaactaaatcaaaaagctttaccgggactgcgcgccttgcgcggcaaactgcgtttgtgttgcgtattcatattattgtttgcgtattcatattattgaccttgtaggtaaatcaaaacaagttattttgtatcacacccaccatgctggtggggtcacagacattgtaggtttatcaatacaagttattttgtatcaaacacacctactggtggggtcacagacattgtaggtttatcaaaacaagtcactttgtatcacaaccaccatgctggtgggggtcacagacattgtaggtaaatcaaaacaagttattttgtatcacaaccaccatactggtggggtcacagacattgtaggtttatcaatgcaaagtgatttgtattacacacacttttttaagtgtggtcacagccctccgatgcttgccataccacattttttatatatgaactttgatatttccgtctgctttattgcggactttccgcattatagttggaaagctaataaaaaccaaaaatgttcactataaacacatttattttttctgtctgtttttctgtttaccttccaataccctattttaataaatcagaaagctgcttgtcagtctcttgcagtaaactctgtatctgtcctgtaatataagttatattttcattaatagatctcgtgccatccactcttatcacaggacactctaatgattgcacccattcctcaacatatctccctgttcgggaacttactttatcgtaaaatgttttttcctgctcgtacatatctcctcccggtaaaattctactaccgaatttctgcaaagagcgctgttttattctttccaaacgaacctctttcggaacatcaatcaaaactgcataattataaaacgacaaaacatcttttccatacgctccttttacagctgcaaacacaaagtttttatatgttacgacttcattcaaaaggatcttttctacctctttatcagaacgtgataaaccactgctataattggaagctgtctgttgaaaaaatagattttcaatatcaataaaatgaatttcaagtttctccgcaagcgcttttcctaacgtactctttccgctaccattcaagccgcacacaataattcctattcccatatatatcatctttccatttttattaataaaaatataaccgcgaataagacagcgcacaacaaacaataattttaatatatattttaagttggctcacaattaaaaaattttttgcatttatctatcttatatttaattatattgaaaatccaccttataagattttataagttcctttgccaaaggctataaacccttatggaatcgacatttttgcttatcaattaagtttccatcgcataatcttataaaatcaagcagaaaattggcggaagttttcttattttgtccacactaatacaatcaatagaatccatacttatcggcttttaagccttgacatacttatttaaacctgacaattaaaacttataccgccgctgtttatgtccaagttgaaatatcatactcaattgcttttggttttaaagtaattatcaacaccgacagcaatcgccctgcctatagtttccgaatcgtttgtcagcacttctaagtcggatgcattatcaaaaaatccaatttccaaataggctatcggtacgggacttttgcagaacaaaaccgcggttgggaaaccttcatatctcccgtctacaaaagcggacagctgtgtgtctgaaacgatttgattatttataagctgacccaaaatattgctctctgatatatattccgccggcgcaagaacaccgctttggtcatacactcccgacaaagccatatacgcgctgccctgacctccgccggcattggaatggatacacacaaagacgtccgcgtccggctcagtagaagtgtcgccgcccgaataacaatacgtaagccgttttgtcattgacgggttttcatcgttcgaatttcttgtgagccttacctcataacccatttcctcaagatattttttggcgtttagggtattgtttaaatttatttccggctcaatatccctgtctccattttcaattggataccagcagcttcctccgtcagggtgccggccgctgcatccgcttccgcggcaatcatcccaaacagttcctgacttccaatggcgccattctccccagccgcctttttctgtgcttaaaacccagccgtcagcagatttgtcttcttcgctcatattaccggaatccttcccatgacccgggtcaagaacaacaatctgctttttaggcgtttgagttggcaatgcgctcgcctctgcagttggaatacttatttcatttttttcggcttcaaaagtctgtctggtaatcgttccgttcagaacaagaccaaaaactattatcaatcctgcgagaataataccgagcgctataactaagcctatcaaatattttctcataatcaatcaaaggtaagatatatctgttttgaatatccaaccgtgcctccataagatattttatagaacgtattgtttggagtgtccaggtacgtaaccttagaacccacaggtatctccataattatattagcgtctgacgcctcagacggcgtgcttcttaagtatatagcatatttcacattggttaccgtcatggtatcagaccatgctcttcctccgctgtacccggcgttgggactgacgctcgacagatattcacgcttggaatatccaatccgcccgttataattaatcttggcaaaaactgaatccgcattttcaataaatccaacctgagttcccaatggtatttcagttatgatattgctgtcgttctcctcaggcaagcttctcaaatatatagagtattttacgtttgccacatacatatatgacaccactgtggtgtttgaacttacgttatatgacggtacattctgaaccggaggcgctgcgggcgcctgagcagccggagccgctgtagccggacttattgttggagcttcagtagcgacaacggggtttatgtgatttatcggctaaggaggcgagcgtaccgtcgtagcgttttcgccagcgatagacatactgacgatttaccttatagcgaatggcagcctttgtcacgccgtgtttaaaagaatattcaattaatacttgcctaaatctcatagtttgtgttatagtgttcatatacggaaggctcctttgtgtatgtgatattatggtgatataactataacacaatttatgagttttccgtattctttttttctatttgtaacacatctattgtaatcctacaaaaatttattacaaaattcctcaaaatcccttgacagaatagaaattaactagtataattgttcgagtagaatttttttgacttctaggtgttgtataatactcggagggagggaagaaattatggcagaaataagagtaaaagaaaatgagtcgcttgatagtgcgcttcgtcgttttaagcgttcttgcgctaaggcaggtgttttatctgaggttagaaagagagaacactatgaaaagccaagcgttaaacgcaagaagaaatccgaggctgctagaaaacgcaagtattaatctgtttttctgttaatgacattccttgtcttttcatagctgtagctttgagacgatgttatataattaattgttagttaatttagaatgttaattaaattgatttatttagggctgtagtaagatagttgcaaaatattatgtgattttttatattgcaggatattttaatttgtatttattacttaagtttgcttgggttatattagtacaggagctgcaacttcaggattttatcctatcttagctgcagtcctttttatttacctttttggaggattgtatatgggtaggtttaaagataaatttaagccggatattttttgtgatgatgtatatactttagatattgaatgtttaaagaaattcggtatcaaagctcttatatttgatattgataatacattggttacatatgacgacttaaaggcgcctgaacatacaaaaaaatggtttgaaatgctgcatcaaaataatattttaacttgccttgtttcaaataataataaagagagagttgaaaattttgcaaagtcgctaaatgaaccatatttttatgctgcgcttaaaccaaagaaaaaatatataataaaagcttgtgatgtgatcggtgtttctccaaacgaagcagctttggttggtgaccaactgtttacggatatttatggaggcaatagattaggtatgtatactattatggttaaagctatctcagataaagaaaactggtttgtacattttaaacgcagtttggaaaaatattttttaaaggaatggttttgatgctggaatttaagagtgaaagttttgctcaatttggtcctgccggaaattcagatgatttttttgaagaaggaaataaatccgtttatgatgttccgaaatggctggaaaaaaatggacttagtgcgtatgaatatcaatgcggtcacggggttagaatttctgatgactctgcaaaagatctcggcgatattgcagaagggaaacacataagattatctatacatgcaccttattatataagtctatcatctgttgaggaagcaaagagagataaaagtatagaatatattttgcaaacgttaagagctgctaaatatatgagtgctgataggattgtagttcattcaggttcttgcggaaaaataactagaattgaagctcttaaacttgcttcggatactctgcgcagggctgttaaagccgctgatgagaacggatatggcaacatacgcatatgtccggaaacaatgggaaaagttaatcaattagggaatgttgaagaggttataaaattatgtcaaattgatgagagatttttacctactcttgattttggtcatataaacgctcagtctttaggtaaatataatacaaaagaaagtataaaaagtatttttgatttaatcgaaaataaattggggtatgagcgtgctaagaattttcatgcgcattattcaagaatagagtatacaagagccggcgagaagaaacatcatacaatggcagaaatcgaatatgaaccggactttgaaccgattgctgaacttattgcagagaggaactatactccaagaattatttgtgaatctgcaggaacacagacaaaagatgcgtgttcaatgcaaaaaatatataaagaattaattaataaaattgattaatatattaggaatcaggtgtttattatgaaaaatatttttgaagagcttaagttgagtaacgagactgcagttttgatatgttcaccatataatatgaaatattttagcggattttcgggcggagaaggatatgttataataacaaaagaaaataaatatctattagttgattccagatataccggaatagcaaaagaggaagcgtataaagactttttgatttttgaatttgggcttaattatccattagatgatatgttaaaaaacatacttttagaaaatcaaattaaaaatttggtttttgaagatgattttatttctgttaaagttttcaatatatttaaaaatatagcggataatattgaattttgtcctatgtctgatgatattaacaaaataagaatgataaaatcagatgaagaacttgaattaattgcaaaagctgaacagataggtgttgatgcttttaaacatattttatcttatatcaaaccaggtgtttctgaaatagatattgctgcagagcttgagtattttatgaaaaagaatggagctgaaaaaacttcttttgatacgattgttttatccggagaaagaactgctttacctcatggcgtgccgggggataggattataaaaaatggtgatttccttcttatggattacggatgtgtatataacggctattgttctgatatgacaagaacaattatgattggaaaggcagataaaaaacaaaaagaaatatataatactgtactaaatgcccaaatgacaggtttgaatgttttaaaagcaggaattggaggtttttctgctgataaagccgcaagagatgttatagacgaagcaggatatggagactattttggacattctctcggacatggggtgggacttcaaatccatgaacttccaaatttatcaccaaagtctgatattatattagaagaaaatatgatagtatcctgtgaaccgggtatatacatttacggatatggcggtgtaaggattgaagatttagtatgcgtgaaaaaagatggaattcgaaatttaacaaatttatctaaagaactaattgaaatataatttttggctccgcaatttagcggggcttttttatacacaaaattcattatcttgagtataatatttcaggagagtgatgatttcatgaatggatattacagagagtttatgccaaatgaaaaagaggataatacgcagaaacaaaaaactgctggtttacctaatgaaagtttagaaaataataatatcagaaataatgcaattaattcacaaaccaatccacggaatgtttcacagacgaatccgcaaaacaattcacaaaccaatctacggaatgttccacagaccaatccacaagcaaatccacaaaccaattcacagaccaatctacaaaccaattcacagaccaatctacaaaccaattcacagaccaatctacaaaccaatccacaaaccaatctgagaaccaatccacaaattaattcgtcaattaatccacaaactgttacacaaactagtccgcaaaataattcacaaactattccacagactatatctgaaaataatgttagaactattccggaaagtattagacaaaacaataaccagcaaacagcacaaaataatcaaaacttaaatcaggttccgaccgcaaacaataataatgttcaaaacaatagtaacttgcagaggaatgcaggttcagaggggaattataacgaacatttatcacgttttaatgaacagcttggagcgagtataaacgttaataatcaatcaaatgaaacatcaaatagacaaaattacgaaaacatagccgaatctgaagtggaatcactggaaggcggtgaaaacagtgagactattagagttccatatactggtaatgggaaactgatagtacaggttactttagcaagacaggcgatacctttggagaatgcaaaagttacagttaattcgacaaacggaagcccaatagaaataaatgaagtaagatatactggtcaaaacggaagaaccgaaccgattgatcttcctgcacctccggtttattattctaaacaaccgcaagaaaaagttcagccatatgcagtatatgacgttaagtctgaacttgacggttattacacaatagaaaatgcaaaacacgctttagtgtttgataatattgcctcaatacaaaatatagaaatgatacccaacgaagaaaacagagactaatttttggaggtgattttgtggatttggagttaaaaattccctcaactgtcgtcgttcatcttggagcgcctactgatagttcagcgcaaaatgttaccataccatttgttgattacataaaaaatgtcgcatccagcgagatattccctacttggcctgaaaatgcattaattgctaatatttatgctcagattacttttactcttaataggatatttacagagcattataggtcgcagggatatccgtttgacataacaaatttagaagcttatgatcaagcatatgtttatggtagggatttttttgaaaatataagtcaaatagttgacgaaatatttaataactacataacaagagaaggaaattataatccaatttacgctagatattgcaatggtactacatcactttgcccaggaggattatcacaatggggttcggtagatctcgctaatcaaggatatgctcctatagatatattaaaatattattatggcgatgatattacattagttgaggacgctgaggtagcggacgcaagagaatcttatcctggtcagccgttaaggcttggcgacaatagtcttgaagtaaaaggcatgcaggttagattaaatagaatttcaaaaaattacccgtcaattcccaaaatcgcatttcctgacggatattttgatgttataaccgaagatgcggttaaggattttcaaagaatatttaatctgacagcagatggaataataggaaaagcaacatggtataaaattataaggatttataatgctgtaaaaaaattgtctgaactagatgctgaaggaatttcattggcatttataaaggaacaatatacaggaacacttcgtaatggcgacacaggtcctggcgttgaaatgatacagtattatcttagatttataggaacttttaatgatttcatacccgctgtcacaacagatggtgtgttcggtgatgctaccgaaaattctgtaaggtcatttcagcaggcatatggcttggagcagacaggtgttgtaaatgaggagacatggaatagattatattcaacttatttttcgattttagacggcctgccgccggattttaaaggtgaaaattttgttcctttcggaggaacggttttataccgtggtgccagcggagatgcagtaagaactttacagaacaatctggcagaaatagcaactgtatatactgatataccaaaagttagtgtaactggatattttggccctgagacggagcaggcagttattgcgtatcaaaaattatttggtttggctcctaggggaactgtaggtccgattacttgggatagtattgccagtctttattctgatatcgtaaatggtaatctaaaatcacccggtcagtttcccggttacgttttatcagaagaataggaggatgacaatgtggtcgattaatgatgatatgagaaatatatttgaactgcaggtcatgctgagggaattaaatagaacattaggtatacgattaattaatcctgatggcatatttgatcatgaaacaactgaggcggtaacacaagtgcaaaaaatagccggtatagaaccgccaaacggtgaagtcgatcttttaacatggaacgaaatagtttctttatttcgagggtaaagtaaaattttaatttttatcttgacataattatagataaactttataatattaagttaaataaggggaattattaggagggagagatacttatgaaaaactataaagagagattcgatttcaaaacttttgttcgatgcggaatgcttactgcacttgcctgtgttttgacaatggtaccacagattcctacgggtaccggaggttatgtccatttcggagatagtataatatatgttgcctcagcatttttagggccgatttgcggagcagttgttggagcggttggacattctttggcagatatattaaccggacatataatttttgctctgcctacttttattattaagggtcttatggggtttgctataggaaaacttttatataaaaacttttcaaaaactcgttttattatgagtgcggttgcttctttggcaattgtaactctaggttattttgcagctgaaattccaatgtatggagtgtcagtagcagccatatcattaatttcgtcaccaattcaatggctgatgagtgtggtagcttcagctgttattgttcctataatcaataaatataggactaaaattggtctataactaatagagacagtgcagtttatgaattgcactgttttttctttaattaaaaagcagaagtctttggatataaaatcaagcatataatggattttaagaaaaagcggagatattatgctgtttaaaaagtaatagctgtataaatatctttgtcaagttatattagatgttaaaatcattatagaacttataataatattgaaagaaagctcataatgtaaatttttgttctataaattgtttattaaaaagatacttacagaaatattttaacagccccaaaaagttacgctaaaaatataactttttggggcaatattatttttaggaatattttcctattatctatttaataattagttctacagggcaatggtctgaaccgaaaatttcttgatggattaaagctgaatctattctgtcctttaatttttcagatactataaaataatctatacgccatccggcatttttttcacgcgctttaaatctatatgaccaccatgagtattcgccggttacatcaggatgaaggtatctaaaggtatcaatatatccttgatttaataattttgtcatctcttcgcgttcttcgtcagtaaagcctgcgttttttctatttgtttttggattttttaagtctatttcctgatgggcgacatttaaatcaccacagagaattacaggtttcattttttcaagttccgcaatatatttgcgtaactcattttcccatttaactctaaaatccaatctttttagttcctgctgcgaatttggagtatagcatgttattatataaaaatcagcaaattccgctgtaatcagtcttccttcagtgtcatattcgtcaatccccattccgtatgaaactgatatgggttgtgttttcgtaaacattgcaacgccggaatacccctttttttcagcatagttccagtattgactgtaaccctcaaggtcatcaagctgtatttgtccctcctgaagctttgtctcttgtatacagaatatatcagcgtcagcagatttgaaataatctaaaaatcctttttgcacacatgcacgtaacccgtttacattccaagaaatcaatttcattgtatgttttcctcctttgtaatgttaaaaaattttaaaccgttttgatatgttatttcacacagctgctccaactctatacctttaacttcagccattttttcagcgacgtattttacatatctgctgtcatttcgtcttcctctaaatggttcaggcgccatatacggactatctgtttcaatcattaatctttcaattggtatgacttttaaagcttcaatagcgcgttttgcatttttgaaagtgattactccagtaaaagaaatcataaaacccatattaattaaaatctttgcagtttccgcgctgcctgaaaagcagtgaatgacaccttttgtaacattcatatctttcaatactttcaatgtgtcgccttttgactgtctgtcgtgaactattattggtaaatcaagctcttttgcaatcaaaatctggttttgaaaacaattaagctgtgattcacgcggggcggagtcatcataataataatcaatgccgatctctccgattgccttaacttttggctcagtttcagcaatagttttaattttttgaaaatcttcgtcatcagcgttttctgcaaactcaggatgtataccgaccgaagcataaataaagtcatgggaattagctatattaacagcttttaatgaagtttcaaggctggacccaacctccataacagtttttacatcattttcccatatctttttaattatttcttcccggtcattatcaaattgttcatcatcgagatgtgaatgtgtgtcaaataatctcataaaatttctcctaaaaaaataatttacttgattatagcatatcgttatgttataatcaattatagcatatcgatatgttataatcaaatgaaatttaatatcttcatttattttatcaatacacagtttgttgtatataatataaataagatatttggcagaaaatggagtgatttttgtggaagaattgatagaaaaaggcaagctcgccaaatctgcgtcaagagttcttggcagtctgtccgcttcagtaaaaaataacgctttactcgctattgcagacgctttggaaaaaaattctgaatttattatatccgaaaataaaaaggatatcgatgcaggcagaagaaatggcatgaaagaaagtctaattgatagattaagtcttaatcaagccagaataatagatatggctgaaggtatacgccaaattgctggtttgccggatcctatcggtgaagctatctcaagtataaaacgtccaaacggtcttaaaatatccaaagttagggttcctctcggagtaatcggtataatatatgaagcgagaccaaacgttactgccgatgcagccgggctttgtattaaatctggaaactctgttatactccgcggaggcaaagaagcgtttaaatccaacatggcaattgtaaaagtaatgcaggattctggttataatgctggtttgccggtaggttcaattaatttggtagaaaacacaactagagaaagttcaactgagttaatgaaactgaatgattatttagatgtaattattccccgcggaggtgctgggctgataaaagcagttgttgagaatgcaacagttccgtctatagagaccgggacgggtaattgtcatgtatatgtcgattcatatgctgaccttaatatggctcatgatattgtcataaacgctaaaactcagcgtccatctgtttgcaatgctgaagaaaaattacttgtacataaagatatagcagaaaagtttttgcccaaaatgctgaagtctttaagtgataaaggtgtagaaatagttggtgatgaaaaagtttgtgagatatatccaggtgccacagaggcaacggaagaagattggggaacagagtatcttgacctaaaaataggtgttaaggtagttgacagtattgatgaagctatcaagcatatcaataattataacagcggtcactcagaggctattgttacagacagctataaaaattctcaaaaatttcttgataaaattgatgcggctgcagtttatgttaatgcttcaacaagatttactgatggattcgaatttggatttggagctgaaattggcattagtactcaaaagactcatgcccgcggtcctatgggacttaaagaattgacctcaaccaaatatataatagaaggcagcggtcagataagataattaattacaggaggtaagatatatgaggatagaaacaaaatgtatacagtcaggatataagccggaaaatggcgagccgagagttctgccgatttatcaaagcacaacgtttaaatataactcaactgagcaaatgggaagattgtttgacttggaggaaagcggatacttttataccagattggctaatccaaccaatgatgctgtcgctgctaaaatagctgacttggaaggcggagttgctgcaatgctgacctcatccggacaagcagcatgtttttattcaatatttaatatttgtgaagccggggatcactttgtttgttcttcaactgtgtatggcggaacttttaatcttttcggtgtaactatgaaaaaacttggcattgatgtcacttttgttgacccggatgcaagcgaggaagaattaaataaagcatttaagtcaaatacaaaagctatgtttggtgaaactattgcaaatcctgctttagttgttttagatattgaaaaatttgcaaaagtagctcacgaacatggagttccgcttattgttgataacacttttgcaactccaattaattgccgtccttttgagtggggagccgacatagtagtgcactcaacaacaaaatatatggacgggcacgctacctctgtaggcggagccatagttgacagcgggaattttgactgggaagcgaacagtgaaagatatcctggattgacaacacctgacgaatcatatcatggagttgtttatacagagcgattcggaaaatcagcttatatcatgaaagcaattgctactttaatgcgtgatttggggtctattcctgcgccgcaaaattcctttttgcttaatataggccttgaaactttggctttaagagtagcaaaacactgtgaaaacgcaaaaaaagttgcagagtatctaagtaaaaacgataaaatttcatgggttagtttttcaggattggagaacgataagtatcacaaacttgcacaaaagtatttgccgaacggttcatgcggagttatatctttcggaataaaaggcggtcgtgaaaacgcagtaaagtttatggatggtttaaagttagctgcaatagttacacatgtggcagatacaagaacttcagttttgcatccggcaagtcatactcatagacagatgaatgatgaagaactgaaggcggccggtgtaagtcctgatttaattagattttcagtaggtatagagaatgcagatgatataattgaggatatccagcaatcgttagataatatttaaaattttagatgtttttcagtgattcaggttggtgtttgacaaatatataagttttgcaagccataataaaccgatgattttgatatgttaaaactaagctataaataacttatatacagttatttataacttaaaatttacaaatataaatatagactataataaaaaagtaattatttaaccacattacttttcaaacagccgcttaaatgcggctgttttttgtttacttgttattgctattcttttatgtgtaatatgtactctttcatgctcatctgagccaatatgttatcttatataattgatttctaatatttatacatagtgtcattttatgactgttgagtgaaattatattgaaatcgaataggtaatttttgtaactttagttgcggcaatagcagcgtactgacaatattttaattattttgatataatgttaagagccaatcaattttaagtaatcggttggtttttttattaaacctaaatatttgtgtgttataccacgcagattgtgtatgaagcgtcgtcataattagatttttatttattttattaaaaaatatacatatgtgcatggtgtcattaaggtaatataaataaataatcaagtttgttggtcaatttttgacatgttttagtcaggttttggcaattgattgcatattaaatttgtgatataattatgacaacatattatgaaagggagtatcgatgtgaaaaattttaaaaagcttttgtcgttgtgcatagctgcaattatgatttgcggcagtatttatattcctgcactggcagattcaagtacagtagcggagtttgcaaattttaagtctgtttggaaaggcactggagaaaacaagtatttatcaattaaatctgactatttggatggaacttcaaatggtgctgttgcttatgcaggaacggcgaatttaatagaaaaaataagtgtttcgatagactgggcgcttacaagttcttatgttggcggagtatcaatatatgcgcttccgctaaaagatacaaatggtgacggaaacgccacagcggaggaaacagacgcattttacacaagaaaccttgatggtaataaaataagctcagcagaaactcccgatttggcttctgacggagttttgatagcacagctggacaattataccggagcggatggaggctggaacttttctacagtttctttgacatctcaatatcctgtgcagggtgaaaaagcaatatttttacagacctcgtgggtttccggaagcaacgggctgacgggtaattttaaaaatttggttataaaagaaagcacagagggaaatcaaattgtaagcataaccaaaaatgattttacaaaaagtgttgtctttaccaatacagaaaacggtaaaacatatgagtcaaccggtgtaacagccgcacttggagctggaacatataccgttgaagcaaagtcgtatgcgccggctacatataaagtagaggcggtaccatcggaaatcacggtaaccgataccaacggtgcaaatgtaacggtgacatcggagctgataactcaaaatttacctgaaacaaattatgaaactataaaaaataacgtaatcgaatggaacgcttcaaacggctataaacctgaatcgcttcattatataaatagtgttcagcatcagcctgatatagctgtagccggagctaagcagggtgaaaaaactgacgctgatgtatatatgcttgtcaacacacaaaccggtaaatttcatacatacggaagaaatggagcaatgcagattaacggcggctccggagatggcgctgtgggtactgtattgaaagttcctgtagttaaggatactaaggtgacgcttgatgcttcttcatttacttatactgtgaatggacaaagtttcagcggtactcaggattattattatctcggcaatgataatggctatgcggtaataaatgttataagcggcggttatgcatcctccgttacaacaacaccgcttactagaacagcagttaccggaactgtaacgggaacggacgccggatgtataatgtttaatgatatttcatcaggcgatgtacagtatgctgagattttaggtggttcatattctgcggagttactaagcggacaatcttatgtgataaaatttggaacatatgaaaatggtgttttcaaagtatctgaaacaaactctacagatattggaggaataatcccgtcgggaaccagtcaggttcaaaatatagccataacagaattaaaggattatattatcggcggtgatgttgttgatttaaaagacggcgacatattaaagcttaacgatggaacaaaagattatgaaattactgtttcgaatggtaaatggagtgcgtccgttccgaacggagtgtatactttcacaattaaatcagataaaaacggaacgctgtcgacgctttcaaaaaacagttttacagtacttggtgataataataaaataaaaaatgttttagttgtatatcctgttcagccggaaacaaaaaaatatataactgttggaacgaattgtgattacgcaacgcttaatgacgctcttgacgctgtaaaggcaaatggcaacccagcttctgaagctgaacgtgttactatttatttaaagggcggagaaactttcagggaacaggttatacttactacgccgtacattacattgacaagcgacaaggataatccggcaacagtcacatggtactatgcttcatatcatagatattacagtgttggtcctacaggcgagtatgataaggactatgcggttgcaaaatctgttaaaaatgatattcaaaacgattggggtgcggcttttaaaataaaagaaactgcgacagattttaaagcagaaaatattaaatttataaattcatttaatgtggaatatactgacgaagagcgagcagacggtgttgaagatacaggaggcggttatgacagaatgctgacgccaaatgacgccggttataaacctgccgattcaagaagcgtgcagactacagccgttgctgtttttgcggcagctgataagagtgagttcaataattgtgtaattatatcaaatcaggacacattgtttacaggcggacctgttagactatattttaacaaatgcgcaataagcggaaacgtcgactatatttttggcggcggttggtgtgtgtttgaaaagtgtgatttggtctcagccggttacagcgaccaaaacggaggcggatatataaccgctaacggtgcgaaaggaaataacggctattatttgtttagagactgtacagttaaaaattcggatgttaaaggaagaaaatttggttcaatcgcgtggggacgtaattggggcggagacacaagtgaagtctatcttataaacactaaagttgacaaaggagtaacaaggccgtcaggctggggcggctggggaacagtatcaaacgcgccattgtatgtctttgatttaaacgacccgtcagtcggtaaaaatacaacagataatatgcatggcttcctgacccaggaacaagctgaacaaaaatattacagcgtacttagtatgatgaatggttgggatcctatatatttaaatcgtgcaaaaggtattacgatcagtgatgcttcggttgaattgaacgtaagtgcagaaaaacagcttgcagcttccgtaaatccatcagatgctatagatacaagaataatatggagcagttcaaagagtgacattgcttctgtggataattccggaaaggttattgctctttcacctggtgatacaattattaccgcaaaaactgttgatggtggattctcagcaacatgtaatgtaaaggttttggcttcaacagacccgtctgcaagtccaacgatagagcctacgtctgaaccgtctgcaagtccgacgcctgagcctttgaaattcagtatagaatatacaaaagatggtcaggcgcatgtaatatcaccggaagccggtactttctctgtcattttcgcagcatataataatgatattttgacaagtacagagtttataccagtgacatttacagagcccggagaacatgttgtgacaccattaaatttcagtacagtcggtgcagacagtgtaaaggttatgctgtggagttcaacagatactatgagaccgttatgtgcggcggatatcagtaaataaagacagcagaaaataaaaaattaagcggcagatgattatcatctgccgccggctattatttaatatattgaatacctgcgtatcatcttacggtattgggatggagaaacgccatatatatctttaaagattctgtagaatgagcgtgtagattcaaagcctgaatctgtggctatatcttcaagattgtcatctgatatttttataagcgaggcggcatggtttgtgcgtagaacatttagataggttctgaaactgacctttatttgatttgaaaaaactcttgatatataatatttgtttattcccaactcgtcggaaatcatatcaagcgtcaaactctttcggaaattcaatgaaatatatgagagcagacgagtaatagtgtctgaattttgtaatgaaagaagtgtgtttttcatcaggagaggaattgtatggctgaagataatatacgcccaacctatttgtgcgtttatactcgcttcctcaaaaattttatgaaaagcgagtaccgcattttcatttaatatatcagcattgataatacattcatcgggatatgagccgcgcgtgtcgggaaacattgcatacagtgcgtcagcaggcataaatattattgcgctgtcggcagcattattaactttttttatggaatccggacgtgtgtatgagtgaggaacatttggaaaaattacagcacagtcgccttcgtaaagaacatattcggagccgtttacaatgagtccctgttctccttcgaacagaaatatagtttcaaattcgttatgcagatggcttttatatttgagcgcccggtgatgatgaacaacgtcgagttcatattgatgtacctcataaaaattaaacatatattatcttccctttattttattatcttctaatatatttattataacatgcggatatattttccgtcaatctataagtcaattattggcagttaatacagcaatactgtcaactgaccgatacattgctttggtatataatgctagcataatcgcagtttattgaaaaaacagatttatatatatatcaactgaaagtgtatataggtttgaataacaatatcgatttatagggtaagcaggtatggattgtagtaatgatttaatatacttatttatggatttatgtatgagatgtcagctattgacaaattgttaatatgtgttttgattcgaggttttggatataaatacataagttgttaaaatgaaatagaaaataatgcttctcattttaataactaatgtattaatatgcttatactcattgttagaagtctgcagtttacagagaatgactgccgtttatgaatatactttgaggcgatgtcattatttcttataattgcagaaaaatttacattgagataaataaaattttgagaaataataaataattatagatttcttcccaaaaaagctgcctgagaaattatttctcaggcgctctgttttattgtaaaattaattattatattagtagtttgtacaaacaatgaagtaattaaaacaaataagtcaatatataatttctatttttatgtatttatattttattgttcagttattagaactttgttatttattatatattttaattggtggataataattggtaataaatctattattgactcaatagatatgagagtgttgaattttaataatcgaattattatccatatctgttttaattctataaaaattaacattgataaaaagaggatttaaaaagtataaacagaattataataatgataagttagtggattatatgaaatattttaaagttttaatggttgtatagatatatgttaatagaattgaattttatatataattaatatttcaatataaaacttatattgaaatatttaggcaaataaaaataagtttaagtagaggaagccgttttaactgtaaatttaagtaaaaatacgagcaaaagtgcagctggcctagttttgttttgtattataaaagaacttgtacatcatggttctatttataaaacaatgaaaaagaatataaaaataaaatactttaataattatgaagactatttaaagaattattcccaatttagaagttgcgggataagaaaatagaaaaatagaagataattaatatagtatccttgtagattcccgagtgaagctatgatattttctgattttctgtgccattactatatatattatcggaaacagcgttctttatgctgatttttgggtagcagtataaatttatttgtttaaaagaacagtgataatttctagaaaaatgctactttaactcaaaatactaattgttttataaaatagagtaattgttttggaggcggtaatatttagaaattattatagcagtgatataactatatataaattagatataatatcatttcaaaaacaatgtatattcaaaaataattatagtcttgcagagcagcaaaaaacaaaatttaattcaaaattactgctttttagagagggagtgtggggatggaatatttcaaagttctactgcctgtaattgttgcagctatatcttctgtaattgtaattttagttattattaaaaagcataagaagaatggcaaaattgaaaattatatgaatgagggattaacaataggcttatgtttgggcgccggaattggagcaagcttcttaactaatattacatattttatcagtataggtatgctggtgggatttttggttggtataaatataaaaaaacattagaaatgtttagtaacattaaaaaagaatgaattatttattaccgtcagtattaaaatactgacggtattttgtatttaaaatttttggttatacagacttaaaatatttaaaaagttttagttaattaaatatatttaaattagacaaaagtgatattgaatattattaatagtttaataaatatataaagtatcttgattttttttgatatattatttataatagtaatgtaaaactaatcataaaagttaatttgtgttttattattttaacagcaaaaattttgtagtagaatctatggatactatgaattaaacatatgcaggagctgaaatttatgtgaagatggttattaatatgatgttacttatattaaaaataagaagggattttaattatgaaattaggcagattaaaagaagttaatgtcagggatttatggcatcacgaacagtatgatttttctaattggttatctgaagaagaaaatatagaacttttaaatgatattctaggattgactttaatagatattaataaagaagtatatgttggggcatatagatgtgatttagttgccagagatgaagcaacaggtataaatataataatagaaaatcaacttgaatgttcaaaccatgatcatttaggtaagataataacatatgcgtcaggtcttgatgctcaagtgattgtatggatagttgaagaagcgcgtgaggaacatagaagtgcaatagagtggttgaataataataccaataaaaaattaaatttctttttaattgaacttcatgcatataaaattggcgattcgataccagctccaaaattcgaaattattgaaaagccaaatgattttattaagaattcaaaaggaaacagtgattcaaatgatatgagtaaaactcagtccgagagagtaatattttggacaatgtttaatgagcttgtagttaacaggggcaaaccttttaatatcagaaaagtgtcgacagataattggtataatgttgcaattggaacaagtgaagcacatatatgtattaatcttgtcaataaagaatccagcattgtcatagaattatatattaataacaataaagaactatttgataaattatatggtaataaaactgagattgaaagtgagcttggattatctttagattggcaaaggttgaataatagaaaagcttcaagaattaaatacttaatatatggattaaattttgataaccacgaaaattattctgaattaatgaatgagataattgataaggttattttaatgaggaaagtctttattaaatatatttagtttttatatattatttttatttgatatttgagaaatgaattagattattaaaataaaaaacagtaatctttaaagagtcaacatgagcaattttacgtcagtacatagttgtcggagtttttaacagattttattgcatatccattgcatttcatatttattcatggtataattttagtaaatatatactattggggtgagagtatgaataaaaaaatatgcaaactaacaatgcttttattcgtgacggtgattttggtatgttcggcttctgttgtatttgctgagggtattattaatcaaaattgttcagtgtttttttctgtaaacggcggtttgtatcagaaacctttttctttaacactttctactgatcttgaaaatgcacaaatatattatacgactgacggaagcgacccaaccgaaaattcagttctttacaatggaaacatcactatagagaaccgtacttcacagcccaatgatttatctgaaatttccggtgtttcaaccagttttaaagcgccaaacggtctagtttttaaaggaaccgttataaaggccagagctgtaaacgccgaatctacaactcctatattcgtaaactcttattttgttagtgacgatattttgactagatatggagtaaaagttatttctattactactaaacgtgataatttgttttcaaagcaaaatggaatatatatgtcgcccaattatttagaatcaggagaactttatgagcggagcgcttttgttgaagtgtttgattctgacggaagttgtcaaatagcccagccggcgggtatccgtattcatggcggcgcgtcacgaaattatcagcaaaaatcgtttcgtgtttatgcccgtgagaatccggaatatcagagcggcggtctgaaaacttttgaaggagatttatttgatggaactgttactgattttaagggtggtataataacaaagtataagcgtcttatgctaagaaacggcggaaatgattgggataagaaatttatccaggatgcgtttatccaggatatatgtgctcctcttgattttgatacacagggttatcgtccgtctgttgcatttattaacggtgaattttggggtatgtatgatttgcgtgagcggtatgatgaccaatattttagatatcactataagttgaatgacaataaagatgttgctatgctaaaaatgtcatctgaagacggtgttcgtgatattctcacgctagaagagggagaagaacaatatcttaatgagtatcttgagcattataattggattttggaaaacaatcttaaggttccggataattatgagactgcttgtaaatactttgatccgtccaatatgattgactatgtgattgcaaatgtgtattttaaaaattgggattggcctcagaacaatgtggtaatttggaaaaataccaatccacaaaatgattttgacgaccgctggcggtttgctatgcttgataacgactacactcttgaggcaaacggaaagctaaatactgataatatccttgaaaaccgaatatatggcaaagaccaaccgtcagcttcagctaaggggtggaagcttagtcagctgtttgcggcatttttggaaaacgatgattttagaaatgagacaattaggcgttataatgactatatgaacactatttttgataatgatatattatcgtcaagattggatgaaatgtataataatatttcacatttggttgccgagcaaaaaagcagatacccgcttagcatgaaaaatgacaatcgcagcagtataaaatctcaaatcaatttaagggaaaccgccgcaagaaatgagataaaagaaacatggggcgtacatgaaatggtgaacgcgttatttatctcggatttatcaaaaggatatataaaggtaaataatattgaactttgttccaataacaaatggcagattaaaaatccgggaaactattccgcacaatattataagaatatcccgatacaaattaatgcagtggcagagaatggatataaatttagttattttttaataaatggacaaaaggtatatgacagctgcgttaacttagatatgtcggttgatgagactgttgagaccatttttgaaaggaccgaaacggcaaaattgatttcagattcaatagtgatttatcaagttttcggagatgggggcaaaactgacgcaattatggatagaagctgcgtacagctgtataatcctctagatgttccggtagatatttcagggtatgctttgcagtattcatcgtcagttggagatggatggcaaaaatttgttatgcctgaaaactctgttataaaaccgaaacatttttatttgattggaggtaagttaaactccataaatgccaggataaagattgacgctgatatttattttgatgatatggttatagataacaagatgttcaaattggcgcttacaaaaaattctgaggatattaacgccaaagcaacaacagttgcggttatagatttgcttggtgtggtggagaagaatggagattcgtcaattgacgcttatgagactgtgccttcatatggtttatcaaagcagaagtctttaatcaggataggttctgataccggaaataatcaggaagattttgcagttttttcatttaaagacgcgtcagacgaggaggtcaaagaaaaacagccgcataagcatgattatattgaatccccaagcccatcaccaatacataccgacaaaccgacaccgctgccgaatgtttcttatactgatacagaaattaagctggaaaacggagaatattggcttagtaccaagctcacaaatattgaacccggttcctcagtggttgtagcggcttatgataataaaggtgtgttaatttcaatacagatagtaaaaagtacagattcaaatattaatactcaatttacatcaaatactaatatagatttttttaaagtatttgtatttgaagagatggatgatattgttcctgtaacagattctgagttagtagaaatataatatctataattaaccaagtacaagagcctggttttatatttggtgtagatgtgtataaagtttaggtttgcaatatattactataagtatagagtcggttagattgattttacagatacagaaaatagttatatttatttctgataatatttgacggattaaattatgttataattaagaaccacataaagtgatataaaaactttgtgtggtttttgaaatttttatttcgggtataaatttaactatttaaaaataaatggagttagtggtaaaaatttagattattattatcaatgttaaaaatattaacttagaggatatattttatctgtatatggctttgtgccatagtatgatgtaattttaatatagacaaaagacttttgtatgaaaagagagaacaaaaaatttctaaatataatataatttctatataaataaatatttgttaattgattatttaaatttttagaataaataaactggtactataaaaattgttttaactggctctgttaaatttacaaaatgtgatttagaatatagtagtgtacagagatataattataaatttgtattcaaaaagtgttataagatataacaagttatttcttaatacataataggaaacaataaatttttatttgtaatatttaatcttatggaaaacatctttaaactatatatttgggacggcgcagatgtaattatccctctaagtcgagccaaaggtgaaattaatgcaatttctgttcctttggctccgacatctgagccggaaatagaatttttaatattaggatttattttcaaagatattaaactatataaattattgtgtgaataacacaaaatgcagtaattttaaaaggttattattttgtaaagaataaaaagctgtcgattttaatcgacagcttttaataaatggtgcgactgtccttattggacttatggaaaaatcgcataaacacaagggttttgagcggtcaataaacagtattaaccttaaaataaaataattttatgtttaaaaaatatcgtgaattgcatatttacggtattttttatttcccttttgcaccaaagaccgacctttacattctcagatagtatatcataaatacataaggcggtcaattaaaaaacaaaagaacgacaaaatttttattttgccgaagtaaaacagaatattttatatataaggcattgggaacactcaatgtctttttttgatgtcgatatttaggaaaggagcatatcagctatggcaacagtattcagagttcagaaaacaaaagattttacagtgatgtctaatcatcatttaaaaaataaagatttgtccctgcggtcaaaagggcttttatcgtttatgcttagcttgcctgaagattgggattattcccttaaaggcttagcaactttaaataaagagggcattgacgccatacgctcggcaatcaatgagcttgaagcgtttggatatattgagcgttcccgcgtcagaaacgaaaaagggcagcttggcgaaaatgaatatatcatacacgaattgcctatatcgcccgaaccaaaacagaccgagcctacattggaaaatccaacattggataatcctgtacaggctgaacctgaacagggcaagtccacgcaattaaatactaataaatcaaatactgaaatatcaaatactgatttattaaatacttatccaatcaattctacggagccggaggaaaacggcgaacctgtaaaaccacaacagcctgaacggataggaatggataagattttagcatacagacagcttataaaacaaaatattgagtatgatattttatgtcaaaagctaaacggcaatatcggtattctgaatgaaattgttgatattatcactgaaacggtatgtacaacaagagaatacttaaccgttgcaagcgaggaacgaaatgcggaaacggtaaaatccaaacttctgaaactaaacagcgagcatatcgaatatgtcatagactgtatgaagaataacacaacagacgtacacgatacaagaaaatatttacttgcggcgttattcaatgccccctccactattgacagctattacaccttgaaagtaaatcacgatatgtacggaggtaattaaaattacatacaacccaaaatcacgcgccccgcctatgcgagcgtgttttttaatacaaaattttaaatcttgacaaggaggatttttagaaatgagaaacaaaataaaaagaattttagccgctgtaatggcggcgggaatgactttgagcgttattccctcaatcaccacttatgcggcgcagagtaacgaatatgtcgatccggcggacgtatggattgaagcaaacgggcgcacaagcgagtttgacatcaatgcaacagtaactacgggtacaatgttctgccccgtctgcgatatgccgacaagcaacatttcctaccgcgtacccgaatacacacgaactggcgaaaccgcatataatcgcggcgtctactattcggacggtacgcttattgacggaaaaggcaaaggcaatcttgacgacggaacacccggcgttgacgcgttctatacggggtatcattggacaaaatcagtttgtcagaattgcggtacggtaaattccgttgacggaattaacgcgtattcgtgcggtaaagatgtatattcccttaacccctgcgacagcaactttttcttggattttgacagtacggaatacataccgtacaacagcaggacgcatacggtaaaagcaaaaaagggcaagtattgtcaattctgcaaaggcacgaaagagcgggtgcaggacaaacaggaaaaccacaacttcaccgaaaatgtaaacggcgaattgggaaatcagcgttttcacattacagcggattgtgaggactgcggatataagaaaaacgaatacgcggcggcaaagtctgttgtacaaagctattatggcaaggttgacggaaaacctcataccgtaaccgtcaatgacttatcggagaatggcgtaaatacaagtattcgttacggaacggaagcgaaaaagtgtaacaagacaagcgcgccgaattataccgacgagggctattatcccgtatattatgagatagaatatacctacggcggcgagagtatgacggaaaacggcgtaagctatgtatggcttttaagcgataatccgccctcaaatacaaacagtattcatactcacgatttcagatttttggaaacagtgcgccccacttgtacagagttaggttttgaccgtttccagtgtgccgagtgcggagccttgcagaaaacgaattatactcccgcaagcgggcacgattacaatactgttgtaattcgtgagccgagttgtcagcaaggcggtttagaattacattcctgtacaaagtgcggcagctattatacagaaagtacctcaatgacgggacaccgttatgaaacaaatattgttgcctccacttgtacaaagaacggatatacagaacatatttgtatcgactgcggatataagtacattacggatttaacgccacttgcaaaacacgattacagaccgacagtaaccgcgcccacttgtaaaacaaaaggctttaccacatacaagtgcagaaattgtgatgatacctatgtcggcgattacaccgagccgcgcggtcataaatgggacgagggacacactgtaactaattcgacctgcgagagcgagggcgttatggaataccactgtaaacattgtgatgaaaagatgatacaggcaatttcagcgacaggacatacacccggaaaggctgctacctgtaccgaaccgcaaaagtgcgaaagctgcggcgctattcttgaactgccgacaggacacacctattccgaaacagtaacggagccgacttgtacagctatgggatttaccacatataattgtgagaattgcgaccattcatatatcggtaattatacggataagaccgaacacaagtataattcagttgtaactcccccgacctgtacggaaatgggatatacaacatatacttgcgaggattgcggcgacagctacatttcagattatacggataaaacagagcataaatataatgctgttgtaacttccccgacttgtacggaaatgggatatacaacatatacttgcgaggattgcggcgacagctataaatctgattatacggaggttcttcctcataattacaataagcagacgattaagcctacttgcacatcacagggctatacaatttacacttgccccgattgcggcaaggaatatatcggcgacgagcaggagccgacagagcataaatatattcccactgtaaccgcgccgacttgtacggaaatgggatatacaacttttacttgcgaggattgcggaaaatcgtatgtcgcggattacacggacgcgaaaggccataactatgaggaaaaaatcacaacttccacttgtacgggtataggatatacaacctttacttgtaaggactgcggaatttcatatatcggaaacgagcaggcaaagaccgctcacgattacgaaacaacagtaaccgcgcctacctgtacagaattgggctatacaacatacacctgtaaaaactgcggcgaaacatatagagccgacgaggtatcggcaaaaggacacaagatgtcagattggattattgacgttcccgctacgattgagaatgagggcagcaggcatattgaatgtacggattgcggtacagttttaaaaattgaggaaatcccccagcttaccgataaggacaattcggacgaggacggatattcaaaagtcggtgattatagtattctgattaccgataaggacagcaagcctgttttcaattcagaaatcagcattgacaaggacgataacatcacaattaagctgccggagggcagattgcttgactatgaggacagaacgacaattacggttgttcgtacagatacaaaggcagcggcagagggcttgaatatcaatatttcagacaagagcggcaacgccgcaacaggtcagacggacgcaggcggtcagcttattgttccgaataatcagagctcaacgggtaatgaaaacggcactatcggcggcgataacggcgaaacaaaatatacttatgttgttaccgttacagacaaaaacgataccgtcattcccgattgtgaaattcacataggcgataaccacgatattgtcgtaaaacttcccgacggtacggctatgaacagcgacaaccgcgttactgttacggtcaaagaccagaacggcgaagcaaaggaaaatgtaaacgtgattgtcataggcgacagcgactatatagaaaagggcgttacaaacgcaaacggtcaggctacattaccgaataaaaatcaggcgtacacggacaaaaacggtacggcgaatgtaaacggatatatcgtacttgtcgaagatgaaacggaaccggtatatatggcgcttgtaaccgttgacgataacggcgttatggtatgcctccccgacggtaaaaagattgattaccataaccgtacatctgtaattgtaaagacgaatgacggaaaagcggttgagggcgtaagcgtaaatgtctatgacaatgcaggcggcgacagaaccgagataacagacaaggacggaaaaatcactgttcctccgctgaatgaaaatataatcgagaataaaccgacgccggagcctactctgacaacaaaacccggacttgaaactcccgaaccgtcagagaagccggacgcaacagacgaaccgagcgcaacggataaaccgtcagaaacagaaaagccggacgcgacagagcagccgagcgaaacggaaaagccgaagcctaccgtaaatcccgataatggaagcgaggttgttactcccgattattcgtataaggtatctgtaaatgacaatgacggcgctgtaaacggcgcaatcgtcagtgttgataaagacaacggcagcgttacggttaagctccctgatgaaaagggtatcactcccgataacagaattattatcggaattacagacaaggacggaaaagctgtaaacggcgtacctgttaccgtaattgcaaaggacggaacggaagcaaaagaccttacaaacagtgagggcattgcgattgttcccccgacaagtacagaccgtacagacaaaaacggctatgcacaggttgttgagggagaaaagacatacaatgtcattgtcgaggacacaaaggcaaaaatcgaaaatgccgccgttgaggttaaggacggtaaaatcagcgttattcttcccgacggaaacaagctcaatacagataatcaaaccactgtaaccgtcagcggcaaggataatacagcggtcaaggatatttccgtaactgttaccgataaggataataagacagcgacaaaatcaaccgacgcaaacggtaaaatcactgtacccgtcaagacttcaacaggcggtggcggcggttcttcttcaggaggaagcggcggcagtagcggatatgtcaagccgtcatacactgtaaaggttgtcgataaggacggaaagaccgtcaatgtcaataagaccgtcaaggacgataaaatcactttgacgcttccgagcggcaaaactcttgacgataattattatacaattaccgtaacggataacaagggcaagacaacggcgggtattgatgttacgctcaaagacaagaataattccgtcagcggcgcaaccgacgcaaacggtcagcttattatgccgacaaacacgcataattcttatgtagtcggatatgaggacggagcctttaagcctgaaaataatatgacaagagcagaagcagctgccatattcgcccgtaatattgcagagcgtaagggcgaaaatatttcaagccgtaaatcatcatttaaggacgtatcaagcaaggattggtttaataactatatcgcctatcttgaaaagtacaaggtaatatccggctatgacgataagacatttaagccggacgaacatattacaagagccgaatttgtaacaatgtgtatgaggttctatgcgctggacgctaagacagtggcggcaaagaagaatatttttaatgatgtaccaaaatcacattgggcgtcaggttatatttacagcgctgttggtatgggctggataaacggatacagcgacagcacatttaagccggacagcaacatcacacgcgcggaggttgtaacgattgtaaaccgcgtaacaggacgcgccgccgatacggaatacatcaataagaatatgtcagccgtaaataaatttacagacctcaaagacaagtcatattgggcgttttatgaaatccttgaagcaagcaatacgcataataccgttgacggaaagagcggcgaaacttgggtaaaataattgtctgatttgtgtattgtgtttgttgaccggatatgatataatctttataatattttatatcgaaaggaaagaatattatggataaaaaattaaaaataattatagaaaactgtccccaaaatcataaatgccccgctgtcaatgtttgtcctgttggagcgttaagtcagaaagattttgaagcaccgataatagattatgacaagtgtatagggtgcggtaaatgttcaaatttctgtcctaaaaaagcattggtattataattggattatacataaggggtgtaaacggtggaggaacgcatagaaccgacaaatacggtacagactgaatttgacgagtggattataaacggtttggataaggcggaagaaataatccataaatcagatacagagaatattaagcaataagcggttgtttgaaaataaacagccgcttttttgttgcaaggagtgatgtctatacaggaagaaataaataaaaaaacagttgcgttagttataagcgcttccaaaatgacggggcgcgtattgcaggcggcaattcgtgaatacctaagacagcagcagaaaaataaaaacaagggctatcagggtaaacagacgattaagcagcttgtagagtcaggcgcggcgctttcaaatattgagataacgaataaaaatataaaatcttttgagccggtggcgaaaaagtacggacttgactatgctttgaaaaaggataattccacgaaaccgccgaagtacctcgtattcttcaagggtaaggatattgatgtcataaatatggcgtttcaggagtattcgcaaaagctgttacgggaaaaaccgtcaatccgtaaaatgttatctcaaatgcgcgagcttgcaaagactatcaatccgaaagaccgcgcccgccgcaaagaacaggagcgcgatatatgaggatagacaaaaggtttattcttttaaatatcccgtatcttctgttcttttggattgctgataagatatgctatatatacaggataacagagggtaataaaataatagcgttggttcagggaattgcggagttttacaaagctccgctttttttgttccacataatcgatatatcaatcggagtaatagccgcgcttctgattaagtgcgcagtttatgtcaggggtaaaaatgctaagaaataccgaaacggcattgaatacggttcggcgcgctggggtacggcgtcagacatagccccgtatattgacggacagaatttctataataatgttcttctcacgaatacggaacggcttacaatggacagccgcccgaagctgccgaagtacgcaagaaataagaatgttcttgtaatcggcggcagcggcagcggtaagacaaggtttttcataaaaccgaatttaatgcaaatgcacagcagctatgttgtaaccgatccgaaaggtacggttttaattgagtgcgggaagctgttacaaaaaggcggatatatcataaaaacatttaatacgataaatttcaaaaagagtatgaaatataatccgtttgagtacatacgcagcgaaaaggatattttgaagctcgttaatacccttattgcgaataccaaaggcgagggcgaaaagtcaagtgaggatttctgggttaaggctgaacgcctgtattattgcgccctcataggctatatttggtacgaagcgcccgacgaggaaaagaacatcataactcttttggatatgataaacgcgtcggaagcaaaagaggacgacgagaattataaaagccccgttgatttactctttgaccgtctggaagaaaaggaaccggagcatttcgcagtaaagcagtataagaaatacaaaatggcagccggcaagactgctaaaagtattttgatttcgtgcggcgcgagattagcgccgtttgacagtgcagcgacacgttgtcgcatataaactctgcgtgggattttcctgcaaagaggtaaaagtgacggaaaggctatagcctttctaactgatattccgagaagtggaatggcggggtaacgccctgaaacgcttcccttgatactgcgttggaagaaacgggacgtatttcccgcgactgacacagcacgctgaagtcggctgtctgcacccgcgactgtcccctttgggggataaagcaaagccgagccagaggtggccgggggtgttaggccggaggtctataaagtacctatgtccagaatgcggctgactaccgctgacaaaagcccgaatgtacaggtctataacgggatatggcagaaatgccatagccgtgaaaacggcgtatgtggggtaaagtaagatttgtcgatatgaaattccctatggtgttacaggcaccatcaggcatacaggcctaaagggcagggttaagggtattatgcaaagataggaatatcggaacgtggaaagccccggatgtggagtggatacgcatgatgaagcaatgggcgggaaaatcgtgccgccttttatgggaggtgcggtataaccgttcttaatccgggaggaaagagcagccatgctacctgtgaagccgtgaacaaagtaagcggtggagggacgggctgtagtcaggaacagaaacaaaatcatattcaataaacacgcataggttcgagtaggactaagaaaggcgaaaatccaaacgaaagtggggataagtaaccgactatggcaacaggaaaggcaaagaagaaagataagttaaggcacgccgagtattatgacttccaggcaattcaagataagctgtatgccgacagcaataaaggcaaagttttcaaacatctggttgaaatcattgcattacccgaaaacatacggctggcataccgcaacatcaagaagaaccacgggagtacgacgcccggcacagatggaaaaacaatcacagaattatcagcactctctgatgaacagcttatatgcgccatacagcgcaaattaaactggtatgtcccacaaagcgtccggcgggtagaaattccgaaaggaaatgacccaatgaagaagcgcccgctcggaataccgacgattatggacaggctgatacaacagtgcgtattgcaggtcatggagccgatatgtgaggcgaaattccacgaccacagttatggattccgccctaaccgaaaccaacagcacgcaatcgcccaggttcacaaaaatatgcagagaagcaatctccactatgtcgtagacatagatgttaaggggttctttgacaacgtgaaccacggaaaactgctgaaacagctctggacaatgggaatccaagacaagaagctgcttagtattatatcagctatgctaaaagcggaggtggccgggataggattcccggaggtgggtacgccgcagggaggtattatctctcccctgctatccaatgtagttctaaacgaattggattggtggcttgccagccaatgggaagaaataccaacggagttcccttacaaggaatcggtcaattacaacggaagcgtgagcaagagccataaatttgccgcactgcggaggacaaggctgaaagaagtcacctgcgtccgatacgctgatgattttaagatattcacgaacagctatcaaaatgcggtgaagttattccacgcaaccaaaagctggctccatgaaaggctttctcttgaaatcagtcctgaaaaatcgaaggtgattaacctgaaagagcagtattcagagtttcttggtttcaagttaaaggttatcccccgtgggaaacggagcaacggacgcgccaaatatgtagtagagagccatatcagagagaaatctattgcgaaaataaaaccaaacttaaaacggctgatttacgacattgagttcccgtcacaaggcaaacgtactgaatatcaggcgatttgccgctacaacgtttatgtaatgggaatccatgactactatcaattagccacaaaggtctgcgatgaccttacgccattcgccttatctgtccacaagagcctgcgggcaagactgaaagaacgggttaaaactgcaaaacaggtcagaaaaaggaagattccgtgtgaagttccgaaagttatcagggaacggtatgggaaaagcaaacagctccgatatgtagccggacacgcagttgtcccgattggctacatacggcacaagcccccaaagtccatgaaccgcaaaatcaattcctatatgcccgagggcagagccgaaatccataagaatctggacagaatcgacatgacggttcttcattacttaatgaggaacccggttctgtaccgtactatcgaatacaacgataacaggctttcactgtattcggcccaaatgggaaaatgcgccgtatctggcaaagtgctttctattggcgatattcattgccatcacaaagtgccacggtatttaggcggcaaggacaattatcaaaatctggtgttggtatgtgaagatgtacatcacctgattcatgctacaaaccctgatattatcagaaagtatatggaaatcctaggccttgaccaaaagcagaaagaaaaactcaataagttaagaagccttgtccacgttgagagttattgagatgaaataaattctgttcctgatggcaagccgggtgagctgaaaggttcatgcccggtttagggcgggggaaaatccggagataacatcaaaggattacctatcgctattacacctgtacccataccgaacacagaagttaagcttctcagcgctgaaaatacttggcgggtgactgcccgggaacataagacgctgccaaaacatatcagagcacttgaacgaaagttcaggtgctttttttatgctcgaacaaataatatattggattgctgtctctgcatctgaatgatgtgtgttatgagataccaataaattgttaagctgtgatggatagtgaccgcacttaaaaaagtgtgtatagtgtgtataatgaaactagcttgttatatcaaacctgcaatatcaattgtggctgtacttttgtttaatttatgatggaattaaatcatatatttatgaacggttttaaaatatgtatttgtatgaagtatgatatgtgcgaaatatttgtataacttttgtgagacatatgttatgatatttgtatattgaacactgcgtgtacaggtaatagctcacctaacgcggcgcataaatgcgccctaccgatgttcgcaaacacactttttttactctattatttatatatattgattagctttattttggttttaagtaatatagaattttattactatataatatacttttgtttattcaggtaacaagaaactaatattaataccaaaatcattaatattaaaagctgtgttatagtgaacatcggcagggcaaacgcaggttgccgcgttaggtgaaccatcatctgaacacgcagtgttcaatatacaaatatcacaacttatatgacacaaatgttatacaaatatagcatatatattatacttaataaaaatatcataacctatatgaaataatttgtatatttaaattatttttattagtgtagtttaatatataattagttatcccttatatagaatagcgggtttataaggtggaatatatatcatgtaaaactcatttgttttatgaatatatgctttattttatttcttaaaataattagtttagtttgcattcttcttatataaatcatataaaaaagatgtttattttattatatcattattcagacagagattttacttttataaattattgaaaaataaaaaatgtttattattttttatttttttgcttcattctatatattaaaaacgaatgaatattatttgaatatatactcaattctattaatttgtactggacctataaaaatattcttaatctggacctaaaaatatttacttgtttggtatataataaaataaaaaatattgttgggaggaaagaaaatgtttaagagattaggagctttagttatgtctgttatgatgttaggcagttcgatggctgccgcggcagctgctgatgtcaaccttgaaggatatccttctcaaaaaggatatgacccggaaactgtaatgtggactgataatccaattgaaaatgtattggcggagaccggaatttacggtaatgctgccgaagttaatccaaatgcagattcaaaaagtaatgtgagtatgcagaatccttatgcagctaatggcgataagtttacgggctgggcatattctgaattctgctggacaaattcgtatccgataggaaacggtcgcatggcgggtatggttgcaggaggaattgataaagaagttattcaaatcaacgaagatacttgttgggatgggtcaccgtatggaactctaaaagatgaaaacggaaacacacttacgaaaatttctcagactgccaatgcagaaaaaataagcgttgagaatccaaccagcggaagtatcaaggatgactggaagtatttccgcggtgcaaatgcggatggtactccggcggagatcggttcagctgatgcaatcgttggtgatgagacttttagaacaaagttccccgattttgctaataaaagtatttcatatcagtcactgaatatagataattcaaaagagcaacaggctgttcaggacagatggagtatggaaagaatggttgaggagactttcttaggaagtccaaacagacaaagagcatataaatcatttgttgaggtttatcttgattttggacagcaccatgaacaggctgaaaattatgttaagcgtcttgacatgaagacaggcgtagttactgttgagtatgattatcacggtgagcattataaacgtgaatcttttgcaagttaccctgaccaggttgttgcaactcatgttgagtcaactgaagaattaaatttcttagctgagttacatacatatcataatcaaaaaactgattactataagtatgaaaaaatcagtgacaatgaagttaaattgactgcttctgtttataatggaagcaaagacgacaatgaaccaggaactgtaaacgcaatcagatttgaagctcacatgtttttagacggagataaggacacaaggtttgcagttgcaaaagataatacttccgtttcagtagtggggggaaacagcgccgatatatatgttgtcggagctacaaattatgttgattatttaaatcttgacaatacaaagccgggtaaagattgtgacaaatattcagcaaatgttaagaagagaacatattcagagataaaagcaagacatatcgctgactttaaagaacagtttgacaaaaccgatcttactattcagaacgatactgaatacgcagatgaatatagtaatacacctacagaaaagcgtattcgtaaagatatagatggtaagtcgggatttttgaccggagctgactcaagtctggaaaaagctaatgcaaacggtgtttattcaacttattcggaaggtgataatcagctggcaacacttgattttaactatggaaagtatttgattatcagcggctcgagagcaggaagagaagctaccggcagtgacgagatagatatacctgagagccagccgcttaatctgacaggtaaatggaatgctgcgctttcagcttcctggaatggaaagtatacaattaatataaatacagagatgaattattgggccgcccagcctcttggacttgatgtgtgcgaacagccgcttatagatacgtttgacgacttggctcagagcggaagtataacggctgcatatcagtatggcattacaaatgacaggggagacgaccagtacaagcctggtgatccgtgggtaatgcatcataattatgacctttggagaggcacacagcctattgacaatgcaacggcaggtctttggccgacaggtggtgtttggctgcttgaccatgcttggcagtattataatttcaataaagatactgagtatttagcagaagtatatccttatatggttggagctgctaagttctttacacagtttttggttatagaccccaagacagggtacttagtaacagcggcttcatgctcgcctgagcagggcggagttcaaccgggaccggcaatggatacacagcttgtcagaaacctctatgatatggtacagaaagcgtcagaaatacttggaaagacaagtgaaaacgcagagcttcttgcaaagattaatgagcagatgccttcatcatatttagctgatgaaaaaggaaaaattgctccaaatattattgacgatgcaggtctgataagagaatgggtacgcggagacgtgagctttgatatttcaagcggaaatgcaacatggcaggttataaatccgtttacaaatgagaaaacaggtgtttatgatcatactgccagcaataatggtagtcacagacattgctcaaatttatgggaaatgtatcctggaacgcatttgagcgcgtatagtgaaaatgaaaatgagcaaaagatttttaaagcttttcaggattctacaacagcacgtggagccggttctggtcagggctggggagtagcatggagaatatctcttaatgcaagagctctttacggtgacacatcgtctaagatgcttgaacagttatttacaacaagaacatcaccgaatctctttgaccagcatccgaatttccaaatagacggaaactatggtattaccgcaggtgttatagaaatgcttatccaaagtcatgacggaactataaatctgcttccggcaattcctgaaagatggaagacaggttctttcaaaggatttaatacccgcgaaggcgcaaccgtagatttgaagtgggataacaatgttccaagagaggcagttatacacgctaaagagaataaggaaatgaaaattagaagcgagtatgctgcaaatgctgagatatttgacgcaaatggaaataaggtagaagctaaactcagcagtgataatactttattgtcatttacagctgccgaaggtcaggattatacaataaagaattttggaaatgaactgaatccaacatctgttcctgagccaacagaacagccgattaaaggaagcccggttccgagtaatactcctgtaccaacacttgcgcctaatgttccgcatgtttatgatataaatgcgtcttattatgagaatgataagttatgtgttgacgttacatataatggaacagagtcagagcctaaagcaaaggttttgattggtacatatgattctcagaatcaagaggaattaataaattcaagtgaatatgatataaccggctcaaatagatatgaatttgattacgctaagcctcaggatggtcaatttgtaaagatatatgtttgggatggaacaaattcaattacacctttaagcggtgttggaacaataggtgaaaagcctgttccgactatagagccgacaaacgctccaactgataagcctgtacctacaactgacccggcaagaaccattacggttgatggttcaaaagaatctgaacctgctgccggaacttataagacaattagagaagcggttgctgcagtttctgctaatccgccgtcaaatgaggaatcaagaatttatataaatgttgttcccggaacatatcgtgaacaggtagttataaatgttccttatataacattacagaaacagcctaattctcagggagaagttaagcttacatggtactatggaactaatactttgtatgacagctgtgatgagagcggatattacaatcctgatgtaattgacggaggggttaccaaaaacgctcctaaggattggggtccggccttagtggtaaaagaaaacggcgacaattttgcttgtgaaggtttgtatctcgaaaactcgtttaatgagtattacactcaggaggagttgaatgaatatatggctcctgccgaaggttcatttgacagaggagcatggcttaatgaacagctgaataacggtgtagatgacgaaacaataaacagctggattcagtcgcgttcacctataattaaggatacaaagccgagcttgagagaaagagcagccgcaataaatactaaggctgacagaatagtatttaaaaattgtaccattatgtctaagcaggatactatgggaataaacaacgacagaatttattttgaaaactgtaaaataggcggaactgttgattatatctgcggaagtgcgacggcagtattcaataattgtgagttatattggaatgccggaccaataaaggaaacttctaaatccacagacacagattcgggatatattacggcgccaagccagtcaacacaaaaaggttatgtattctataattgtaaggtaacgggctctgaaactgcaactgcaggagcatttggcagaccgtggaatccaaatggagaagcgatatatattaacactaaaattggcacaagctcacgaccgggatacaatgcaaagtcgttgataagtgaatccgggtgggcaacaatgagtgataatccgccggagaatgcaagatttggagagtttggctcaactgacataaagggttatcctatacaaatttcaggagatttaagacagagtaaattactggacgagtggacaatgcttgaatataatccttatagttatacatgcggtactgacggttgggatccgtcagggacagctgaggattataaatctgtaaacagcgttgctgaagcaactaacgttgaaattccggaaggaacgagcacagaggttgtgctcccgtctgctccaaacggttatgaatttagctgggcatctgagtctgaatatgctgtagtaagtgaagacggaacaaagattattgttacgagaccggccagcggtgagaaaccaatagaaaccgaaataattttgtatgttagaaatgctgacgcgaatgctattggaacaaaagcggttatacctgtaacaattaatccgacaacagataaagaaaatgtgtttgaagtaaacggtactgtaacaagtacgagcggagcgcctgaaacagatattcctatcagcgttaagctctataagggcaaggcagtgattaagacagcttctgcaataataaaggcgggaacaacttcggcgtcatataaggctgaaggtatacctgttggtgattataagctggttatagatgccgaaagctctgattataaggttacagtccctgcagacggcacggtagaaatatcgggggcaaaaggagatattaaaatggttgattcaagcgttggaaaattgacccataccgttttaaatattactactgacccaacagccataggaagcggagcttcagttgttaataataatggttcatatacagtttcaagcccaagcggaacttctgacggcgcatactggaatctttccaagttagcagagggagtaaaaacgagtgattcggttactgtttcatatactgtgacattctctgccgataagccttataagcaggatgatatgggatgtatgattgatgttctttcgggaataccgggaactttaaataagaatgctaatcctatacgcataaacagagttaacatgggtcgttgggatcagatgaatatgctcgactttgcccaggcgtcaagaagcggttcacaggataccgagcatcaatggctaaaatgtgccggagaaggtatagctaagaactcatataagccacagtcggtaaaagtagttacagactttaaaaaccgtgttatgacagcctctgctaaggttacagaggcggcaagctggaatgactatacgtttaccggattccctgaagaagctgatgttgaccgagagaatatgtgtctcgcagtatatccgggaagcgcaggtgcaaataattatgtcatcagtgatataacagttgagtttacagaatttaagtaagaagatattaaatatttcttcaataaaaattaacggattttgattcttttatatttattagaaagcgcagcgaaagctgcgctttcttactgtcggtaaagtttgaagcgtttagagatatgtgcaaaagccaatgttttaatccgcgcgtccgtgggcggataagaacgcattgtggtcccaggagttgttttcaaaacattttcctttcctcagcagtttttctaacagatgataatttgagggagctgcacattttgcacaatttttcgaaactgcttatcaatatactaaaagctcggctttagccgagctttatatcaaaatattaaaaatgataggcgaaagctagatgtgcacaccagtaatataaaataaaggttaagcagaggtggaaagctatctatttaagcagcgataaaagttatttgtctaaagagtgatgtggattttttgttttaatatctcctgctaataatataaaattgttaagctataaaaacattaggctgattagtttaaccaattttttttgttattcaaatctcatatttcacctgcgtatgattttgtttcatttggcatagtaagaaatccgtttttttggtatttatcaaacaagttttcaagcgctgatatatatgcttcgtaattcggtgaatcctcagaaatcatatatgaggcagattttaatctttgtataaatttttccttagtaaatttaagatcattttggaatactttctttttatacttagtatcaaagaagtttgaaacagccgaatccatattttttataccgccgctgaatccggtaaatccgggacaatatttttgacatatttccgcattttcttttatcattttattggatgaaactctggaattccagaccagtattacctttccgccgggttttaagattcttttgcattcagctttgaattttttatggtcaaaccaatgaaacgcctgacctactgttatatagtttacagaatagtcttcaagagcagtgttttccgcgcttcctttaacggagttaaatctttcatttcctccaagcagtttttcagccgtatttctcatatcatcgtttggttctacagctataactgtgcagcctatatccagtaattgggatgataaaatgccggttccggaaccaatatctgcaacgatggattctagacccaatcctgccgagttttttagatactgaataaattgttcagcgtatttaggtcgtgaagaggcgtagacagaagacttgccggtgaatttatttgtattgtccatattcatcctccttaatcctttttaacttctgctattatatcattagatatattgaatttcaattaccaagatagattcattaaaatcaaaaatatgaaaagtttctaaaaaattagttaagtttctaaaaaactattgctataatttgggttggcgtatataatataattctgagcgtcatatacatttaaaaggcgcaatatttaattgaaatttaaaggaggattttgctcgtgggtttaggttttatagaaatacttaagacgatattgctgggcattgttgaaggggtcacagaatggcttccgataagcagtaccggacatatgatactgtttgatgaattcattcatttaaatgtaactcctgagtttaaagaaatatttttggttgttatacagctcggcgcgattcttgcggtcgtggtaatgttttggaaaactattttcccatttcattttaaaggcggctttggagtagataaagagaagataataatgtggcttaaaattttggtagcgtctattcctgccgggattataggtatcctgtttgacgattattttaacgcttggttctataattactggactgttgcaataatgcttatcgtattcggtattctatttatatggatagaaaatgcgcataagaataagcttccgaaagtgaatgatatttctgaaattacatataaagccgcgtttataataggagtattccagcttattgcggcagtatttccggggacttcacgctcaggcgcaacgataataggtgcccttcttttgggcatctcaagaacaaccgccgctgagtttactttcttcctggctataccggccatgttcggaggaagcgcaataaagcttgcaaaattcgggatggcatttacctcaagcgaaattataattctgattttaggaatggcggttgcgtttgtggtatcaatgctgtcaataaaattccttatgaattatgttaaaaaacatgactttaaagtgtttggctggtatcgtatagttttaggcgctcttgtgattgcatactttttgttctttggcgcttgattatgttttggtattgttataaaataattagatatgaaagtgagatataaaaaagacctcgctgtgtattgagctaactctcaaaagttagatttttggtctaacttttggaagatcggttcatacagcgggtctttttttagtggtaagatgtttttaatatgttgtaatatagccatattctcgttctatataatgttctccgcattacatgacgagtgtcttcggatatatgacaattttagtcttcggtaccaaattttaagctgatgagccaaattattctttggaaccaaatttcatgttattataatacttttttaattttcttcactgtctgagagtttctgaggtatagaaatgaaaactattacattgtcattttcgtttgaatattttataataccattcatgtctttgacagctttcttaacgctttttatgccataaccgtgctcagaagaattttctttgtcggttttacagttgtcagggtcaaataacagacctttgacagttgaatttttaactataaattttatcattccggcgtcgctgtgtatgtgaagagaaacttcttttgcttcggatttatcagcggcttcaattgcgttatcaagaatattaaaaagtattgtagtgatgtttgaagaacttacagttatatcgtgtccaagttccatatctatcttaaagttgatattctttaattttgcctttttaatttctatgtttatgatagaatctatggtttgattttgggtatatactacaaaggtatcagaatagtttttgtttttgatatctgaaagatgagttaaagcggtgtctgtatctccatttttaaccagcgaatatacaatatccaaatgtttgcgtatatcatgttttaaacgtcgaatttctttttcattttctttgagtagagtatagttcttgttgtaatgctctatagttttttgagcaatgccatactttaattgcgcagaataggtttcaaacaaatcaaatatggcgacattgatatacacaagacctatgtatggtataactaacagtgcatagttggtaaattgtgatttcatcaatatagcgtcaataataacaacaattaatatagttactaaaggacaaagtataattagtatccaatacttaataggaagattgcgttgttttttaataaacactttaatcattggaaaagccaaacacagcgttagtattgttgtagagcatgcagctaatattagtgaaaagtcggtatttaatatatctgaatatgtatcatcaaatagttgagataatataagcagtgtagccatttgcgaaattatataacaaacgtaatatattactactacagctatttttttagttgctttatcctcaaatgagaaaaaacagaatgttgtataacaaattattgaaattattaaattagcgttactatttaaatgaaatgttgaagtaaaacacaatattaaaaatggtataagtgcccccaaaaaagataaaacagaaaactttttgaatttaaaagcatagttaaaaataatagttaaggctataaattcaataataactatagatatatcaagtataaggctcattataacattccctctttaacactatatttaaaatattggttctcaaaatcttctctatatgatttacctattggtacaacttctttgtttatcataacagcctgcgtttttgaaacagagaatatattttttaggttaatagcaaatcctttatgtacacgaacgatataatcgcagtctaatgtgtcaaacaaatcagaaaaagttgaacgtatagtaaaatctttatctagcaaatgtatacataaactattatgacacgattcaatatatacaatatcatttaaaagaatattgtaatgtattccattattaactatctgcactttattattgtttttaaagtattcatttataattatctctatttcattgcttaattcttcgatagttgctgttttaagtatgtatctgtcaattccatatttgtaaccgttgacagcgtaaccgtcataatgagtatacgcaacaactatacagttctttgaacgtgtttttaaaatccttgtagcattaagaccgtctaatccttcaacttctatatcaactaaagcaatatcaaatacttggctgcaatttaaaaaatcatctgctgtagagcagactgttaaacttacattatatttgcttaatactatgcgtaatttgtcaatatatatattttcatcttcataaattaaaacattcataaatgctctcctaacttcataaaatattatatatcacacatgcgaaagtgtcaaccaatgtaaaaagtcataaatgtggataattttttaaacgttatgaaaaaactattttatgataattcaaatatcgacaaaattaaaaatttgtggaaaatgaataaatgagtgaaaataattttggtaaaatttaccaggaaagttgttgccgaaaattcatttataccataaaataagtttacgtcccagtatattgattttaatatgccgatactttataatttaattagagaaaaatgttgaaaaaagttacccgcagaaatgggaggaagcaaattgatagaaagcatttctaaaagactgacaaatttttttgtaagaaatggtttaatcaaagaatatgacagtgaaatatattcttacggctttgaaatgtttgtttccgaaataataagctggctgattataatacctatagcaattatatcaggtgaatttttagaaagtatggccttcgtattcagttttattattttcagaacatttggcggtggttatcatgcaaacacccattatggatgtattattagttttacttttatatatttgatagggttatttgttggtaaaactatttcaaccggtatttctttttacttaataggggcgtgcctaacagcagcggggattttgctttggatatttgctcctatagaccataagaacaaaccgtttgacgaaaatgattttaagcgtcttcgcaaaaaaacaaggctgctatacttaatttatttggcagttgttatacttttattaagtattttcccatcagttaagtttgttgttaagctttgtgcatttggaagtatggggttgtttatggtatctatgtcggtcatgattcaattctttgtgagaaaaaaagaaaaagttaattcaatataaatttaaaaaggagagaaaaatcatgaataagttaaaacaatttatgtaccgatttggtggaactatctgcgctattgcggctttcatggctgtatatacagatggaagatgtggttggaaaatatatcagccaaaggcaccagcaaatttgcgggagtttgctgagagacaatgaaaacacaaaatatattttaattaggactgtggcagatgttattttttacatcgttacagtcctaatttttttattttaaatttttatagcaaagggagagtattgtggtatgggacaaaatcaaaaattgctgagtatagcgcttattatagctatattagcgggaatggtaaatttcgtatatgtgtttgccgagaatgaaggacaagcagagagtggctcacaagcgtcaacaggtggatttgaaatcagcgttaatgaatctaaagattttgatgaaaatgcagatattgaagattttgataatttaggggaaaaaccgacagaagctccgacagaaaatactagtaaagatttttcaactgaggatgttcaaccatcggcggttccttctccaaaagtatcagaagttacagagcaagatgaaactttaataactaataacattcaagaatctaaccaaaatgaacaggggtctgttttggtgcttaattctgttgtccggtattctgttgtgagcggtttaaaccacagtttgcgtataagcgacggaaaggttcaggcatatggtgacaacacctgcggacagcttggaaccgggaataatgagccgacaaatgattttgttgatgtgacgggtgcttggggagataaaactgttgcacaggttgaaacaaggggaaatacttcatatgcgctgacttctgacggatatttatatgcctggggagacaattcaaaaggacaatttggaaacggaacaaatgtaagcagtaatctgcctgttcttgcagccgttggaatggaaggcagcattaaaaagatttctgcagggcttgaacatgctgttattgaaaacagcgagaatggcacaaaaatatatgcgtttggggataatagttacggtcagcttggctccggaactgacagttctaattctttagtaccaatacttgttacagatttttcagaactatctgaagtgggagattaccagacatactacagcggtacagacagtgagataatcggctgcggaaaaaatgataaaggtcagcttggaagttcagtggacgcagagggaaatatgatttgctttaccaaaatttcagcgggtaaagaccatgttgttggaataggaataaatggaaagatgtatgtttggggtgacaacagtttgggtcagcttggtgttaatctgcagagcggcggaacatattcccaatatccaattaataccggtatagatgtaacggatgttgaagccggaaataatatgacgctgtatatctcaaacggtaaagtgtatttggacggaacaaatgatattggagttcaaatgtggccaaaagaaataaatttgcctgctgactgtgcttcaattgccttaggaagcaatagctatgcgtatcaaagtgacggaactttttggcactggggatatatgagtgaatataacgttggcaccggagacagtgtaaatccaataatgagtgagtataaatacgatattgtggatattgactcatacagggcgcaaaccttagctatagatacggcagggagcatagtcgcatggggtgaaggatattatcctgatgaaaccgggagtatgagtaaagtatcgtatccttataatgttgatgaaaaatgtgaaatcaaaaatgcggtaagtgtttccagaggaaaaaaccataatctagtgcttgatgaaaacggagacgtttggtgttggggaagcaactcaaattatcctatgggttcacttgacggaaaagttaagataataaaaaaattgcctggtattactgatgttaaacagattaaaggcggcacagagttcagtctgtttattaagaatgatggaacgttatggggcgttggcaaaaatgataaaggtcagttgggtatatctccggaggaacttaataatactgatattccaatacaaatcacggataaagccgactttaagtatgtgaccgcatgtgaaaattctgtaatcgctattgcggatgatggcgtgtattcttggggcggcaattctaagggtcagttgggagacggtacattctcggataacccgtcgccgaaaaaactgaacattagtcttgaagatggtgaatacataaaggatgtaaaaacaggaccgcagcattgtattgctttaacaagtatgggcaatgtatacgcctggggcaataacggcgtagggcagttgggaataggaaacaaagataataaatcaactgcagtaaaggttaatttgtcagatgtaaaatatgtaaatgcagggttttatcagagctacgcaataaagtcggacggaactgtttggggctggggaagcggagcaaatcatcagcttggtactgtgtccgttggtacatgcagggttccgacacaaattacaagtttgaatggtttaaatattgagaagattgtcggttctgacggatttacaattgcggttgataagtatggaaggatgtactcgtttggctcaaatgcagttgggggattgggtgtatattcacagacacctgaaatagttgctgaggattattatgctgaagatttgagagagctaaataaatatatgaaagatattccgcagaacctgactgaaaacatacagctgccggtcatgatgcagaatggaatgcaagtatcctggacaagcagcaatgctttttatctttcagaacagggaagcgtgcgaagaccaaacagttatgcaaaagatgaaaaggtaacgctgaccgctcttgtttcctacggagaagtaataagagagcttaaatatgatttctgcgttttaaaaaaggaggagggacagccgggagataaaacgttgaaaactcagaccttaaatattgaaaaaggaaaaaaatacataattaatatcaccgctaaaaatgctactcaaataagcggaactgagtttgagtttgagtatgatggaagtcgttttgaaatggtggatgcaatatcacgatcgaaaacattcgaaacgcttagcggagctgtatatggtgatataaaaatcacgtatgccggaccgggaatcataaaatttgagacaacaaaacaaataccggccggcaggcagttcacaggatttgtaaacggaatagtcttaaaagccaaagaaacctgcgaaactgtttgttcattgttatattaggaggggcggagtatgaaaaagaaaattattattttaggaatatgtttagttcttgcagcggggactgttgcagcagtggcaagcggtgcgtataataatcaaaatatagatataaaatcagcattgtcaaaagtattttcatctgagaaatctgaaaaaagtttagttcagaaagacagtgtgcagacagattcaatatctttaaatgatgatcaaaataaatctgttataagtacggatttatcagataaggccatcgcactatacccatccaacttttattccatggttgagatattgaaatcaaatatttcagatactgaaagtatagctgatattttggcatcttatttatatttaagagatatttatggtcttaataatgaacagcttgagtatatagccggtcttattaccaatggagccgacccaaacagtatattagacatagcatacttttgggctgacacttgtgaagatataaccataattgaacagatatataataaaaaaggcgattatgaaggcgggcgtttttggattgagaatgcttataataatattacaaaaaatgttcatggggttttaaaatctgaggaaataaataattatctttctttgggagtaactgtttcagatatacagaacgcaaatactttgagccgcaaaggagtttattcaattaagcaaattttagacagaattgccggcggagatacaatgataaacattataaacgaagtatatggcacaagcataagtcagccggtcagcttgtttggaataagtgaaaatgaaaaatctgacgagagtatattgaacagcaaagagcttgcggcgcttgagaataaacagattgaggaatctgcttcagagattttatccgatgagaaaacagctgaaagactggtggaaaaaagaaatgaaaaaaatgcggaactggtaaaacagctgataaatgagggaatattagaagggagaatagataaagatttgggggttgtgtttgatgaataagataaaatgcagattaataatatgtatagtgtcaatattagtaagtatgataggaatcacatgttatgcgtcaacgtcagatgagttgtatgaacaatcgttaacccaaaacttgatagagcagtacggagcggattatgaaactccatttatagctcctggcggcaacgtgtcgctgagtgacggaaatgttaatataaatgaggtggatatgagtctgccaggaagaaatggtatggatgttaatattaggcgtactcattatgtaaacggcggacctgtcagttacagcggcacaagagtatttgccagagggggaagcgttcaaacaagtccgatgtatgtgtttacatatgttttaaacggtaattcaaagacaatatatgtagcgtttgataaagaggaggatttggtagacagtttttatgccgagtcttcaaaattaaatacaattgagactgacgccataggtaaaaaatattataaatactcaactataaaggatacatccggagtattgttcactagagataaaagtaaggctgcagtaaaaatgagcgaagtacctaatgagttttatacaaccacagtgcatgctaccgatattgaaataggttatggctggtatgtgtcaatgccgcagttgactttggtaaacaagtcagaacaagcctctgatatgaaatataagtatttatttaaagatgaaaacggtcagacaatgaatttttcatatttgaaagaagaatcgaaagattcaggctggatatataaaccgggaagctgtaaagtttcagattcagacagccaatatacagctcaggtatatgacgaacttcagacgcatagtttaggatttaactatgatataacaataacagacggtgaggggaagacatattattacgaacaaaccttgaaaacatactttttacctgccgcaattatcgataggtacggcaatgccgtccgttatacttcgaacgctgacggaagcgtgacgatagttgatacttatggcagaaatatacacgtgtcgcaggcaggtataactgtctcaaatgggaactttactaagagcgtagaatacagcctctcaagggtaaacagtgacagagacccatacggtctgctggattgttattcgaaatatattttaaatgttaagaagtataatggcgtttcttatgagactacagaatacgtatcgcataagagtacaatgctttttgtcaggagcggtgaagtaagttattatgataaaattgagaaggttacatttccgacaaatgcttcggtagagtatgaatacgaaactgttccaacagttaaaaagtttgcttccagtattggggcgaatgtggtttcgcattgtgattatcatataaataaagaaaaagtatatgaagacggcagtgaaaaatatgaaagaacatattcgtttgaacaagcttcccagaaaagttatgtagataataaagaacgcagtgttacagttgaggacacatatgacgacggaagtaaaaaaagtatgacttatagttatgattatgccggcagattgtttgagaaaagcggacaaattgaaggcaaaaaatatacagaagaatataagtattcctatacttctcagaatcttttatcatcaattccggaagaaaatatgctgaaatacagaaaggcatatttgaagagcaccattactgcctatgacaataacatggtaaatatagcttataatgagtataacagcagaaatcttcctacgtatactatgaacggagagttagagtcattatatacatatgataataattatggtatattattatcaaaggaatatcaaaaagacagcaatactaaaatgaaagtaagtaataccataaccgcggacggaaaaagtatcttaaagtcagaagtttttgaaaacggctctcaaaagacagttacttcatatacatataatagtgatggcaccgtagcaagccaaattgtcacaccgacagtcggagaaccgcttactacagagtttggatatacatataatcctgacggctcattcagcataacgacaaccgttaataacgttaaggataatgacggcagcagtaagtcggtgacaacggtgcagaattatgactggctgggaaacttaacatcgtctgttgacgctatggggaatacaactgtatattggtatgataacctaggaagggtaatcagacaaataaatcctgatgaaacatataagaaaatagactataacgtttctgacaacagcgttacggttactaatgaaaacggatatgcaacaaccaaagattattctccgcttggctatatggataagatttattttgataatgatttaaacaagctggctgcagagtataaatacgataaccacggcagaaaaataagcgaaacagcatatcaggatatcggaggaaaggctgtaaaggaaaattatacttatgaccagttcgacagaataaagactcaaaccagcaaagaggatgatacagttttagataaaatcaactatcagtatagttatggagagggataccaaagtttgggtgagggaattaatatagtaaacgttccttctaacgccaaaaagctaacagttttattctacagcaaatcatcgaggaactatgatgcagctgttcaggacgacaacagcgtatatttttccgaaaatatgacatacggtaaaacaaaaggaaccgttgtcgatgtgacagggttgtcccaaataagaatttcggcgggatacagcggagcatattataaattcctgaccgatgaagagactgctcagaatataaacctgctgggcggagcaagccaaacggttacagcgacatatacaggggatgaaacatatgtgaaaccgacagttgaaactgtattggacggatttggaaataaagtgtcagagacttactataagcacggaaccgatacagtgctgaacaaaaacacatataagtacgactatgccgggaatgtgacggagactcttggcggacgaacttatatggagaatttgggaagctatacaagcaaagctgaatataattatatgggtaagcccactaaagtatatcagacggacggtagttatgtaaccgctgagtatgatgattacggaaatgctctgacaagcacagactatgaaggcaatacaacaacggtatgttatgatatactgggaagagcaatagcctgcgaagcgccgtttgatgaaacgacaaccacaaaaagcctgacatattatgacgcaaacggaaacgtgataaaaacaaagcagcaggtgacggcttcaagttatactgagacagaaaacgagtatgacaaccgcaacaggctggtatcggtgaagataaacgatggtgagcgggacatatatacgcagtatgcgtatgacggagcagggaatgtgataaaaatggtaaccggtcagacaagcaagatagaagatttgtatggaaccctgccggaagaagcaacgtatcaaacttatgagtatgacagatttggaaatgtgacaaaagctacagacgcactgggacaggacgtaataagtgaatataacctaatgggactgccgaccaaacaaacggacaaaaatggaaatgaaacagtaaatacgtataatgcgtatggaagcgttctgacgagcaaggtgacaggagacgaagatataatcaatacatacagcaagaataatcttcttatatcaaccaaacaaggaaaggaagagataaaatacacctatgacgattatggctatatgaaaacagaaagccaagggaatattcagaatacatatagttatgacgtaaacggaaacaggaaaaattatacacaaaaagcaggaacaaacacaatactgacagggtcatatacatatgacatattggacagactgacagaaatagattacggaacagtaagcgcgggatatatgtataatgcgaatggaaggctaacaaaggagacaagaggaaatataacaagcgagtatacatataacaaagccggattggtgacagagatgaaaaatagttcaggtcagagctatacatacagctataacttggcaggaaatcaaactgtaaaagcgtcgggacaggagataacaaactatggatatgatggaataggacagctgataactgaaaatgtagtttcgcccaaagaagatgaatgggattataataatacatattatcagtatgagcgcgcagtcgcggaaaagataaatataaaggtattataacaaattgttgcatatatgttcacgctgcgcgtgatatgatggctcacctaacgaggtgtgcttgcgcacaccctcccgaagttcactaaaaaactcagcatataagaaaatattttaaataaaaagttatatatatataatttcggtatagcaagcatcggtagggcagatgtaatctgccgcgtaaggcgcgcagtcgcggaaaagataaatataaaggtattataacaaattgttgcatatatgttcacgctgcgcgtgatatgatggctcacctaacgagacgcgcaagcgcgtcctcccgaagttcactaaaaaaactcagcatataagaaaatattttaaaataaaaaattatataaaattttggtatggcaagcatcggcagatgtggtcgcaatccagacgtgattcgctggaaactcgatgtaaattaatgataaatattataatttaatcattaatttggaaccacagcagcgcgcggcgcgcaagtatatttataataaattatttgccttattaacaaaatagccgaaaatgtttatatcctctcgctttaaagtgaaaaatctattgcaaaatggttttaataatagtataattactttgtttaagatatttaatttgaaaatcagaggtattgccttatggaaaaagaagtatttactgttaatttggaaaaagtaatacgtgaaatgaaattggatagactttattatccaaataaagaagttttgattgatacagccgaccttaacagacccggcttgcagataacaggatttttcgattattttgacccgagccgtattcaggtttttggtatggtcgagaatacgtatctcgccggattgtcttctgaggttcgttacaatagtcttaaaagactttttgaaaaacaaatatcagccgtcattttgactagaaacagtaatgcttctgccgagatgctgaaacttgctgaggagtttgaaacgccggtgctgagaacttctcagcctacatcgtcttttacaagttcgctaaacgcatatcttaacgtggaacttgcccctagaatcactcggcacggcgtgttggtcgaagtatacggtcagggagtgcttatattgggtgaaagcggagttggtaagagcgagactgcggttgagcttattaagagggggcacaggcttgtggctgacgacgccgttgagataaaaaaggtttcctcaaaatcgctgattggcgtgtctcctgatataatcagacactttattgagataagaggtataggaatcgtggatgttaaaaatatctttggtatgggcgctgtcaaggagtctgaaaaaattgatatgataatacatcttgaggcctgggaaaagggaaaacagtatgaccggctggggcttgtggatgaatacaccaatattctgggcttggatattccgtctcttactattccggtaaagcccggcagaaacttagccgttattttcgaggttgcggctatgaataacagacagaaacgtatgggttataatgcggctgaagagcttaacagaagaataactgatcaaatcagtcattttgattgataaattgctatggaggtaattatatttgaaagttttagttgatacacatactcacacaaactgcagcaatcatgcttttggaactatatgggaaaatatgaagtgcgcaaaggcaaaggggcttgaaatggtttgtatgaccaaccatgccccggcgattccggattcccctcatatttggcattttaacacaatgaaggaattgcccgaatatattgagggtgtgagactgctttgcggctgcgaggcaaatatcctgaattctgacggtgagattgatatgcctgttcagtatttaaaatctatggatgttgttgtcgcttcaattcatccgccgtgttatgagtctaaagacttgccggaccataccgagacatggctgaacgtggtgaagaatccgtatgttaatatcatgggacacagcggcgacccgcgttttccgtatgatattgacgctgttgtgagggcggccaaagaaaataataagtgtattgagattaataaccattcgtatgcggtgcgcaaaggcagcgctgagaattgcagaaagattgctgaaaagtgtatggaagtcggatgcaggattgttttaagctcagatgcgcacagtccgtttgatgttgggaatgttgaaaacgggataaagatgctggaggagataaactttcctgaagaattggttatgaacacaagtgctgacagatttatcggctatttaaggtcggttggaaaagatattgtattgtaagacataatattggagggaacgatgaataacatgattataaccctggcaaaaggtatcgtcggggaatcaaatgttaagacagatgagccgatgagctctcacacgactttcagggttggcggagcggcggatttatatattactcctcagaatgagagccagcttgcttcgcttatcaagcttttcaggcagtttaaggttgagtttcatgtaatcggcaacggttcaaatcttcttgtgggagacaggggcgtcaggggagcggttattgaaataggaagaaatctgagcagtattgaagtttctaaaaatatggtaaccgcacagtcgggagttctgctttccaggcttgcaaattcggcggcaggcaatggtcttgcagggcttgagtttgcgtcgggtatacctggctctttcggcggagctatatacatgaatgccggagcttacggcggtgaaatgaaggacattataacagaagtagtttatcttgatgaaaactgtaaaatttgcaccgtgagcggcgaagactgcggttttggctacagaaagagtatgtttacagacagcggcaagattatactgcgcggaacgctcaggcttgaacctgatgaaattgatgaaataaaggcaagaatgcaggaacttacccgcagaagggttgagaaacagccggtagacaaagccagcgcaggaagcacgtttaaacgtcctgagggatactatgccgcggcgctgatagaagaatcggggctaaaaggatattcgtacggcggcgcttcagtttcggagaaacatgccggatttgttgttaacaatggaaatgctacggctgaagacgtgcggaatgtaataaaacatgttcagaaaacagttaaagaaaagtttggggttgacctaaatacagaggttaagtttttgggtgaattctaaagtctaaggagcagaaaagtgaaaattttaattgttacagggctcagcggagccggaaaaactcaggtgattaaggcgcttgaagatattggtttttattgtgttgacaatatgccgccggagcttataccaaagtttgctgagatatgccataaggcgacagaaaaaatggataatatagctattgtcaccgatatcagaggcggcgatatgttcggcgagctgtcagaagctataggcgagctcgaggagcttgggtttgagtgtgaaatactgtttttagaggcttcaaacgagactttgataaaaaggtataaggaaactaggcgcctgcatcccagcgccggcggaggcaggataattgacggtattaacaaagagcgcgttctgctgagcgacgctaagtcgaaagcggcgcatataattgatacgtccgacttgtcggcatcccagctgaaagctcagataaaatctatgttcagttcaaaagaggatttgggactgattattaatgttatgtcatttggtttcaaatatggtctgcctatggattctgatttggtgtttgacgtaaggtttcttccaaatccgttttatattcctgagctgaaagaaaaaacaggtcttcaaacctgcgttcacgattatgttatggagtttgatgaaagcaagaagtttttgaaaatgctgacggatatggtgtcgtttctgatacctgaatatatcaaagagggaaagagtcagctggtaatatcggtcggctgtacaggggggcaccacagaagcgttacccttgcggaagagctttataaattcctaaaaaagagcggtaataacgtaactgttacacacagagatattaagaaggggatatagccgcggctatatgtatcgtattatggcggtttcaaaatatgaaaatttcaaaaaaacaaacagcaccgggtttaatcccaaaatagtttctgtcggcggcggtacaggattatcggcaatgctgagaggtataaaaaaatatacttccgatataacggcagtagtcactgtggctgatgacggcggcggaagcggcgttttgagggaggatcttaaaatgcctccgccgggagatataagaaactgtattctcgccctctcagaggttgagcctataatggaaaaaatgcttatgtacaggtttgacagcggtctgcttgaagggcaaagttttggcaaccttttggttgcggctatgacaggaatcttcagtggagattttgttgaggctgtccgaaacgtctgcaaggttctgaacataaccggaaaagtgttcccggttacggcttctgacgtagagttggtggcaacgcttgaaaacggacaaactgtggtgggggagtccagaataggaagttcggtgagtgaccataacagccacataaaaaaagtgcgtttgcgttctaaatctgattatatgatgcctgttgagccgctgaaagaaattttagacgaggtgcggaaagcggaccttataacactgggtcccggcagtttatatacgagtgtgctcccgaatttggtaatcggtgatttaaaggacgcaataatggagtctaaagcgcctgttgtatatataaataatataatgacccagcccggcgagactgatgaatatacggcttttgaccatgtgctggctatattggatcatacatatgacagctttattgattattgtattgtgaacacaggaaaaataagcggagcgcttctcgaaaagtatgctgatgacggctcgtgtcctgtggcttatgataaggaacgtttcggttctacagatataaccgtggtagaaagggatttgtccactgtggacggcaatggttttgtccgccatgatataaacgttttggcggatacgctgcttgatataattaatataaacaggaacgagcaggggcttaaagtcagttctgaaggcgttttgttatataaccctaaaacacggcggaggtgatagttgtggataagtttggttgtgttaaatctttttcaagacgtgttaaagaggaaatatacagaacagaggttgttgaccagtgctgtataatggcaagattttcaggccttattctattcggagcgaatattatcagcaaaaacgagataaaatttgtaaccgacaatcaggatgttatgggcagttttgtagagctttcacgcctgcttgggatagaagctgatgtgaaacaggtaagcgataaaaattttaaatacacagcttcaatatcagataatgtaaaaatagcccaattgttatatgatttggatttgctgaacagccttacaggagacgttaactaccatgtcagccgcagtatagtgaaaaggccgtgctgtaaacgggaatttttaagaggtgcatttttgggagcgggtacggtcagcgacccgatgaaaaattataattttgaaattgtgacctcaaagtttttgctttgtgacgaacttataaacctgtttatggaaatggattttaagtttcataggatagagagaaaaaacaagtatgtcgcatatgttaaaaacagcgagataatagcagacatactctcatttttgggagcgtataagtctcagatggagcttattaatattaagatagaaaaagagataagaaacgatgttaacagaagcgccaacggggagacgtcaaatttgtcaaggactataaacgcgtctgtggaacagatttgcgcgattcagaaaatacagaaaatgacaggtcttgacagtttgcctgacgacctgcgcgagattgcgattctgcgtttggaaaatccggatttgagcttaaccgagcttggcggacttttaaaccctccgctaaccaaatcgggcgttaatcacaggatgaaaaaaatactggcgtttgccggaaactagatactaaatatataaaataaatactcagccttcaaaaactgttttggtttttgagggctttttatattataaaaagaaaggacccctttcgccggacgcttgaaagacgaaagggggtggagcttaatatgtttgttttgtttagaaagttatagaagaattatgattatggtttaatatttactcctcttcgcggatggtctttactccaaacatgagttttaggattcctctgataacctttgggggttttataacaacgatttgcatatgtattgctcctttataatatatttaggtttgataacctataaaacgaattcacttcttttgtttatttgcatatgaatttaactcccgcacaaatgagtgcgataccgaataaagctataaggaggtaggtcgggattatttgtgctaagaatacgcccactcccagagcgacaagaaccggacccagtattgatatgctgtttttctttttgcagcagggcctttttctgaacatttttaacacctcatctctaacttgcctcagtataatatattcaaaaatcaaaatttggttacgaacctgaattttatcaatcatattcttgtctgtttctgcatatcatctaacaaatgattcatgccggtctaccaaagttttaaggaggaaacaataatgcgagataacttgtacaatgacattgcactcaggacacagggggatatttatataggggtggttggcccggtaagaacgggaaaatccacctttataaaacgttttatggatctgttggttctgcccaatatcggaaacgactacaaaagggaacgtgcaatggacgaactgccccaatcggcagcgggaaaaatgataatgaccactgaaccaaaattcataccaaatgaggcggcacagataaccgtgggagaccacgccaatctgaaagtcagaatgattgactgcgtgggatatatagttcccagcgctttgggtcatattgaaaacgagatgccgagaatggtgatgacgccgtggtctgctaatcctatgcagtttgagcaggcagctgaaataggaacgcggaaggttatatcggagcactcgactgtaggggttgttgtcactacagacggaagcataaccgagatacccagagaagattatgttggagccgaggagcgtgttataaacgagcttcttgctttaaacaagccttttgttatccttcttaattccgctcatccggacgcaaaggaaacaaaagaattggcaaaacaaatgcagggaaaatacaatgcgacagtaataccggcgaattgttcagaattaaatgaagaagatatcaacaatattatggaaaaaatgctgtatgaatttcctcttatggaactctctgtgtcagttccggcttgggttagttctatggataacacaaatatttctgaagatatttacagcgccattgaaaacgctgaaaagatatcagacgtagatatgattcctaaaatattaaaggaagaatgcgagtttgtggattcagctcagattgttgaaatcaaccctggatatggagaggcaaggattgaggtttcggttcctgacagtctgttctataagacgcttaacgaaaggtcaggattaaacatcaatgataagcaggctttacttaaagagatagaagccctgtcaaagatgaaaaaggaataccagaaagttgcgtatgctttgggcgaagtagaccgaaagggctatggaatcgtatacccatcaatagatgagctgactctcgacgagcctgaaataatcaagcagggaagccggtttggagtaagactcaaggcgagcgcaacatctgttcatatgataaaagctgatataaagacagaggtaagcccgctggtcggaacagagagacagtctgaagaacttgtagaatatctgatgagcgagtttgagagcgacccaaaacagatttggcagtcaaatatattcggaaagtcgctgcatgaacttgttaacgagggtctgcacaataaactgtcgaaaatgcctgacgacgcccagcaaaagctcagagaaactttggagcgtattatcaacgagggcagcggcggcctgatttgtataattttatagtttaacaatataaaccaaatgatgagttatagactttaacgtccttgactcatctttttttatggaggtatattatgcttgcttttataaattctgtactacagtcattaatattgcttatatcatatatttcaaaccacaactcttttccaaaaccgctgtccaaagaggaggaggcggaatgcctgaggcttatggcggaaggagacgaggaggcaaaaaataaacttattgaacataacctgagactggtggctcatgtggcaaaaaaatattcgtcgtcaaccgcgtgcgccagcgacagcgaagacttattgtccataggaacgatagggcttatcaagggaataaacagttttgacgcctcaaaaggcactaagcttgcaacatacgctgcacgatgtgttgaaaatgagatacttatgatgttaagaagcaggaagaagaaccaaaatgacgtgtcgctcaacgactctatcggtactgataaagagggcaacgccattatgcttatggacgttatagaaaatgacgacgaggatatttttgaagagatacagtcgggcgatagaataaagactttatataaaaacattaaatataaccttacgccgagagaacgcaagataatcactctgagatatggactgatagacggaaaatgtctcactcagcgcgagattgccaaaatgctcggaatatccaggtcttatatttccaggatagagaaaaaggccatttcaaagctgggcgagggaatagtggattaaagagtttaacgaaaataaaacacacaaaaaaatctgtttcgggcagtttattttcagaagttatttccttgacagcatgataacagctgtggtataaacgtgttatagggatatactattgatgaaaataaacaaactcggagtgtgtgatatatgataaagtttattgcctgcgaccttgacgggactttacttaattcatccaaagagcttcctcgggatttgcgtgcgacagttgaacgcctgaataaaattggagtaacctttgccccggccagcggaagacagtattataaggttcttgaacagtttgagcctatcagcagaaattttatgtatatagccgaaaacggcgcgtttgtcattaaggatggtgaggtaatcgtccgtgactgtctttcgggagccgttgctttggatgttataaaaagaacgagaaaattgccgagtgtttaccccatattgtgctgtgaagactgcgcgtatatggaaagttctgtcggcggttataagcctgttgaggtcggtcagtattttaggagactggaatttgtgcccgaccttactgattattgtgatacaaagaatatactgaaggttgcagtatatactccaaacgacgcatatgagaatatttataaaaagctccctgaataccctgaatctgctcagataatcctgtccggcagagaatgggttgatgtgatgaagattggagtatcaaaaggctctgcaattaaaaaggttcgtgaaatatgcggctgggataagtccgaatgcatgtgttttggagactatctgaatgattacgagatgatgtttgaatgcggtgaaagttttgcgatggcaaatgcgcatgaagatttgaaaaaggcggctaaacatatagccccgtccaatgatgagaacggggttatgaagtcaattcaaaaatggtttgggttataaagaaccgtttaggagcggcgtccatgtgtccatcagcagttttgcgcccgcctctatttctggtattgaaagctctccaaatccaagaataaatgttttaagaggaactttcgggttttcctgctccagcgcattttttatataggatagctttaccccttttttatgagctgagacaatcaaattctcctcggatatatcgggctttggcaccattaatattgtggtgcctgcgtccgtgttttttatttctattttttgacccagcgggtgcttgcaaaggcaggaaaccaaatgttcctgtttgttttgatattgttttctgagccgttttaggttggtataataacttccgtttttaattatctcggctataaactcttgctcggcttttgagacgtaagaatgataggtataatattctttctgccaaagattgacaagatgttccggcaggattaagtaagctgtgctgatgttgggtgctatgctccgctgaaagtctccggcaaaaatcacgtttttattttggctcatcgaaaagagcggctttgactgatttttatatacaaaatccatgtcgtaaccatactcgattatgtatctgtcttttcctgcccaatcgagaatcatccatttctgctcttttgacattgtataatacattggataatgatgaaacggcattaaaaataaaatatcagcgttaaaattgtttaacgatttttgtgtaggtccgtctgtctctatgttgagatatgacatttgtcgtccgccgagtctcatatatctggctattctataataagccgggttttcaagaccgaacaccatatcatttcccattatacgaaacagagagtcgagtagggtttcaagacccgagcctactataacctgaagagggctgcagtttatatccagggttttgttgagcataaggcttatttgttttcttaaatcatatgttcctgtatagtcgggataggagaatgcgtcctcaataaaattcttgagacagtatttatatgatttttttaggcttgccggaaccgaaaggtcggaaccgttcctgctgaagttataagtgtacggagcgtcgctgtgccatttgcgctcgggcacattttcatcagtttttgttatatcgttaacatagtatccggatcgctcttcagatgatatatatccgtattggacaaggagattataggcatttgtgatagtgttaaccgagacgttcatctgcttagacatctgtctgcttgagggaagacgtgtccctcccttaatttcgttgtggttaattttttttgcaagctggttgaacgcctgtatatacagcggttcggagctgtctctgtcaaaatctatgtatatcatagttttcccccaaatgtagagataagtaaaatttatccaaatttcaataataaataatgtattaatatagtaattatagcacaaaatgtagatagccgcaacagttttataaggagtagaacataaggggatattccaagatgatacggtattatacgggcttgacatagaaaatattgtatgatagaatacaaaggatatttttaggaatagaaagggttatattttatggaaatgattgatttgagccgttacactggaaaatatgatattgagaccgttattgacggatttgaaaaaggaaccgttaaggacggggataccgttgaaatagagggaatgattcaccgtatccgcgctatgaaaagctttgcgttttttgttttgagaacacagagaaatttggttcagtgtgtttatgaaccatcagacagtgataagccgattgcggactttaaagaagaggacagcgtaaggctgaccggaacgattaaaaaggacgacaggagcgcgcttggttttgagattcatatcaatagtatagaggttttgtcatctcctgccgaaaatatgcctattgttataaataagaagaaactggactgcaatgtggacataaagttggattacagatcgttgtcactgagaaatccacacgaacgcgccgcgctcaaaatagttgacggtatcataaacgcctttaggtcatttatgcacggagagggatttactgagtttgttccgcctaaaatcgtttccgcaggagcggaaggcggagccgatatgtttgaggttgactatttcggtgaaaaagcattgctcaatcagagcccacagatgtataaacaaatgatggttggagtgtttaagaaagtatataccgtagcgcctgttttcagagctgagaagcacagcacatcaagacatataaatgaatttgagggtcttgattttgaaatgggatttattgactcgtttgaagatattatggctgttgaagcaaggtttatgaagtatatgtttgactatcttaagacgaattactctccggagcttaaggagcttggagtggagcttcctgacattcctgacattccgcagtttaaatttatggagataaaagagatcattgctgacaaatataatagggaattcagaaaccctaatgatttggaaccggaggaagaacgtctgataggtgagtatgtaatggaaacatatggctcgccgctggtttttgttactcattacccttccaaaaagcgtcctttctatgctatggacgaccctgaaaatccaaaatatacgttaagttttgacctgcttttgaatggagccgaggtaaccacaggcggtcagaggatacatgattaccaaaagcagcttgacaaaattaagtccagaggaatgaaccctgaagagttctcagactttttaatgatgcataagtatggtatgccgcctcacggtggattgggtataggtcttgagagactggcgatgaagctgctgggagtggataatataaggacagttaccgcattcccgagggatattggacgtattaatccttaaatcgggacgggattggtttgttatattccggctgagataaaatttaaaaataaacggattgacaatatttttgtcaatccgtatttttatggttttatattattaatatttgtttttattttatataatatttatgagcttaacctataaatattatataataaataaactattcacctattgtttttttatattctgcaagatcgtttgcccactgctcaaatccgtattctcccctgtggtcgggcagatgatagttctcatctaaaaatttccctaagtattccgtaacttttactgcgccgctgtggttcatatgccagccgccgtcccgggtgtcggtgttccagtctatgccaaaactgtctctgtttatgttaaagtctatgaattttaagccgttttcatccgcataatcttgtattgcgttatgtttttcataactccagcttttagaggacggcacgtcaatcaataaaagctcaatatcattttctttgcataactctgttattttgtctaaaaagaacttttgtattttatgaaaggattcaatattttctgtttcattcatatattctcccccggtgtatggattggaataagtgacgtattcgtaaccctttaaaacattggggcggttatgggagggtactgttgtaaaatccctttcagtgagttttttccagcggttgtgatattcaaacagcggaaaatcctcacttatgtattcgcttattatactttgcaggtcgcttgcggtcgaacggtattgaaaaacaacgtccgtttctaaaatacacagtttaggtttatgtttgtctatcaatgatttcagcagaaaatatgagcggtaaatcatttgattggattcacccgccgcatatgaggtatagccatagtcttcccatagctgcatgggcgtcattgcggcaaaaaggttgctgtttccaactgcgaaaatatctaaggtgtttttacactcagcatatatatcgtccgcgtctgttaaatggattcccatttcaccggcattactttttggagacaccacgtatgcggcaagacaaagcagtataatgaggattaatgcaaatagtatacgtctaaaccatttcattttatttctccagtcgttttaatatgaggcgtacatcagcgcagagggtgaatatccccagccatacgcgccgaaaattatgattgccagcacacaggcataataaaccgcccagcgtgcagccgttggtttttcagatagtttttttctaatatccagtccgcgctctcttaaaatttccatagtcagcaggactgtgcaggatatgattaatataattatatcgttaatatcaacttttagattaatgctaaagaaactcaaaacctgagccggattaaagtctgtaaatagttttgtaaacatatttatacagacttgaagattatctgccctgaatatcagcattccaaaattgaccaggacaaaagttctgaaaattttaaatgctttatatagtttgctttctttttttatattcaggctgttttttattttattaatttccggttctaaaaccattcctaagcttataaggataaaataatacagtccgtatgcagcgtatttccagctggcgccgtgccacataccggtgctgaaccaaacgagaaataaagcgcagactgccggtataagttttccggcacggttgccgaagtggtttcttgaaaacttgccaagtttcttgacaggagacgacagggaaacagggtagaataagtagtctttaaaccatgttcccagcgagatatgccaccttctccagaactcagaaacactgccggaaaaaaacgggcgttcaaaattcttaggtattataattccaaacagttctcccgaaccgcgcacaatatccatacagcctgaaaaatcgcagtagagctgaattgtatagcatagcactgatattgctattatagctccgccgtaatttgaataattagaaaacacttgattaaccagcacgttgagcctgtcggctattattatttttttaaacagaccccaaattatcagctggaatccggaaactatgtttttggaatcatagtcgtttccgttgtacaaactttcggcagtctgactgtatctgcaaatcggcccctcgattagctgggggaaaaacgttaagaacaaacaaactctgaatgggtttttatcagccttgacagtgcctctgtatacgtctgttatatagctgactgcctgaagagtgtaaaatgatatacctaggggcagcattagggaaagcgtaggaataggggttagaccaaacagattgtttatcagtccgtttatattggagccgaaaaagttgaagtatttcaagaaaagcagaactcctataagtatagaagccgatattcctgtgacaatctttttctcacggttcattttctgttttattgcttttctttgtgttttatctgaatctgcaatgataccggcgtatttttggtttattctctcaagccaaagtcctgcagcatatataaagagtgaagacgcaagaatgaatactataagcgctccgcccgttattaaataaaacgcaaagcttgccaataatagaaccgcccagcggtatttttttggtgtcagataatatccgcccaaaacagccggaagaaacacgcatagataaataggcatattgtattgcatatgatctctcttttcttattcttgttccagtctttttatcatttcataaatgctgtttacagatttaaagttgtcatgggtgacgtcaacaggagttatttcaatatcaaaattgttttccagttcggccgatacctgaactatatctaaagaatccaaaaaaccatcggctataaggtcctctgagttctcaaagccttccccgctgcaaatgccgcttaaaatttcaatcagttcattcattttatacctctccttttatatataggttttttaatttgtttctgtcaatttttccgtttgaattgtaaaacattttatttagaaacacccactttgcaggtatcatgtatttgggcagtttttcttttacaatttttttaatctctttaatttcagaatcagtttgaagaaaagcggctattttgtcctgctcttcatcatatatgcaggaggaagcctgaacattcggaattgaattaattgcattttctatttctccaagctcaatacggtatcccatatgcttaatttgatggtcttttctgcctaggtatattaactcgcccttatcgttcagttctactaagtcgccggttttatatataatttcaggatagcatgtgttgtttgggttttgcacaaacgcctcggcagtttttttcgggttattataataccccatggcaacaatagaacctcttacacaaagttctgtttgtgtattatcgccttcagccggtataagttccagcgcgcaattgtcgcagggcttaccaatcggcagtgattcatcgtcttgaaaacttctgtctaatatatagtaggcgcatatatccgtaacttctgtcggcccgaaaagattggcaaacaatacgcccggaagatgtttgcgccaaacattcagttgtttcataggcattgtctctccggcgaagagaaccttttttaatgtttttggaacgcagtagtcaaatgctttccagtttgcaaccaaagccagtgcagagggaacccaataaatagtgttgattttgttttcgtcaataaactttaacagctcaagcggaaacgaaaagagactttggggaataatgcaaagttcggcgcctgtcctaagcgacgcgtaaatatcaagaaccgacatactgaaataaaacggagtttggtttccgaaaacggtttcattgtttatattaaaagtatctattacccatttgctgtaggatataacatttttatggctgacggcaacccctttaggtattcctgttgaacccgaggtatacagtacgtagagcaagtcggtatctatagttttatttctgatttcggagagcaggctgttgtttatattatgaggaacggcgtcaatagagattattttggtttcagggaatatttctttagactttgaaaggtgcgaaccgtctgttattattagttcaggttcaagattgttagttataaggcttaaccgttccgccggcatttttatatccagtattacataaaaattaccgctgtagactgtgcccatcattgaaataagcgtttcaatacttttttccatatatatggcgataggacggcgtttgaatttaaatttggaggctatatatgagcctgtttccatggctgctgttttaaacctgctgtatgtaatagttcttttgccgtctgatactgctgttttgtcaggataaagcttttctgagttttccagtaattctaaaatgtttttcatattatcctccatgagtagcttttagataaaattatatatgatgttttttaactatttttgtagtatgtttgaacattttattaataatgggcaataaaaaagagcctaaaatagttaagaacgataaaaataattcataaactataaaagctctctgtatttacttaaaattacttaaaaaatctaatataatcttcttcctgacggtttttcttctttttcataattcggtttttcatctacgtctgcgttttcgtcaatatgctttcttatttggcattccgcattatagctgacgatgaaccctgtgaaagaatatagcagcagcacggcaaatataaggtatattgtgaaaagcactgtaaatgaaccgcttgacagcataaatattcctaaataaccaacgcctactgtcatcaaaagaagcaatactataacaagaatactgtacggcaggctgaccaagcaaaacagcgcggcatttctgtaaagttttccgatagtcagcttatatctcaccataagcggatacaagaacagatgaaccattgcgtagaaaaggaacaagcaataaaccaggtattttccgtatttcaggaaattggtttgagacgagtagaaggttataccgtagaagaaaacgaaaagcgctatcaaatcaattatataaacagccaaagactgtttaaaattgtcttttattgcgtcccaaaagtcacttaatataaaagagttttcttcacgagagtaatttctaaggatatagtgcatacctgcgcttacaggtcccataccccaaaaaactgtaaatagtatagtaacaaaagctctgattcctaggtctatggttatgtacatagcgctgaaatcgctgttgctgaaatcaggagcgctcagtccgaccatactggcaatttggtttgagaacgttccgtataccgcgtttgaaactgtacctgaaagaaaaaacacgattaaaaaggttgggatatttgccaggcaaaaaagcaaattgacctgtatgaacttccagaactttcggataaatatttcaaaaaataaaacagcgccctcgctcttgggttcgagagggtccacacccttaccgggtttattatagtttttcatgctgaaaatgcccataaatcaatctccgtttcaaaaaaatttactatttggaagaaaatccataaaatattaaaatgattataatattataatagaaaaacatagtcttgtcaacgagaataaaacgtttgttacggttttataataaaataatggaatattttttaataaaaatgtcagtgaaaataatgctaaaatatttcccaatatgttgcagatatattgctgcagagtagtttagcacaaaattattttttcatattaataacattatatttattggttttgtctgtgtttgaattgtcaatgattatatatagtaagttattgacaaaaattttatggtttggtataattaccactaatatgtaatcaactttatagcgaaaagagtgatattatggaagtaacaaaagatatggtttcgtatgtggcggaactttccagattaaaactgaatgatgagcagattgaaaatgccaggcagggtcttggcgagattataggctatatggacgttttgaataatattgacactgaaggcgtcgagcctatgtcacatgcgtttgccgtaaaaaatgttatgcgtgaggacgttgttaagcaaagcgccgacagaaaagagcttttggctaacgctccaaagtctgacgacgaggctatcatcgttccaaagacggtggaatagccatcacgtttgagaaatttattttggaaaggaaacggataaatgaatattactgattatactgcccttgagctgggcaaaaagataaagagcggtgatattacagtcgttgaagcaaccagggcgttccttgatgaaatcaaggcaaaagacggggttgttaacgcgtatatcacagttacggaacaggaagctttggagagggctgaagaagttcagaaaatgatagactcaggcgagctcagcgattctccgctggcaggagttccggtcggaataaaggataatatttccacaaagggaataaagacaagctgtgcttcaaaaatactgggagattttaagccgccgtataatgctgctgtaattgataaattgaacaaggccggcgccgttatcatcggaaagctgaacatggatgagtttgctatgggcagcacatctgaaacatcgttttatgggccgacaaaaaacccgtgggatactgaaaaggttccaggaggttcatcaggcggagcggctgcagctgtttcagcaaaggaagctccatacgcattgggctcagatacgggaggaagtatcagacagccggcatcattctgcggcgttaccggaatgaagcctacctatggagctgtttccagatatggccttatagcttacgcctcttcacttgaccaaattggtcctgttgctaaggacgctgccgactgtgccgctattatggatgttatttgcggaaaagacgaaatggacggaacttctttggaggttgaacataaagggtatctcaactcgctgtcaggtaatgttgacggtttgagaattggaatacctaaacagtgttttggcgacggtcttaataaagatgtgaaaaagtcagttcttgctgttgctgagactttgaaggaaaacggcgcttctgttgaagagtttgacatgactattattgattatgttgttccaacctattatattatagcgtctgctgaggcaagctcaaatctttcaaggtttgacggcgttaagtatggattcaggtctgaaaattttgatgatttaacagatttgtatatgtcaacaagaagcgagggattcggcgaagaggtaaagagaagaatacttctcggaacttttgccttgtctacagggtattatgatgcgtactacaaaaaagctctgcaggttaaagcccttataaaacaagcatttgacgaagcgtataagaaatatgacgttatacttttccctgccgctccgactactgctcctaaattgggttcaagtttatcagaccctctaaagatgtatctttcggacatttataccgtttctgttaaccttgccgggcttcccggaatcagcgtgccgtgcggatttgatgaagatggtatgccgataggcgcacagctggtcggcgcgccgcttaaagacgatgtaatcctgaacgcggcgtatacttatcagagtttaacagactttcacaaaaagtcaccggatagttttgtaaaggaggcgaagtaatatggcatgggaaaccgtaatgggtcttgaagttcatgttgagcttgcgaccaaatcaaaaatattctgttcatgcacaaccgaattcggcggagagccaaacactcactgctgccctatatgcacaggaatgccgggtactttgccggttgttaacaaacaggtagtaaattttgctatgaaggcgggaatagcgctgaattgtgatattacccgatacaataaatttgacagaaagaattatttttatcctgacctgcctaaggcgtatcagatatcccagctgtatctgcctatctgtcggaatggacgagttcctatcgagacagaaagcggagttaaaaaggatataaggattcatgaaattcacatggaagaggacgccggaaaactgatacatgatgagtttaacgacgaaactaagtgtgattacaacagatgcggcgttccgcttatcgaaatagtaagcgagccggatttcagaagcgctgatgaggttatcgcatatctgtctaagctgaaatccactctggaataccttggagtttctgactgtaagatgcaggaggggtcaatgcgtgccgatgtcaacctgtcagtcagaaaagtcggcgaggaagaattcggaacaaggacagaaatgaaaaaccttaactcgtttaaagctatttcaaaagctatagcttttgaagcaaaacgccagatagacttattggagcgcggcggaaaggtcacccaggagacaaggcgctgggatgataataaagacaagagctatgctatgagaagcaaggaaaacgcacaggattacagatattttcctgagccggatattccgcctattgatatagacgacgagtggtttaattctattgaaagcagtttgccggaacttgctcctgagaaaaaggcgcgttatataaaagactttggactgccggaatatgacgctaacatgataacaggtcagaaagcgctggctgacttctttgaggagacaacggcgatatgcaataaccctaaagaagtttcaaactggattatgggcgagctaatgagaaaactgagcgatgagggtatagaagccaaggatatgaagctcacgtccaaagctcttgccaagctgatagagctggttgataagaaaacaatcaaccgtaacaaagccaaagaaattttcggaatcgctttcaatgaagatttggatgtagaaaaatatgttaaagataataatctagagcaggtaagcgacgaaggattggttcttgatatagttaagaaggttattgaaaataatcctcagcctgttgttgattataattcaggaaacaagaaagctataggatttttgatgggtcagtgcatgaaagagttaaagggaaaaggcgaccctggagtggtaaataagctgctttcacaagaactgaataaataaattattatttataaaaatacaggttagaaaaagctttttaaataaagtaaatactattatttaaaattaaattttgttagaatttaataaatattataaaaagttgtttaaaatttaagatatacaaaaagacaatggtgtgaccactaaaaaagagatttttaaagcgtagcagttttatgactgctgcgctgtttttatgcagacaacttgaatttattatacgaggttacctgtcttttctcagagcttgacagcttatgtcataattccgtgccaatatatttttaagtaaaattttacttttataaaatatgcgttttgattatataaacatagttaataatatttatacttaaattgtgaccggatttttaagctggtacggttttagttttcaaccgcttaaaataattaatcttttatgttaaaagaaataatacatatatatttatcggtaactaatttgattgacacaaaaacttaccaatggtataattaaaaatgaaaaaacaaaaaatattataatacgaggtgagaaaatgaagaaaaaactgctatctttaatgctggctctctctatgcttataagcacaatgccgtttattgtcattgcagaagaagacggcgcaggttatgcaacaaggggatatgttgccgataagcttttgtctgtttcggatgattataatgcaggaataaccagaggagacattataaaaggatatggcgacggtgacacaaaagacgaccagtatattacgcgttccgaggctgttgttatggccgaccgtgcttttggaaaaatgcctgaacctgataagaactttaaacgtatcagcgaaactgatttaacattttctgatgttcctgactgggctgaagacgctgtcaataatttggcaagccgcgggatactggttggaaaaggtgatggattgcttggttctgaggattttataaccgaggacgaggttactttgattatccgcaggttatattatctttttgggtctaatttaaaggatgactttcaggcttatatcaacaaagattattataacactgcagaaatttctcaaggcaatgtagtaacttcatcgtttcatgaagttgacgagagaaatgatgaaataatctcagatattattaacaattatttgtcagaagaacagcctgccggcagcaatggtgagataatagctgatttttataccagtgttaaaaacttaaacaccggcgagggaactgaacaggatattgaaccgctaaagccgtatcttgatgaaattgataaaatagaatcgcttgacgagttagacgctttgtcaacaaaaattgtaaaagattatttagttaccacctttgcagcttttgcgattgtcgctgattttaaagacaatacaaagaatattcttgcttttgggacgtattcgccgagccgtaccaaagcagattatgaaaatgaagatattatgaacagctataaagattacttgacaaatatcttggttctcggcggcgaagacaacactaaagctgcagaagatgttgagaagtttatcgcttttgaaaaggatttatctcaatatgtaatgtcaaaccaagaagcttctaatatagataatatttataatctttatagttattcagagctgtgtgatttgttccctgcatttgattttgataagcttttggaagcattaggtcttcatccggaagataatgttttagtcacaactccaaaggttatggaagcgtttgcttcatatgttaatgacaaaaacattgatttattgaaaacaatacttaaaatttctgttttaagtttgggttctcagctggataaacgttttattgacgcagcgaatgattttgagtcggattattttggaatggacgttacaagtcctgctgaggatatagctttgactactaccaaaaatactttatcttcatatttgagtgaagaatatataaaacggaatttttctgatgagactaaaaaagatgttgaaaatatggtaaatgagtttatagatattttcagaagcaggattgcaaatctaacctggatgggtgaagccacaaaagagaaagcaataagaaaaatcgacgcaatgtctgttaacgttggttatcctgaatcatttgaggattatattgacgatataacggtttattctccaaatgaaaaatacgcatattttaatactatgaacagtataagaaaatccgcgtatgctgatatagctgaaagccagggaaagcctgcagaaaaagcagattattggagcgtagttccggtatataccgtaaatgccggatatatgcaaactgataactctattaacttcccggccggaatacttcaggagccgttttattattctgatggaaagcctgaggaaaatttggggtctatcggtacagtaatagcgcatgagattacacatgcttttgataataacggcgcaaaatttgatgagtttggaaacgctgcaaattggtggactgaagaggatttagctgtgtttgaacagctttgccaggatgttgttaactattataacggatttgaatccgctcccggaatccaaacagacggcgaacttacaataagcgagaacgtagctgatattggaggaatggcatgtgcgcttgacgccatgaaaaaactcgaaaatcctgattataaactgttttttgaaagtaatgctaagctttggaagataacaggtcagcgtcagtatttagagagtctgagcacaatagatgttcattcttttggaattgtcagagcgaataggcttgctgcattatttgatgagttttacgaagcttttgacataactgaagaagatggaatgtacgttgctcctgagaacagagtatcaatttggtaaaatagcaagttatttaaatccgcctacaattgtgtaggcggatttttatattttcttattataataagaaaatattacatagtatattgttgaaaaagattattgcaaaatttttagttttatatttattattataataaaaaagttattcacagccctccgatgcttgcaaaaccatatttcatataataatttattttagaaatattattctgtatacagagtgtttttagtgaacatcgggaggtgtgactgtgaccccacctaaatggtgggtgtgagcccaaatatctctttattccttaaaccttcaatgtcaataatatgacttagttgtgatgtttcccacctctggtgggtgtgatacaaaagtgactttttttgtcatagccttaaacgtcaataaattacttagttgtgatgtattgcgcatttatgcgccgcttcaggtgagctgtcatcttacgcggagcgtaaatatacatagaacagtttgtcataatccgttttataataaactgttccacgactgcgcgccttacgcgacgtacttcgtacgtcctaccgaagcttacaaaaccacactttttataatttatttagaaatattttttatatgttgttttaatgattatttgaaggtgtgcacctatcttacaggtgtagacaaagtcctgctgaagctagcaaaagaacattttttatattcatttttatattaaataacattaacatttctgtgtaatgatttcggccttttttatagttttatagaaacaataaagatgatacttgtttaatgagctgtcggaaaaattatcaattatcaattatcatatatctaatgaggtgtttactggtttttataaatgtctatttgatattgcaatttacatatataaatttttgaaaaaatatagaaaaaagtcttgcatttataatttggttatgatatactatttcggtgtttgggctaagtttgtccaaattatataaaatacacacgctttgtgatttcatttgatgtgccggtattcccattccggttcttatgaaagctgagcaaggcggaggtataactttatggaggtgtaaaatatgggagtagtacaaatgaagcagttattggaagcaggtgttcattttggacatcaaactcgccgttggaaccctaaaatggccgagtacattttcactgagagaaatggtatttatatcattgatcttcagaagacagttaagatgattgaggaagcatattactttacccgtgatgttgctgccgagggcggaagtgttctttttgttggaacaaagaagcaggctcaggaagcaatcaaagaggaagctgagagaacaggcatgtactatgtaaatgcaagatggctcggcggtatgctcacaaactttaagactattaaaaagagaatcagcagattgttccagcttgacaagatggctgaggacggaactatggaacttcttcctaagaaggaagttatcaagttgaatcttgagaaagaaagacttgaaaagttcctcggcggtatcaaaaacatgcatgacttaccgtcagctatgtttgttgttgacccaagaaaagaaaagaatgctatagctgaagctcacaaacttggtatcccggtaatcgctattgttgatactaactgtgaccctgaagaagctgattatcctatccccggcaatgacgatgctatccgtgccgttaagcttattgtttctacaatcggaaacgctatccttgaaggcaagcagggcgagcagatggaggaaactcagaacgaagaggttactctagacgttcttgacgaataatataataagaagttttttacgaaaggaagaataaaaatggcatttacagcacaagatgtaaaaacattaagagagatgacaggctgcggaatgatggactgcaagaaagctcttactgaaacagacggcgatcaggaaaaggctattgaatatttaagagaaaaaggtctttcgaaggctgccaaaaaggcaggcagaatcgctgcagaaggtatggttggttcgtttgtttatggagacacaggcgttgttgttgaggttaactctgaaactgactttgttgcaaagaatgctgatttccagaagtttgttgaagatatagctaagacaattgctaataacgctcctgctgatgttgaagagcttaagactttgacaatcgacggcggaagccagacagttggcgacgctttgaccgaaaagattgctactatcggcgagaatatgaatattcgtcgttttgagacatataagggagttaaccagtcatatgttcatgccggcggaagaatcggcgttcttgttaattttgaagtagcagacgcttcaaaggctgaaacacctgaatttgttgagatggctaagaatgtggctatgcagatagctgccgctgctcctgaatatttaacagaggaaactgttccgactgaggtagttgagaaggaagcagaaattctgaaacagcaggctttgaatgaaggaaagcctgaagcaattgttgataagatggttgcaggccgtataaagaaatattacaaggaagtttgtcttgtagaccaggcatatgttaaggaccctgatatgagtgttcagaagtatgttgatggtgttgcaaatacacttggaacagaaattaagattgcaaaattcgctcgttttgaaaagggtgaaggaatggaaaagaagcaggataacttcgctgaagaagttgcttcaatgatgaaataatctaattgattagatattaaaattaactcaacattaattttgcgcgctgtgagataatcacagcgcgttttatattaattttttatatatgttttgtgaagcgagtatatttataatatagttcattatacaatattttataaaataatctgacctcgaatacagaaagtttcgaggtcagaaatactattcaattgtcacagtttgactttcctcgtcccaagtgatttttgcgtccaagttttcaacaagaaatctcaatggaacaaatgtgcggtctttatataggtatggcggtgaatcaagtgtttgagctttattgttgacatatgcaatattagagccgagttttaattttatgttattgttattagagtgaattgtaacagtctcatccagttcgctccaatcagttttagcgccgataaaatctgcaacaggccgtgcaggtaacatggttctgttgtttactatctgcggcgccgaacctagacttatgtctatatttccaacttttgccgtacctttgtcaattgttaataccatttttcttttaatattatttaaagcagcaaaatggtcatacatatttcctattctgtcacagttcaaaaaaattgtgcttgatactttctgaatactttcaggaagttcaatatctgataaacttgagcagtttccgaatgcttcatcatatatatacattaatccatcatttaaagtaacacttttcagagaagtacaatttttaaatacttgataccatattgattctacgtctttaggaataatgatttcagtaagggagctgcaattttcaaacatatatgagctgatttctttaagaccctgaggcaagttaacttcctcaaggctgctacagtcgctaaatatgccattctcaagttcttttacattatttggaattgtaatttttataagagaactgcaattttcaaacatatatgaaccgattttttcaagactttgcggcaagttgacttccacaagactaacacagtcgctaaatgcgtcactcctaatttcttttatattatctggaattgtaatttttataagggaactgcaaccgctgaaagcactatatgagattgaagttaaactatcaggcaattggattgattctaaattagtgcagttgctaaatgcgcagttttcaatttcaattatattatcatttattataatatttttaagactgctgcattcagaaaacatgttgccgcttattttttttatatttggaggtaaattaatattttcaagtgctgtgcatccgttgaaaacatacccatcaatattagatacagtatccggtatttcaatactttttaaggaagaacagcagttaaaagcattatttcctattgatatcaaactgttcggcaatgatatgctttctagttctgaacaattttcaaaagtatatgattttatttctgtaatcccgtttgggacaacaaagtcttttagtgtgcagcagtttgaaaatgcgttatcttcaattttaactatattatttggtatatctatatgttttagtgaagaacatcctgaaaatgcatatgaatcaatttcagttactcctttgggtattataatattttccaaagacgcacaattatgaaaggcaaaccctcctatgatggttacagtctcaggtattataaaatcagttagcgatgtgcatccgctgaatgttccatccaattccgttaaccaatttggcaatgaagcagatttaattcctgtgcatccactgaatacattttttcctaaagttgttaccgaatcaggaaccaaaacagactcaagaccggtacaggatgaaaacgccgaatcaccaatggatgtgattgaaggtggaatatacagatttgttaaagatgaacagccggaaaaagctcctttatcaatagtattcacattaagcggtatattgatttccttgagattcttgcaccctgaaaaacaatctctacctattttggttattccgcttgggatatttacggaagctagattggagcagctttcaaatgcatattcatcaagaatagttacattttcaggaataacaatttcagtaagaccgaggcaacataaaaatgcaccttttatggatgtaacgctttcaggtattgttatgctgctcagactagaacagatttgaaaagagttattaagttcagtaagactgttggaaattttaagctctgttgctgattcacaatatctaaacgcatattcacctaaaaaatatacactgtccggaatatcaatatattttagtgattgacagtttgcaaaagcgtgaccgcctataacttccaagccatatggtaaatttatttctgtaaggtcaaaacaacaattaaaagcctgacctcctattatcttaagtgtgcttggcaaggtaacattttttacatctgagttttcaaaagctttaaagtcaagcttagttacgccttcaggtataataatactgttaagattgtgcgtgccgtaaaaagcctccatacctatagttgtaacaggcgatccattaatctcggatggaataactatatctgcagcgtctttgttgcagccggtaatcgtaattccataaccatttctttcatatgtcaaatcttcatagctttcagcgcaaactggaaatgacaatataaaagatatagataaaattgatagaaataataacataaactttttcatattcatcatccttatatatttttaatatattttatcatttaatttactatatgtcaaatagtatttggaaattatataacatgatgaaaattatagtgttttaataaaaaatggaataattataaattaaagggtaaatattttctctctcaaatgaaaagttgggctcttaaatttttaacttcagcgtaattattttctgcttcatagaccaaaattttttgtcatcagtcgtttggatcataataaaaataatacattatttttattatgatggactgtaatttgataaactttatcttcaggtaaaatattttggtttaaatatatagttattgaaatttgaaatataaaaatttatttatattattttatatataatacgatatatttcttcaatttattttctagtgatgttctataacatatatgaaataaatcaaattctacaagtaaaagtataaaagataaatagtttaggattacagtttcggccggcagttagtttccgctaactattggccgaaaaaatataattacgcgagtattactgaagaattgattttagagctgtcacaacaggactcggagatttaacgaacgggaagtatgtttcgcagatttttgattaacagtgttaatcattttatgcgaatatgtactgataaatactactattaaatcctgttttattaccttattttcgaagtagggcggcatctgcgtaaaaactttagccttatatttgtatgatttgcaaatatctttgtatctggttgccatacggtcgtttcctccagttaatacaatactcataccttttatcctttttgttatttactgaatgttttatatgtatatttgcccgtactaggcgggcagataattttacttattttttatattaaacgctgaaagtcccggatatacggcggaatcaccgagttcctcctcaatacgaatcagctggttatattttgcgactctttcagaacggctgggcgcgccagttttgatttggcatgtgttaagggcaaccgccaaatctgcaattgttgtgtcttctgtctcgcctgatctatgtgatgaaatagcagtgtatccggatttgtgggccatttttattgcttccagagtttctgatactgaacctatttggttgagcttaataaggattgagtttccgcatgcaaggtcgattcccttttttagacgctctgtgttggtaacaaaaaggtcgtctcctactaactgaaccttgttcccgagttcttgcgtcagcttctgccagccttcccaatcttcctcgtcaagagcgtcttcaattgaaataataggatatttttccacaagttttttccagtgtgctattaattcttcagaagtaaattttgttcctgctttcggaagaatatattctccgggttttgaacctttccattcgcttgtagccgcgtccatcgcaatcataaaatctttttcaggttcataaccggcagctttaactgcttcgagaatatactgaatagcttcctcatcgctggcgaggttaggagcaaatccaccctcatcacccactgatgtggttaggccttttgatttgagcaatgacgcaagggcatgaaatacttcagcacaccagcgcagggcttctttaaaactttttgctcctacaggcattatcataaattcctgaacatcaacagtattagcggcatgtgctccgccgtttaaaatattcatcatcggtacaggcagaacattgccggaaattccgccccaaaatttgtaaagaggtatatcaagtgaaattgacgccgctctggatgccgctattgatacggctaggattgcattggcgccaagttttgatttgtcttttgtgccgtctgcggctatcatggctttgtctattgcgtaaatatctgaagcgtccattcctgatatggtttcatttattatcgtattaatgtttttaatagcttttgtaacgcctttgccaaggtacctgtctttatcgtcatcacgaagttctaacgcttcaaactcgccggtggacgcgccgctcggcgctgttccgcgaccgatagtgccgtcggcaagatgaacctcagcttcaacagtaggattgccgcgtgagtcaaggatttctcttcctataactttttcaatctgtaaatattctttcattctttttgctcctttcaggatattatatatttgtgttatatttatttttgctgattagcaaaggctaaatggcctgattatgtcatgagtaatatatttgttaatattttaaacacatactgtatatggttggagtattttattatttattatatctgctatgttggattgcattatggtttggatgatgctgacgctgaggggggcttttgatacatttaaaatattttaatttcttttaatatttaatattgccatatttatcttattttataaatttactttctgatatgagaaaataatattgttttatttaaaattataaatagcaagtgatgttattgatggcgttaatatatatttaaaggtctaaattgaattaattatttaatataaataaaatttgtggctgcgcgcctaacgaggcagattacatctgccctgccgaagcttgcagaaaatattttttatatgagtatatatttgtaaaaataaaaccatctgtaatttaggaactaattagaattaattatttaatataaatcgttttcgccagcgatagacatactgacgatttaccttatagcgaatggcagcctttgtcacgccgtgtttaaaagaatattcaattaatacttgtctaaatctcatagtttgtgttatagtgttcatatacggaaggctcctttgtgtatgtgatattgtggtgatataactataacacaatttatgagttttccgtattctttttttctctttgtaacacatctattgtaatcctacaatataaatgagaaaaatataaaaaagatattgacaaattattaagaatagtataaaataaaatagttgttgatttcaacgacgtttattatttgcggctatggcggaattggcagacgcgcatggttcaggtccatgtgaaagcaatttcatggaggttcaagtcctcttagccgcaccaaaatttgaaaatccgaaccttataccaattggtaataagttcggatttttgctttattttagttaattaaattttaatattattatataacttatggacaatttgtgacatcttttgtcaagaggtctttaacattatttgttttgatatagattattttttagctttgcgttttaatctgccaattaaaataatatcagcacgagaaaatcaatatacgtatatatttgtgtattgattagggagagtttacatatttaagattgcaaatttgcaaatttgctattcgtttgatataatataatcagctaataggggcctatatgtccttgttagaaatatcaggcgatcttattgtgcattggcagacaaacagaaagcggatatagtaattggcaggactgatagggacgcagcataacaattaagtcaaattgaaaacggaaaaatgtaaaacaccagcttcgatatccggataaggccggaaaaagggtttaggacataaacaaattatatattggggctaaccattattggccgccttaaaagttttgatatatataaatttggtttgtctgaaaacgtggttcaaaatttatgacatggacggttgatgtacatatcttgaaccgtttgccggaatacaaaagttttccacagcagtatagctgataagtgcttagttcaagtacatgacggatctgagaaatatagtgcgaaacgaggtcatggaactgacattgcctgcttcttgttcctgtgaaagacagtatagtgtaaagctgctctgaaattgttttttatgtaatatataatacaccaaatttgtgattttgtatggtcataagttttgggcagtaattttcataaagaactgtaactttattttggtatatttgaaaaacagctgtggagcaacattacggccaattgcttaaaaggaggattctaaatgaaccaatttattgaaacgttgacaagtaaagacaaatgtttggagttacccgaagaatatgattatttcggaaaacttatcgaaagctggaaactcaattataccgaccgaaacatatcatgctcagttaaaggagaatggcatttttcatgggttcttgagggtatggcaatacaagatgttattgttttaccctcgcgcgatacaaaaactgaaattccgcatccactcaccgaatacggcacaacgcttcgtgtttacaatccaaatacacatgcttgggatattgcctattgttacacaggagaaattatacggctagaggcaagaaaacaagacgatatgatagtgctcacaaacattgatgataataagaaaaaatgggtttttgtcaagattgaggagaatacttttcattggcaaaatattaccataaaagaagatggcgaatggcatataaatgcggatatatatgctgagcgaataaagtaaatacaatataaaagaaacttttagacataaagataaagaatatcagaaaaaacatagtctgatacaaaattgtatcagactttttgtattatttcttatataccgattaatttgactgtattacagagatataaaggtattaaacataaaatctgtcctaagtaataattacatattaaactttcacgggttttagatttatgaatttcgatttgcaaattctcaggttagagaaacacgtgtttttttcagcttaaatatgactttagactttagattttatattttcagagacaatattgacgaatgcagtatgttttgatgctgctgcgcatgacaactattttgtgttgggaaataaattcatatttagcagaaaaataagatttagatgatattaccatcgtttattgtaaaaattcggctgctgtttttttgcggatttcagcgaatgagtaaccataataattgtttgtacgatttctttattaatattattcagtaattcaattcttggctgctttattgttggattgctgtctgcatagataatatattttcaaagtcctgtgtgaaagttatagcccaatcaccgcgtatatttttaccatttggagctgacattgtaataagtaatgcaaaaatacagaatacggcaatgagagttccaaaaagtgaaagataaatattaaatatatatgaaaaatactgtggtaaccggattctttcatataatcagcccttttcttttatttatacctcaagccttttattgttacaagctgtttcggactttacggaatattctctattttttctcatgtatgacgtatatacaccatgattgtattgtcacaaataatactgtattctccccatacttgttcatatagccgttccttgctaataattttatcggcgttttccattaagtaggatagtaacaataattctcggccggtcaagtcaactttttttcctgatttataaatacggctgctttctttatccaatgaaagacagtcaacagttaactgtttgaggttatcaagcgtatttactgattgatattgttgacggcgaatttgtgacttaatgaggtaaacgatttcacgcggactaaaaggtttagtgatataatcgtctccgctgcagaagagcctggtgttttgtttatatcatcatttcttgctgataggaacagaattgaacaaaaagaaaattcacgtattttttatacctcaataccgtctatatccgtcagcataacgtctaagacaataacatcgggctgatattctttacatattctgattgcgtctgtgtctgtatatgttttttatatttttgaaattgttttaatacagagctttttcaaataaacctacaatatacttttcgtcatctattaataatattttattattcattagttataatgtcattttttttcgttaagaggcctattattagaaaacttttctgctttctttggtattagtgcatgttgcaagtttacaaaacgacagatatgcgtttgctatttatagtattttatgttcttgttgttttgctgatttaaggtaatatgaaacattaatagttttttagtttcgattatatgcgggcgcataaataaagtcaacagaaaatataaaaattatttatttagctggaatgtgattgacggttacaaagaaatgtggtataataataaaaatagctattgattatggtttttgatgtaaagttgaatttaaaataatagcttgattttcattattgcagtgtttttttatatatatagtttttgaggtagttactgtatatcagcagtcaatgctttgattttgctatattatttaagttcagtaatagcagttaaaatagcattttatttaatgtgcgggtgtagttcagtggcagaacaccagcttcccaagctggatatgagggttcgattcccttcacccgctccaaaaaagcggcaagcatttaatgcttgccgctttttattatgaaataaaacagagctatttgccattttaaatctaagagattattatttttctcatacaaaccaaagtttttgtcatcttttacgactaatgctggttttgacaggctgttttcagccgagatactcatcataactttatctttaaatttaaatatacagtatcgcaggatcccgctaaatgccttgtatataaaagtatctgcaatatattgtttcacacttttctaatattaaataataacttttattaaataataacttttcgagttctttttcgacaaaggtgtggtcacgaaaatctaattttttcccgttaaatgtatattttcaatatgttcaacaacaaattccacttgttactatctcgctattattacattgcccaaatactttatagtaaacgcaccgtcaaaattaaacagcttaattattttcctcaattgcttctccgaaaagttttcattttacagttgattacttaaagtgttttctctatatcatcgtgtttccgcaagtcatttacctttatatttcttttaatcaaaggaattaattttaaaagccataacaatataatcaccccattttgttttatacaaggggtgattatattgtatatacattaaaatcaaagaaatatataattactcaattgttttaatgattatttctctataagagtaaatttccatttacagcagcaggattcgtctgtaatatcaggataacagctgatgcagtcacagacaattcttttatcaataattttggcaaactctgaatactcaattattcctacagatttacatggatggtaaggcatattttttcttaatcttgcagtttgaaccctgcattctaaagtgctgtatatcaaagtattgtcttttattataagttcatcccggtttatattggcataaaatctaagctttaatgctttttccaagccttgcagacccgggtattcttcaagattaagaaattctttgatacgttttgcttcaattgctgtaaaatgcgtccacacttcttcatcacggcacatggcttcctgcataccatatttattctcaagtgactgaaaccataatccatccatagccagccaattttttgaataagcttcaatcaaagttattagttcattttttgataatttttgcagtgtttctttatttaacatgagccgctcctttaatatcttattttagaatataccaagcaaatgctgcattaacaaactaacggcaccaatcgctatccagcagcataaaccaagaaatattggctttcctcctgattttacaagcttgactatatccgtgttaagccctatagccgacatagccataacaataaagaatttgctcagagtttttaaaaagcaaaatactgcttgtcctccgtcatgaatcattccggatggaaagattgcaaagaaaatggtggttatgacagaagctaagacaaaatagaggatgaagaatgggaaaatcttttttatgctgacctttgttccgccggccgacttttccttttccgttctccaaaaggcaagcaccaaagtgattggtattatagcaagagttcgggtcagttttactattgttgctgtgtctaaggtgttgctgccatgtataccatcccaagctgtcgctgctgcagttactgatgaggtatcgttaactgcggttcctgcaaacaatccaaatccttcattagacaacccaagcatggaacccagtgttgggaaaatcaatgcggctatgatattaaataaaaatataaccgagattgactgcgctatctcctcatcgtttgcgccgataacaggagcagtggcggcgattgcagaaccgccgcatattgatgaacccacacctattaaggttgcaattttgggatgtaattttaaagccttatataaaacaaaagatacgattagcgatattgaaatagttgataaaataatcggcaatgactgagctccggtttttgctatacttccaaggttcataccaaaacccaataaaattattgcgtattgaagtatgctttttgatgtaaatgtgattcctgattgggactttgttttattcttataaaatatagttactaccatacctgctattattgcaaacacaggtccgcccacaatcggaaatattaatccaagtatgtatgcagggattgcaattaccaaacaaattaaaattccaagccagttttctttaacaaaattcaagtttactcccccttaatttagtgtttattctattgcagcagatttatcatattctttaaattgcctttgcttttcaaatacctcaggcagttttttgacctttataaaatatgaaatcataaacagcgtgcaggcggacagccaagctatcggcccggatgcgcagactcccaaatatccataaaattctccaaacatacctgttagtgtgtttgccagcacgagtgagagaacaattcgggcaataagctcaaccgcgcttccgcacagaactattccggaattccccattccctgaagactgttgcggtatacaaataagaggccgagagcaaaataaaacacacctgctacataaaaatagttttgagtatataatgtcacgctttcacgcaaatctccgctggttcctgaatcaatgaatattcctgcgatttgtcttgaaaagattaaaacaagagccacaattataactgtgaatcccaaaacaagcaaagcgcatttatttactccttcgcgtattcttttttcacgcatagctccgtaattttgtcctacaaatgttgccattgtaaccccgaaagaaatttggggctgactgacgagctgctcaattttattagccgctgtatagccggcaataactgttgagccgaatgagtttaaaacagcttgaacaatcattacgccgatagcagtaacggacatttgaaatgccattggcactgcaagccctagatgtctgagagaaaattttgagtcccacttaaaatcgctttttttgaggtgcagctccgggaactttttgccgacgtatagaagacaaagaagcccggaaatagcttgagctataatggttgcaagaccggctccggcaactcccatatgaaagtttaatataaatactaaatcaagaattatattaataatcgaagagattaaaagaaaatacagcggtgttctgctgtctcctaaagcacggataacacaggatatgtagttgtaaaagacttgaaatacgattccggcgtatattacaataatataattatacgaatcgtttataatattatccggcgtgtgcataaactgcagaagcgaccttgccgaaagcatactgactgctgttaagaccacagaagccatcgttgccaaaataagacctgtgccaacgcttcggcgtactccgtccatgtcattggctccaaatctttgagctactatgatagaaagaccatttgtaaaaccaagtgcaaaacccacaattaagaatgtaatcgcaccggctgcgccaactgccgcaagggcttcaacactgatagtccgcccaactataatggtgtcaaccatgttgtaaagaacttgaaagatgttcccgataagcagcggtatggtaaatttaataatgtgtttgataggacttccgacagtcatatcgtttgttaaagcatttgccatttatttcattccccctcaatataatataattttcaaacataggtcttattaatataacgctacaaattttgtatgtcaactataaaactgtacaaagtttctataagtacaaatttaaaatattattgaataaaaagaccgtaataaaagaaagagaatatttaatttatcaagtattttaaagtggaaaaatgttgttaatatcattttaaacaatttaaattttctgtaaatattcggattatgaagttgttgatatagctgtttttgtaataaaaattttatgcgcttgccggcattttattcactgctgatgtatccaatataattaaatataaatatgcaccgccaaaagtaacttgcttttggggtgcatattaaaatattatatttaatttttaaattaaaaatttattcttataggcctgtctccgagagtgagcacatcattatttttgatttcgacctgatgtttaagaggcttgccgtttaaaagagtaccgttggtggaattgttgtcttcagccataatcttctttccgtcgcgaatcagtatacagtgtaccgaggaaaccataggcttattaactactacatcacactgaggatttctgcctactaatatttcatcttctatagtcagagtttttgttttattgttttcaataatagttacgtttacttttatttcgcctttactgttatcagctttatttttgtcagtgtttgaagatttattgtcacttttttctataggcttagaagctttgggttcagaacctttttcacttttactttcttcattatcattaatattatcttcttcgtcaacagcgtcttcgctttcaatgtcagagttgttatcttcttcagcgtcttcaacatcttcaacatcattttcttcaagttcaggggtgtttaagtgtctgctcgattccatgtttttataatatagaatttcatcaagttcatcagtttgttttttcttaggattcataaataatcctaagcagattagaaccatagcgataacaaaaagcgcgccggcgatgagtaatatgtcattaagtatattcatatggcagttctcctttaaaatattatcgtgatagcgctgtagctatcttccggctcatttttcttcacaattctaatcatctttctgagccattcagaggaagatttcgaacgttttaaggttttttcaacctggcgctcagtaatcttttcccaaaacccatcggtgcaaatcaaaaccgcatcaccgcttctgacggcgattgggtcaattgtttcagctccgcacatcgggtcggcacccaaataagcggtaagcttgcgcctttcagaacttttacgaattcccggaaaacgaaattcacctttactatgggctaaataagctaaagaatgatccggagttatatattgaagataattttcactgagataatacattcggcagtttccgagatgaccgcttatcacacaattcccatcggttagcacaacggcggcggaggcttcataagtcttttcttcaccattgtttttagacgcgtgcgtaagatcccaaagtttttcatctgcgtttttaaaataaccggagatagtatcccgggttatatcggaagtatttttaaaatcagataaaacggaatcaattacaagttcagaaaccttgtccccgtttaaaccgcttaaagacccgtcacatacagcaaaacaaccgcagcccctgtcttcaagcattccgatataatcacagtttatttccatatcgcccgaatatcgagcggatgaaatatccataaatcattctcctatctttataatgactgtataagctaatatttattaatataatattttattagcaaaataaaccagtcaatcaaaaacaacatattctcattatactttatattggatatattgtcaacacaaaatgcggtggtctaagccatattattgttcagattgaataacaaattaagacaaaaaaagaccggctgaagtccggtcttttttatattctaaattaaggctccgcgtatcatagcagtgaattaatttttttataagttttattcttcaactaactcaacaatttcaacattgtcaacgttagaaatcggcgggatacttcttgtttctattgcacttctgttgccttttaccttagagcctactgttaaatcagcaagcttgtagattcttttgtcattgccgcgggttataacggtgtcgtcatataccataagggcacgctcgattccgttgtcatctataattatgcggtcttcctcaacagctgttatagtaccttcatatggtacagaatcgattacatcgggagcatcttcaccgttaacctctccggatctctcggttccgacagtttcaatagaaatagcggttgtctgaggcggaaggctaagagtcattgcggcgccgtagcctattttgagctcctgtccgtcaacaagtgtgttaaggtcaagttccttatcgccgtcttttaaaattgtatcttcgcttactctgactattacttcacccaatcttgcatcctgaacagacagaacgctgttttcatcttcacctttttcaatagagtttaaggtaacgtcagcaggttcaacaactataacatagtcgtctccgccttcgtatacgtctacgcctacgaggtcggttaagaattcaacaggtacataagttgtttcaccgtcaaccaatgaaggagctattccgaaagaaacaggcatcatttttgagaaataataagagtcaagccctatattcattccaaactcctgagcgcctcttaaacactggattttctggtcttcttcattccaaacaacttcaaagtttaagaactccatgacatatctgagcggaaccattttgtgtccgtcaacgtttacaaccggaacagcaggaatggtagctccgttgtatgtaacctctgactcagagccgttgttaaccgcttcaccgtcagttgctgaagtagttgtatagtcaaggttagggtcggctgttttttcaggataatattccgcaaacacagcagtgccgcttgcaagaactccggcagcaactaatgtagaaataatcttttttgtatctaacttataatttttcataatatcctcctaatcaatttacttaatgttttgtttacagtaccttagacgaaagatttttataaaagttacagatttttataaattatttgtaattcgtaatatttaccaaaaaacacatgttatatataggaaataagtatattttaagcataaaaatacctgtgctgtaattggcacaggtattaaaaagtaggttaagtagattattatattaatattggctgaagctgaattcccttttgcgctgcctcaaccgattttggtatcagcttaaagtcggaaaccagcgagttttctttttctgagtaattatcctgtccgaatgggactatataaatattttttcttgaaagaagtgttcctatgtttcttgcgctgccgctgagaccatcatttgtggaaacagccacaactatcggtttgttatttctaagatgggactttgctgctaaacacactgcagtgtcggatatcccgtttgctaatttggatatggaattccccgtgcatggggcaatcacaaggacgtctataagttttttaggtcctatgggttcaacgtctgttagtgcggtcataggttttttaccggaaatatcatggaccgcgtcgtatatttcctttgctgttccaaacctcgtgtctgtatttgcgactgccggtgacaggatcggataaatatccgcgcccatatcagcaagctcagccataacggcaagcaccttttttatcgtgcaaaatgatccggttaaaccaaaccctattttgacgccttttatcgtttcgtccatataattcatcacctcgcttgctcatttaaaatattattaattgtgtcgcggattatgtttcctgccgtgagcggagcggtttttcccggcagcgataacgcccatattacatttctgcccaatcgttttgctgactcaaagtccacaccgccgggtttgcttgccaaatcaattatcagacagtcttcacggagttgtcttaacatacttccgttgattatcattttaggtactgtattaaaaactacatcgtattttcttgggtcagtgagaggcttagttatgtccgcgccgttatatccataggcttttatatatgctaaatcactctgtttcctaaccgccacagtaacatttgttcccagtccgcttagggtatgacataaaatctttcctacgcggccaaatcctgtgcataaacagttagaaccatgcagagtgacaggcagttcttccattgcgattttaacagcgccttcggctgttggtatggcgtttaagacggcaagttcctcacgtttcatatagtccacaacaccagcgccgtttagatgggacaaagctgtaagcctctcgtcaactttcccagctaaaatcagtttcttatccaaaaggatagggggctcgaatagatcactgatttttatttttgtttctgataaaggagtattaatattctcgttatctaatattgatgaatatggaaccggaagtacaataaagtcagcattgtttacggcctgtgccaggtcgttgcagacagtaatattctttttgcctaaaagttcatcactgtctataccgataacatttactgaatatccgtcttttgcaaatccaagtataacgtaaatctgccgtctgtcgccgccgataaatgcgaaagtagaatacttgctcatcttcaacacctcaatgtatattatgttggtatatgaatttggtgaagatatttataatcaaagttttatttaaaaaatttcaaatttttatattttaaataaacacatagtataatataattaggaagtaaaataataagaaataaaaaatgaaataaaaaaacggccgagatgtggtggatctcggccgggagtgtttctgcttgaactaacctcaagcagagggaaatgaaaaaaagattgtttagttgtggtatgggtatatattacagtatttgtgtgatttttgcaatagaaaaatttgttgatattgcttaaaaagataactatgtttttgttaatattttacaattatatacttttatacattgataaaactaaaagtatatgtaattaaaataatttttacacacaaaatacacttatatatttaattttttctatattcataatagttaaacgtctggttttgtgctcttttatagaaagataatctgctccaacgtctgaaagcactccgcatttttcaaatttgctgccggtttggttccaaaacgctacgcaaacgttttcgccgcagaagttttgaaggtattgttttaaaacggttgatgagttgttagaattctgaggaacactaaagattttctcagtgccgctcagcccgtttgttctaataatagcgtcataaaccgtcttttcttcgccctctgcgtccggcggaagtatcaaatcatcatagttgcgcgaatcaatgtttatatttaaagtttccatgttatgtttgtttctgcctgaacggcggttatttataggttgtttcaattaccattcctcctatcttagtaatagtctattcagaaaaaataaaaagtttacaaaaatatgaataacatttatatttttgcaaagaatagatttgcaaaacaaaattttaaaattttataggaggtttgacaatgtcaagcaaaagtaataatcaaaataataaccagaacaacaatcagaacaacaatcagaacaacaatcagaaacagaaccaaaataacaatcagaaccagcagtctagcagacagaacaacaatcagaacaattcaaattctaataactaattgcagaaaagcatatttaggggcaacaggtattgttgccccattttttcatttattacttcttgtatttgtgtcctgttccgagaataataactaagggaattgggttaaagacaaggaggtagataatattgcctttattaagcagaaaaagggttggatttatcatcactgttttttttgtttttttggtatttttcgggatttccgcagaggcggaggaagacggaaatgctgcggcagaaaaatttgttgttccgggcggacaaagcgttggggtttctttggacctcagcggggtctatgtagacgggctgggtgatgttgagaccgagggcggcgccagcgcctctccggcaaagtcggccgggatagtgtcgggggatataatcacagctataaatgacgaccctgtaaaaactgttgacgacttcaggaaaaaactgaacacacttgaagatactgaagaggttaaggtcaccttaaaaacaagccagggaacagaagagactaaaagcgttgttcctgttagagcgtcagaagacggttctatgaaaataggcgtttgggttaaagacgcggcttcaggtgtaggaaccataacctactatgacccgcagacaaaggaatttgccgctgtcggtcatagcattagcaacgttaacgccggtattgcttcaggtgaaataacaggagatatttttaagtccgaaatagtaggcgtgagacggggagaatcaggaaccccgggcgagcttattggagtttattcagaaaataagcttaaaataggagccattagccaaagcaacgaatttggaatcgtgggaaccgtttcaaatcccgaaaatctgaactctatgcgccagcctattccgataggcggcagggactcagtttctttgggtgaagcgattatatgttctaacgttgaaggaacaaaaatccaagaatttactattgaaatagtagagattaatcagaacagcgattgcggcaaagatattgtttttaaagttacagacgaaagcttaattcaaaaaaccggaggtatagttcggggaatgagcggaagcccgataatacaaaacgacaaaataatcggttctgtgacacatgtcttggtcaacgagccgacaatgggctacggaatttttattgaaaatatgcaaaaataatttaaaaagggtgattttttcacccttttttacagaattgccaatttttggcggttattttgtcgaatgggttgacaacaaaagggaaattcactataatttgaatatcgaatgttaccaaattatggcaaaaatgttacaaagaaattacgacagcgtttttcgacacttttgtctatggtaaatatttataaaaatttataaaaatttaatcacatagggagaaaagaaatggaaattaatcaaaaaatcaaagtagcagtagcagatttcgacagggagttcgcagacggattgtgcgagtatatgagacagactacaaaaattgacgtggtgggttgtgcgtatgacgggttggaagttccgggtttggtaaagaataatgacgtagatgttttggtaatggatttggtgctgccgaccatagacggaataggagttcttgagagaatcaacagaatgcagctgaataaacgtcctcatgttctgatagtaagctcagtcttgaacgagactgtaacgtcatattccaattcatacggcgttgaatattgtatgttgaagcctgtcaactatgatgcgctgattgacagaatcacaatgatggcggctccgataaccacaggcgaagatgtaatgcagaactggaaggtgaacacaaaaaagtttgactatgcacaggtagaagcaatggtgacaaacgttatacatgagataggcataccggcgcatataaagggataccaatacataagaagggcaataatgatggcgatatatgatttggatataatgaactctgtaaccaaagaattatatccaaccatagcggagaacttcagcacaacgtcgagcagagttgaaagagcgataagacatgcgatagagctaaaaataaaaccatctgtaatttaggaactaattagaattaattatttaatataaataaaatttgctactgcgcgcctaacgaggcagattacatctgccctgccgttgcttgcagaaaatattttttatacgagtatatatttgtaaaaataaaaccatctgtaatttaggaactaattagaattaactatttatataaataaagtttgtgactgcgcgccttacgcggcagatttcatctgccctgccgttgcttgcataaatcatttattatataatcatttagatacttcaaagaaataatattatatttccttattattaataataattgaatgataaacattttttgatatagatagtaaatatgaatataaaattgtttaaatattataattatcacaaatacttttagcattataagcatttttattattacaagtctttttcgttattgcaatttgtttaattattataagtataatatactctttaaaaatgatatttgcaagcttcggcagggcaaatgtaatctacctcgttaggcgcgcagtcacaaattttatttatattaaataattaattctaattagttcctaaattacagatggttatatttttacaaatatatactcgtataaaaaatattttctacaagcttcggcagggcagatgtaatctgcctcgttaggcgcgcagtcacaaattttatttatattaaataattaattctaattagttcctaaattacaaatggtattatttttacaaatatatactcgtataaaaaatattttctgcaagcttcggcagggcagattacatcgccgcattaggtgcgcagtcacaaattttatttatataaataattaatttaattagagcctaaaatacaagtgattttatttttactaatattataactcttataaaaaatgatatttgcaagcaacggaagggcagatgaaatctgccgcgtaaggtgcgcagtcacaaattttatttatataaataattaattcaattaaagcctaaaatacaagtgattttatttttactaatattatatactcttataaaaaatggtattagcaagcaacggaagggcagatgaaatctgcctcgttaggtgcgcagtcacaaaatttatttattatagaataatttgttcaaattagagcttaaaataaaaaatataataaacaaaaattttaacgattatatttataacagttttataataaaatatttttgattggaaataatataatagttcttgcagatttaaaatttttaacttttgacttattattttaatcgttttagataataatataataatcagttttaaaaaagtgtttgataaacaaagttgttgtaataatgtaactgtttttagaataatataagtttataaggaaataatatcaaaagaatttataattaaataatttatggaggacatagtatggatattattgcattgattttagtcattattggaggattaaactggggacttgtcggtatttttcagtttgatttggtagcgtttttgtttggcggttcggccagcatcatcagcaggataatttatacgcttgtgggtctcggcgcattgtggagtataacatttttcttccgtgatgaaatcttgtcaagattcaaagctaaaaagctggattaatataataagttatatgccgtgtttcttaagaaacacggcatattgtatattacttaatttgtaataatcagtttatacttccggcgctgttagcgtctgaccatttctgttcaagctgcacccagtcgggattccgtcctatatatgtccaggtctcgtaagttgaaccggcagggcgttcgtaatcatgggtattggttgcttcctgaacagcagtgtaataccattcatttttgtctttgttatctgcccatgtcttcatatttttatgaagaccgcttgtgcgtacatgtctgtttaaaacattgttgacaagcgtcatagcttcggctcttgttatgagctggtcaggtttaaatgttccgtcttcatatccttgtatccagccttcctcagccgcgatatttacataattctccgaccagtgtccgccaacgtcgccgaactttccggttccgctgtagactacatcgctaaatcttgcagcaattgttgcgaattcagctctggttatataagctgtaggcttaaaatacgctgtgccgtcaccaccgagaattccggcttttgtaagagtggaaatagcgttgttcgaccataagtcagccgggacatctacataatagttaacttgtgaccaatactgagatctggatttatcagtaagcagtctaaagaaaatagttgccacttcatctctggtgatattactttcaggtcttatatatccgtcaggatatccgactatatatgcaaagtggtcgtaagtattaaggttaggtttcggcgtggctgtaggtgttgttcctgtggagtgacctgagttgcctccgcccataaccgaagttttatagaactgatgtgagatagtcatggattttccgtcttcgcttatattaactatatctgctggcttgttatttatatatgctgtcattgcgccttcatctttagagaaagtgtatccatcgttagcgtggagggtcacagcggcagtataaacggtgccatagttaaaattgcttcccggatatactgttgggtcccattccgcttggtctgatgtgtaataggaatttcccggaatcttgacatcaaagcttactctttgatttgaagcaggagcttttatctcagctgacgcatagcgcataacaaatgtcagttcttgttttgccagcctgtttccgtatatgatatttataaacctgtctccggaatatacgtcaatatcaggtatttccgtgtctaatcccggtttgaatgtgaaactgtcttttgttgtttcgtcatatacaacgtttgaacttgttccgtctgtatttattatattgagaactaatccggttgggtcaaatttttctccgttgatatattccgtttttgtcggaggagttgatatttctatatggtctattgtgcttgcgtcttgtgtgacaaccgttccggatatgtcatatccgttcacgttcaggcttatgtcactgtttttcaaatcaggctcttttccttcaattgctatagctgaaatatcataagctccatttggtacagaagcagtaaataatactttatctgctgtatctgtggctctaaccatttctgtttcggaagctgtctctttatttataagtttaacatttgtgatgttttcatcagcatttatagaaacaagataaagaggttccggtgtttgggttggtatgtttgcggttgcttcaggagttggaatcggacttatggaagcttcagggtcaaaacttggtgttgcagtagggtctgaacccggttctgttgaaggtgaatttgtcgcttcagggtcagaacttgcagctgctgttggctcagcggaaggaacaaaagttggctctgctgtcggttcaatcgtcggttctgctgtcggggttgttgttggatcgggcgttggctccatggttggttcggctgctggatccaaagttgaagcagcagttggttccgacgtaggtggtgctgtggtcgtttctgcaggaggcagggtgggaataattgtaggctgtaatcccggtgtttccacagctgatggagatgcggaggccggctcaggcaaaatattaaatgtcactgccggcatattagaagtttggtttactgcgccgttattttttacaaaatattgtctcggattattagaagaagccattatccctgtcttattgtttttcaggtttgcgatattaattttatacccggaaaatatttcgtggttttcatttgttgttccatcatcttttagtattataaaatctgacccggtatcactggtattatatttgaaatcaaaaatggcgttaacatatttataacgggtgtttccaagccgtataggatttgctgaatttttaaagttgtttttgactatggatataaccgcgttatctgaaactgagtatatgcttatagcgttgttagctatatttccgaaattgttttcagaaaacacactgccgttttgaacttcatatatcccattatatccggtttctatacaattgaaataagcattgtcggcagctttggaaaaatcatttcctgaaactgtcagttttcctttaaccgacaaagatacaggcgttctgacgccgttgtttatgtatgaattttgggctgtaaatttacagttttttaatgaaaagtcatagtttccggcggcgcttataaatccgccgtcaccaaatgtaaagccattaatggtaaccgaggattttaattcggctttttcgcctgaggttataataacccgttcattggccggctcaattacatcgccatttttagcagattcaacggctgtttttagagaagtataatatgtatttccaattttggcggtgtaattattagttggttcaccggcgtatgccgtgaagaaggagaacatagatataaacacagttattgtcagcatcagaggcagaaaacgcagtttttttatgaaagtttttttcattttttaatccctctttctaaaataaattttttattatatatataataaatctataaccataatgaagttcttaaaaataaatttataagctttcgtataaaatcatcccaatttgtcgaaatgcactaaatatatttttaaaacaacacttagttagtatatatgacttctgttattcgaaaaaagttcccaaaatttaaaattttttctaattcataaaaatataaataataattcaacagaaaaatcggccgtatccgcaaaagcgaatcggccggtttttaaattttaatattcaaagtttactgcaattttattagtttccgcatctgcatccacagccacagccgcggtcattcttaccgcaattagaagatgtgaaatcatttgtctttgtcggcgggaagaattcgtctatcgggaatctaacgttatcaaaaagatcacatggatcctgaggtgtagctccgacgcaggtcttttccggaatacagaaatcaactgcatctatcaaaagctgaacttttctttctattctaacgatagtgaaaagacctagactgacaagaactttcttgatgttgttagctataacaagatcttcgccataacatgaacaaatgtttgtaggaatagaaacatttgtgtcacagcagcagcatgaatcgtcaacaaggcgtgcgctgagagctattgggttaactacctcaacagttattttaggcatgttgttgcttttccagatatgttccatgcagtctccggggtcgattgtagattcaaaactctttgtttgaccttcgcttccatataacataacgcgtttgtcataggttacaagtccgtgaacttctgtaggagcacaaacatccgagaatgcttcaatagtaacgtcaataaagtattttatgtctactgaataatagcctgagctatataatacaggttctgtgtctgtgtacacccagataatttccgcctttttaagtttaacatttattgcgctttctattatttcctgaccgcactctgtgaagtaaacgcgctcgtcaacaacgcaggttctctctctgcatgcgtcataaactttgtcaacgctcacacaaaccggctcagaaaattcttcactgcgtcttcttttgcattcgctgttctcgctttcagtatcctgaacagttccgggaacacttacaggctctgcagctgtttcagcattattacagccgcagctggctgcgcgctgtcttgtaaattcatttttgcagctcataatcaaaaatcctcctaaaatatttaatggtatgcggctttgccgtaacctcaatatattatattgcagcttccgacattatgttacacaaaaatttaattatgtttaggcacagctttttatataagtagatttagtctgtatttatgcggaaatatttgagtatgttgaaatatatataataaaaattttttatgtcatgatgtttattataattttcaatatattttgattcttaaaaattacagttttattgttattatatataagtttttaatatttttttaagtttttagcttgaagtattgtataaaatgctatataatgaaaaatatgaaagtaaaaatattttagagggggtatttttgtgcatttaaaaaaactattagcttttgtattaacatgggttttaggtattgcagggtcttctgctggtatggtaacagtttttgcggctaacccgtgggacggtatggtagaaaccagcgtactggaaaaagtaacggataccactaacagagtggggacagacggaacatttgacgggtatattcaaaccgttcagggtgcggatttgctaaacagcagttatataaaagttacatatactgtaacgggtactgtgaccgatgatacggaaattttcacagttcaaccgtttgacaccgcctggggcggatggaatgataacaagataaagataggcgattctattttatcggacggtgtttacacggcatatttgtcggttgctgatgtaaaagcttcgctcacctcaggaactttgaaaggaatcaatatctcgtttttagaaaactcaggatatgacgcaactttaaccgggtattattatttggctcctgagacagaagacccgggcgtgatgactgataaaaaaagacttaaattaagtcttgattactgtgccgggatggatgagtcaaaatatcagcctgattcctggtcaactttccaaaaagcggtaactacagcccagtcagtttataacagttctgttgccgatacaaaatatgccagtgctagagcagatttagaaaaagctaaatctaaacttttgtttgttgacagcacggaatcttcaaatccaatggattttagaataataagcggtgataacactatatacgaaatgggtgttggctggaatcttggcaatactatggacggtcatacaggttttcatccggcagaaacagcatggcagagtgttgtaacaactcaggaaataatcaaggctgttcatgacgctgggttcaatacggttcgtgttcctgttacatggggggatatgattgacgatgaaaatggttatgcaatcaatgacgcgtggataaaccgtgttcaggatatagttgattattgtacctcgcttgatatgtatactataattaatatccatcatgacggagcggagcaggacggctggctgagagttgccgctgacgatatagataaggtatatgaaaagtttgaatgtgtatggagacatatagctgagcattttaaggattatgacgagcatcttatatttgaatcggcaaacgaactaacttgtatggaaggcagcgacaagaattcgtctgctgctattactaaagatacgcctgttatagtgaatttaaatcagatattcgtcaatgtagtgcgttctacaggctcaaataatactaaacgctggctgtcagcagtatctcactatgcaaatggtggaacgcaaagcggattcgcattgccgactgattactataattccagcaaccgtcttatgttctcagctcatatatataagtcaagcactaaaactagctggacatattcagaggtatatgaggttgtatcggctttgacaaagatggtaaagaaacataaagttccaattatattgggagagtacggaaacagaaataagatgaacagtgctaatccgagcggatataatgacatagacagggcatggtttgatgaaatagttactcgtgcttgccaggttggaaaggttgttccgtgtgtttgggatcagggatggtttgatttgacccagaagccggattcaacattctcagtttggaaccgtgagggaaacgctccgatatttaagaccatcaccgacgctatgatgagaggcgtctatctaactccgtcaagcaaaaataagagttatgatatgactgatatagctatcaatcctgctataaccaatataaccgatatatctttatcagacgccaatattgatattgagtatggtgacagcgtcacagtaagcgcagaggttcagccgttgggaacaaatgacgttctgctgtggaaatccagcgacgactcggttgctactgtttcaagaggaatgataagaggaagaaagataggatacgcgactataacagcattttcgcagagcggctctaaagaggcggaaatgactgtcagggttcttcctaaaaattcagataagcaaataacctcaatattaactgacagtgaaagctatcaggtgatgaaagataaatatgttaatatgagtgttttggctgagcctgccgataatactgattcattgatttattcatcatcaaatccgaaggttgcaactgtcaatccactcggcaaaattgttggtgtttcagctgggcagacatatataactgttatgtcttcaagcggaattacaaaaacggtgccggttacggttacagagtccgcttctgatgaatctatagaactggcggcaaatgtatattataacgatacgctttatgctgcaaatgagataggaacgccgataaaggtaaatggagacggacaatatactgtttcgtttgatactgcagtcgatttgtctgataaagctaagactgccggtataaaatatcttaaaaacttgacctcagtttatataaaggataatgcagtagcaacaggtcaggctgtaaaatcaccgcttgacagctgtgatataagatatgattcaattaagcttgacggggttccgcttacaataaccaagacggactttaagtcagctttaaaagacaacagcgtatttgatacaaacgaccctataaacggttgggatggttccgcggttaaagaggtatcgtcaagtaaccataccgttaactttacttcatcggatacaccgtcaaagattgagataacatttacacttcaaaacctaaaattcacgccaaacagttctgacgacagcaagccggctgagaagcatgaagctgtgtctgataaaaggatagttttaaatgccggtgatagttttgaaataaagacaaaaatttctccgtctgacagtacgtcattggtgacgtttgtgtcttctgatgagagtgttgcaatggttaaagacaatgctgtttcagctgataataacggtgtttgcacagccaaacttacagcgctcagagaaggttccgcaaagataaccgctgttactgataacggacttacagttgaatttgacgtgacggttggaagtatggcgtttagcaatgctaaagccgttatagacggaggaaaagtcacatctgttactgccgatatgaattatgctcctgaaagtgatatattagcagtagtttgcgtttatgacgctgacggcagaatgagcgtctgcgattcaaaacctgtcggtttagataatatgtctaacggaaaacttactgtttcaggttttgatattccggtatctgacggacagacagcaaaagcgtttatttggaattcgtttgaacaaatgataccgcttagtgattaaactgacttctttattatgatcaattaaatataactccctgggagatacggaaagtgcagctctgttttcatagacagaactgcatcttcgatattttcccggggagttatttatgcaaaatttacgccttacgcaatatactttgtcaagattttgtcaaatgccccaaactgttttcagaaattaaaaaaattaaattatcctgttgcataattataattttatgatataattatcacagtaagcggtttcaatcgaattttggcggttttgcagccgaaagggtgcatttgtatttattttttttgcctaaatcggtgttccgcaaaatgaaaggagcaaacatatgaagtattcaagtgaagtagaagcgatgtgccccttggcgaagggtgcgtatcacggtcctgcgcctattcctcaggagggaaaatggacgcaggctaaagaagttacagacatttcaggcttgacccacggaattggctggtgtgcacctcagcagggcacatgtaagcttactcttaatgttaaggaaggggttatccaggaggcgctgattgagacagtaggctgcagcggtatgacgcattcagcagctatggcgtctgaaattcttgtcggtaagacaattttagaggccctcaatacagatttggtctgtgacgctattaacacagcaatgagagaactgttcctacagattgcctatggacgtactcagacagcattttcagaagatggactgcctataggagccggtcttgaagatttaggtaaaggtcttagaagccaggttggtactacatatgctacacttgctaaaggtcctagatatcttgaacttgcagaaggatatattactaaatgtgctgtggatgaaaacgacactattataggatataagtttgttcatctcggaaaaatgatggaaatgattacaaatggtatggacgcaaacgaagctttggaaaaggcgagcggtcagtacggacgggttgacgatgcagttaaactgattgacccgcgtcacgaataagaataggaggaatttaaatatggctttatttgagagttatgaaagaagaattgagcaaatcaatgcagagctagaaaagcatggaatttcttctattgaagaagcaaagcagatttgtgacgataagggtgttgacgcttatcagatagtaaaagatattcagccgatatgttttgaaaatgcctgctgggcgtatacggtcggcgctgccattgctattaaagacggatgtaccaatgctgctgatgcagccgagaaaataggtcttggtctccagtctttctgtatccctggcagtgttgcagatgacagaaaggttggaataggtcacggaaatttgggcgccagactattgagagaagagacaaaatgctttgcctttttggcaggtcatgaatcttttgcggcagctgaaggagctataggtcttgcaaagagcgctaacaaagctagaaaggaagacttgagagttatcctgaacggtcttggtaaagacgcggctcaaattatttcaagaataaatgggtttacatatgttcaaactcagtttgactattacaccggtgaagttaaggttgttaaggagataaaatattcagacggcgagcgttcaaaggttcgctgctacggtgcagacgacgtgcgcgagggtgttgctatcatgcatcttgagggcgttgatgtatctataacaggtaactcaaccaatccgacaagattccagcatcctgtagcaggaacatataagaaagaatgtatcgagcagggcaagaagtatttctcagttgccagcggcggcggtacaggaagaactcttcacccggataatatggcagccggtccggcttcatatggtatgacagacacaatgggaagaatgcacagtgacgcacagtttgccggctcttcatccgttcctgcccacgtagagatgatgggacttataggaatgggcaataacccaatggtaggcgctactgttgcagtagccgttgctgttgaagaagctatgaaataaatataactgcgttgattcagcttgctttatatgggttgaattgaagcggctgaagtgttatatataataaaaataacagaactgcccgcgttttgcgcaccaaactttactggtgagcaaacgcgggcagtttctatatttgcagatatttaatggaagtgtataaaaatattatttttaagcagatgcttatatatgttttatgcaatatattgtaaaggctgcaataatatgaagagaaataaaaaggctgagtaatataaataattatataaaaatgtggctagcaagcgtctgaggagtaacttttaccgtatctgaaagatgtgtacagtcgcaatgacactttgacttagaacctacaatgtcaataatatgaataggcaaattatgactgcgactgtaagatatatgtagcccaaataacactttatataaaattggttaggctacaataaattggacacaaatgttaaggtcatatatcataaaaataatattaatattatataaaaatgtgctcttgcaaacatcggaatgcagatgaaatctgccgcgtaaggtgcgcagttgcggaaaaatttattagtaaaaaggattatggcaaactgtttaaagtttatactaggtgtgatatggcagcttatctaatgagatgtgcagcaacataagattgacaaaccctagttggatagtggataataagagtaataaaattgtggaggaatgggatatatggatagaaaagagcttgttaatcaaagtattgactatataatgcagcatttagataaagatttatcacttgatattttggcttctgaattttatatatcaaaattccatttcagccgaattttcaaagaagaaaccggtgaaagcgtttatgcatttattaaacggtgtaaggttgaccagagcgctgtagatataaaactgaacccagctaaaacaattacagatattggattggattacggatacagttcttccaattatagctcggtgtttaaaaaacatcgtaatatttctcccactatgtttaaacagtcaattccggctaatagtatgacagttccgtttacaccggagagagttgttaattttaaaactgcagatgagtattccgcacgaattgacattcaagaacttaataacttttttgtgatttatgagcggtttattggaagttacgaagatattgaagagaactggtatcagtttttagatagatataatatttatttaaatgaaaatacagttctggtggagcgattttataatgaccctgctataacaaatctgtcgcagcgtatttgtgacatttgcatgacggcagaccgaaactgtaatttgaataatgttacggagattaaaggcggcaaatgtattgtgtatcattatgatggaaaaatcgaagatatttatgagatattacaagggattttcagtgtttggatgcctcaaagcggttataaaatgactcagaggtatggattgaatatttatcacggcattgacagaaagagtcatagagttgttatggatttatgtattccaatttaattagagcaagaattcagaagtcagaagatatatttatttatataattaatggtgttcagtaatacttcaccggagtggatttggagctcatataccaaataagttaataaagaaacattgtatagaaaataaaatacaaattactgttcctaaaatattattagtgtttagaagtacagtaatatgtgttttgttagaaattctattaatcaataaatatttaatatatggaggaaactatgttcgatattagaaaaattcaagagaatataatttatgaagctgtaagggctgaaagcaatgaggatatagcgaatgaagtggtgtatggtaaagacaatatgtcaaaagcagaaaataattctgattgggtaaagtcatcaatgattcgcttagaaaacaattttgaaaccgaaacaataaagaaaataagaatgaactgtcaatgtggttacgaaatggacgaaaaaattgcacttgtaatggaactgaagtcagattcatcaaatatagaagaatttgcaaatgcagagaaagcaaaagaagccgggcttttttgtaaagacggagaactttttctgcaatttgatttttgcccttgtccaatgcttgccgaagtggataaattagagacaaatacatggtgtcagtgcactacaggttacagcaaggttctttttgaaaaggcatttgattgtgatattgatgtagaattgctcaaaagtataaaaatgggcgacgatatttgtcttatgaaaattattttacataacccggtctggcaatgatatatagcaagcaattatcagattttattttaagagaagaaaatgaataataaatatgtttaatttcaaaattgaaattaagtaaaaaaacaaaaaacggatagcaatttaaatgataggctgtcttttttgtttgccgtataaaatagttgaagttagcggagagaaaacaaatttgagtataaatgatatatgtaaattttattaactattttcatattattagcttttgatacgaatgtttatcataccataaagcaaacaatggcaatagtatttttataatcttatatcgtggtgttttaaaatagaacatccattcaaaacagattctaaatatatgttttgaatccacgcacccataaagggtgcgacaattttgcaccgggattatcattcccatatccctcgtttcaatccaacatcttccgttttgtttgatgttcttactatcataataaagtaaatgtttatatatttctatttgcatattgttgcggaaaatgacactgattttatcagcatataagtttatttttaatcgacgtttttactcaggggcgataattcgttgtgtctgcgcattttgtatcaaatattctatctgtactgtacagaacatatatgcaattgaacacacaaacttagtgtatatatctgtatattgtataataagtgttttattaaaattattcataaatgaataacaattttacagacatatagatttttttgaaaagcttattttaatcaagagtgagtataaggtatgataataaataagatttaattttgaattggaaatgtaatttcagtctatttctatataagaagcaacggaaattgccatttgtatagtggagcaaacatggttgaattaacattcttctcatgagatgttgcatatcttaaaatattggttaaaaagtagataaataatatatacgtatttatattggagacttttatgattattttgcatgtaatagattatagttttatacatacccagtatggcagaatttttcacatttataataaactgttttactattttgttccaaaacatatatgatatagattaaaatatatgtaaatttacttaatgtcaacgtaagtttctgccaatagcagaggggaagccacaaaatttgtataggcgattttgacctatgagtttttaataattttatttatctttaaatataagttgagactataaagttaatcattatttgtacaaagatagaaatatcaatccacaaactcgcataggacgacgatacagagatttaccaaagtatatacgtcgcatctacgcactcgtatagagtgcgacacgattgtccgaaacacactattgataagtattaactaatttaaatccacgcactcatatagagtgcgaccggaatacaggtgtaggaaaattgacttgacacagagatttcaatccacgcactcgtgtagagtgcgacatacttttttgtgcaaacatcttaacatatgggtatttcaatccacgcactcgtgtagagtgcgacagcaaaaatatataaaaataaatttgttaaggtatcatatttatgtatttttatattaaataagaataatatatattaaatgtattctataccttagtcatatttaaaaaatacttatatatttctgtttaaaagtggtgcgaatctccctgacattttatgggagcttcaggttcgcactattattttagatatttttaatactgctttatgtttctatttttttgttttttacttggttttaaataattcgataaaatagtttttacataatattttcaattctcaaataatattgttttataatttataaaatattgaacattataaatcttttcttctattatacaactcttttcaatataagtaaatatatttttacttttttatcctattaaataaaaatcttataactcatatttataaataattattattaaaattaaatttatcaataaaacaagctgtttgtatattaaataatttatttttataatttataaacatatattttttaaaaagtacttgattttcatgaatatatagtatataatattatcgacatatgtcggtaatggaggtgagttatgtcaagaccttttaaatgcagaagaatatgtgaagaacctaagtataacagctttgcaccgcttggcgttgaaaatcctgagaaatgtatgatttctgttgatgagtatgaggcggtaagattaattgaccttgaaaaaaagacccatcagcagtgtgctgaacttatgggagtttcaagagttacggttacagatatgtatgaaaaggcacgttttaaaattgctgacagtattgctaatggaaaaatattatgtatcacaggaggaaactatcggatttgcgaaggttcggtaaacaaatgctgtggaaaaaggtgtaaaaaattaaaatcaataaaaaatttagttgtaaagaaaaaaggagaaggtaaaatgaaggttgcagtaacttatgataatggtgaagtgttccagcattttggacatactgaaaattttaagatttataatattgaagacaaaacgataattgacgccaatgttgttaataccatgggcagcggtcacggggctcttgcaggctttttagttgaaaatgaagttgatactttgatttgcggcggtataggaggaggcgcccggaatgctttatctgaggcaggtatcaccctttatggcggtgtttcaggaaatgctgacgacgctgtgaaagcattgatagatggaaacttgggttataatcctaatgttaaatgcagtcatcatgaacattcatgcggcgaacataagtgcggagaggaaaagcacggctgcgaaggcaaataagataatgattaatgaaataagtataggaattttataataaattctgtgatttttataaatttgcaacatatgttttaacatgctatataattaatttgtatttaatgggctgctgtacgaattcagcagtctttttttattatcacttatcttaaaaccaatttgtaaaatatcatattactattggtgaacggaatatgtttttgaagtttttataataatcaaagttattatattaataaattattgtaaattatttgcaaggttaacagaaaactagacagaaaaattaagagtgttttttgtaaacaacggtatataggataatattttaaataaaaagttatataaaaatgaggtatagtatgaattgtatggctttgactgaacctgaaagacgggtgtgattcaaagtgacttgttttgattaatttacaatgtcaataatcagacttagttgtgaaggcggatgaaatctgctgcgtaaggtgcacggttgctgaaaatttattataataaggtttataatgaacttttctaagtatgtttgcgcttagcgtgatatgacggctcacctgtcgaagcgtgcaagcatgcactgccgttgtttgcataaaacacatttaattatcttccaattattgcagcctttccaattatcgggcgtcttacattaacagctgactgtattaaaataaaaaataattaatgaacaatttgaatatatttgacaaaaaaatccctctgtgaattttcacagagggagagaactttttatttaaataatcagtattattaagtgagattatttaaattgtttatatgattaatatattcgtcttttgtatagaagtttaagacgtcgatatctgtttgcagttttttgagaatttcggcggtcgagtcagaagaaccataatcgacaaccgaaagtccgctgactgttatgtttgcgtttccggaagtcaattttccggataattgtctcaagagcccctccacatcgttttcctgattcttgacaaatacgacaagctcagacggaacttcagtttttttctcatgactgagcccttcaacgataccataaaggaatgtaataagaccaattatcgcaaatataccaacaaacaccaacaagatttgatttatcatactgccatcaactccttgatagtagtataatatgctaaaaacctctatttgtgatgatatttatattaatacattccgccgcctgcgcccatagcagcagctgcagcagcgtctgctgccggatccggcttatcagctacaacgctttctgtagtaagaatcatagacgcaatgcttgaagcgttctggattgcgcttcttgtaacctttgtcgggtctactataccaaatttgagcatatcaacatattcacctgtaagagcgttgtatccaacaccaacttcgctgtcttttatcttattaacgataacgcttccctcaacaccggcattgtatgcgatttgtctaacaggctcttcaagagcgttcagcacgatttgggcacctgttttttcgtctccttcgagtgagttcataagttcttcaatagccgggagagcgttgatatacgcggtgccgccgcctgctacgataccttcttcaacagctgcacgtgtagctgcgagggcgtcctcgattctgagcttcttttctttcatctcaacttctgtagccgcgcctacttttataacggcaactccgcctgaaagcttagctaagcgttcttgaagcttctctttgtcaaactctgatgttgtttcttcgatttgagccaatatctgatgaactcttgcattaatgtcatctttgtcgcccattccgtcaacgataatagtattttcttttgtaactttaacctgacgcgcacggccgagctggtttgtctgagtttcttttaagtcgaggccaagctcatctgaaatcacctgtccgccggtcagaatagcgatatcctgaagcatttcttttcttctgtcgccgaatcccggagcttttacagctacgcatgtaaatgttccgcggagtttgttaacgataagagtagaaagagcttctccttcgatatcctcagcaatgataacaagctttttgccttcctgaacgattttctcaagcagaggaagaagttcctgaatgtttgagatttttttgtctgtgataaggatgtaagcgtcgtcgattacagcttccatcttttcggtgtctgttaccatgtaaggagttatataacctctgtcgaactgcataccttcaactatttcagaatatgtctcagcagtctttgattcttcaacagtaataacgccgttgtttgtaactttctccatagcttcggcaataagtgtgcctactgtttcgtctgcggcagagatagaagctacgcgggctatatcgttctttccgtcgatagccttgctgttttcaacaattttgtcaacagctacgtcaacagctttcttgataccctttttaactatcataggattagcaccggctgtaacgtttttcagtccttctctgactagcgcctgagctaaaagagtagcggtagtagtaccgtctccggctacgtcgtttgtttttgtagcaacttctttaacaagctgtgctcccatattttcaaaagcgtcttcgagttcaatatctttagctattgtaacgccgtcatttgtgatgagcggagcgccgtatttcttgtcaagaacaacgtttcttccctttgggccaagtgttactttaactgtgtttgcaagctgatcaacaccgctctgcagtgcctttcttgcgtcttcaccgaactttatttcttttgccataatgcattacctcctaaaataatgtataagtctggattaatcaacaatagccaaaacatctttttggctgatgataacatactcttcgccgtcaagtttaacttctgttcctgcatatttgctcataataaccttgtcgccggcttttaattccattttaacttccttgccgtcaaccactccgcctggacctactgcaatgacctcggcgaactgaggtttttctttagccgaacctgctaaaataataccgctttgtgttgtctcctcggcttccgccatttttgtgactactctgtctcctaatggtttaatgttcattttatatgcctccttaaatttaattatctaatctgttagcactcgtcttgtttgagtgctaacgctattctactcgttttcagtctataaatcaaacttaattatctggaattatatgctattattgtcagttatattcaattataatacaataatcattgatttctaattttttctatacaattacaattaaaaaagctagtctcttcggtataaaagaggagggtgccgttcgattttcataagaataaaattaactgctgaaatgttggatggtatttttatttagcagtatcagattattcttattgtgccttttttatactgcataccgcctgagcggaaattccctcgcagcggccctcaaaaccaagtctttccgttgtggtggcttttacgctgacgcggtctgtatctatattgagagcagaggaaatattgctgcgcataagctcaataaacggtgcaagtttaggttcctgtgctgctatcacggaatctatgttgattacagcataaccatggtttttcagcagctcgcctacatgtttaagcaggtcaatgctgtccgcgcctttatattctttgtcggtatccggaaaatgttttcctatatcgcctagcgctgcagcaccgagaagagcgtccattaaagcgtgtattaaaacatcagcgtcactgtgcccgtcaagacctttttcgtatttaatttcaactccgcctagtatcagctttctgttttcggtcaacttatgcacatcatatcctatgccgactctaatatcattattattatttgtcaatataaattcactctccttgcggtaatattatttgtacagtcaaatgtgtaaaagcggagacggtaatgtctgtttttataatttagaaagtcatgggtttaatattttgttattgtttaaactgccagtctgccaagatattctccgagaataatgcccgaaagacataggatgacactgagtattgcgtaaattgttcccaaaaaaggttcgccgcgctgaaacagttgtacggcttcaagtgaaaatgttgaaaacgtggtaaaaccgccgcatacaccggttttaagaaataacaaaaacttttttgatataaatagattatccgaaagtccgacaataaatcctattaacagcgcacccagcaagttggttatcagtgttaaaaacggaaaggtgttgttaacaggtattaaacttattaaatagcgcagcatggatcccagtgctccgccgagccctaccataataaattgaatcagcatattggtctccggtggatatatatcacatccactttttctttttaaatattaatatcagaaacaaaactatcgcggcgcttactgcaattactgccgggtatccgtaaacggatttaaattcaggcatatcaaaattcattccataccagcctgccagcagtgtaagaggaagaaagatagctgtgacaacagtgaatactttcatcagattgttctgacggtaatcaagctgtgactgataagagtcgagaaccattgctatgtagtccctcagattgaccgcgtcgtttaagagatggtctatgcgccgctgtattattccgcagtaccgcacgccgctgtctgagagcaaatcattctcatttgccaggagctcgtcaaatattagttcgagctgttggtagtaacgtttaaaattcagcaggtcttttctaagagaaataatcttccttgtaaaatctttttcttctcctgaaataaattcatcttcattatcagtgatacggagttcgtattcatcaagccatgccatatcgtttttcagcagcctggcaaaaaaatgatacaggagctgttcgttgttcagcgaaccgtccgaggcggcagttccggcaagttcttcagcgaccctaagcataggctcttcatgacatataaaaaatatattttctttgtcgagataaattgtgattttagaatcttgtttatcttttatttcatggtagttgaaagataataaatcgaaatcttcaaagctgcaaaaaaattctatctgatgtctgtcacctgataggagcttttgaactttgtcgccgataattccgctgatttcagatatattgctgagcgtaagtattttttgcatggtatgacaaccccagtattatgtattgttttgaattttagcgatgatagcttccccaaggattatatcttcgggagtggtgatttttatgttattataatctccggttatgactttcaccggttcacttgttaaagcttcaataactgcacagtcgtcagttacggagaggttcaattctttggcttttttatgagcttccataataatgccatatctgaatccctgaggtgtttgtattgacacaagtttgctcctgtcaggagtgttttcaatatatccgcgttcgtttgtttgcttgattgtatcttttacgggtacgccaatagcagcggcctttgacgagccgctgcggagttccgatataatttcttttatataatccgctgatacaaaaggtctcgcgccgtcgtgtatcagaacaatatcatcattgccggaatttaaatgagacaaaccaagaaaaacagattcctgtcttgtgcttccgccttcgattactgcgctgactttttttatattgtgctcagataccagttttttgattatttcaatatcacattttctggtaacaattaatacagaatcaatttcagacagaaactcaaaaacatttatggttctgattataacaggaatgccgtcaagctcaataagctgtttgcttatattagttttcatacggctgctgctgccggcggctacgattattgctgtagtcatatattaaatcctttcgcgctaggaaattttgctcataagcatatcttcaatgtcagaatacgacgagtttttggacaaaacgagctcagaaatcaatatggttttagcgttgctgagcatttttctctcagcgtttgaaagactcttctttctgtctctcattatcaaagtttttgttactcttgcgatttcaaacaagtctccgtcttttaatttttcaagattatcccggtatctcttattccagttatcatcttcgtcgcagctgcatttttcgaagtcattgatgacagcgtctgcctcgttctcagatactatatatcttatcccaactttttctatccttgcgacgggaatttttatctctagttcaccaacgcagggctctaaaacaaaatactggtgttcctcaccgagtattttctcttcctcaacacattttataatacctgctccgtgcataggataagagactttgtcaccaatttgaaacataaaataacatcacctttctaaattttgcataaaatagatttcaatactcaaacattgtgagtacgtagtctgtttacatccgtttaaaatatatctttcattacctgtgttatattcgagtattgacagatttctatatttttaaactttttccggtcttttgctcccatataaggaacaataatttttttgaatcccattttttcagcttcaattattctgctctcaagaaaactgcaggaacggatttcacctgttaaaccaacttcgccaacagcggctatctcttccggaaccggcttgtttttgaagccggaagccagcgctatgattattcctaggtcggctgcgggctcaaccattctgagaccgcccacaacattgatatatgtgtcataagatgacagatgaagcccggcgcgcttttctaaaatagccagcagcatcatagctctgttgaagtcaacaccggtggtcattctgcgcgggttaccaaaagcggttggagtagctaaagcctgaatttcagcaagcacaggccttgttccctccatagtgcatacgatacagcttccgggaacaccctggggtctgcctgataacatagctgacgatggattttttatctcagacagacctgatgaattcatttcaaaaacgcctatctcatttgttgaaccaaacctgttttttattgccctgattattctgtatgaacggttttggtcgccttcaaagtataaaacgcagtcaacaatatgttccaaaaccttcggtccggctatagagccttccttggttacatgccctaccaaaaaagttgcgatagaataggtctttgctattctcataagcatggaagctacgtcacgtatctgtgaaacgctgcccggggcggaattcacgttggggttaaacatggtctgaaccgaatccacaatgagaatatcaggcttttccctggatatacattcaagtatgttttcagtattggtttcagagaaaatctttatattgtcactgtccacacccagtctgtcagcccttaattttatctgtctgagagattcctcgccggaaacatataatattttctgcgtttttccaatgtgctgacaaatttgaagcagaatagtggattttcctatacccgggtctccgcctaaaagaaccagcgaccctgcgacaagacctccgcctaaaactcggtcaaattcagacagtcctgtgcctgttctgatttcgtcagttgttgatatgtttttcagacgctcgggaaccgctgagtctcctgcgttttcaagagccgaaatagcgtctgatttcatgcctgagcgtgaagatttacccggctgttttgtaattactgtctcttcaaccaatgtgttccaggagttgcaggctgtgcattttcccatccactttggaaattcgtttccgcattctgtgcagacaaaaactgttttggttttcattaatcctccagactcagaatattttaaacacttcatattaaaaaatcatgagttcttacttatatttatactcatttattataacacataaatttacttttgtctaatataaaaaatcacaattttttgtgccggttgtttattgttttatcttaattttgccatttttttggcaaatatggcatatatgatgtgtgaattgtatatattagtatgtgcaattgttagaaaaatgtaataatttcacacttgatatttgcggtctaatattatataatctctctatattgtaaggggtgaggcttgtgcatacgtacgtattggaaatcattgtcgatttcttagagcttttcctcttttttattggtacgtattatgtcgtctgcggcgtattctcttttgttaaaaggaatgacgtcttaagacaagattttcggacaaacagattcgcggttataatacctgctcataatgaaggcgctgttttgggccagcttttaagcagtatttcggcttcaaggtatccaaagaataagtatgatgtgtttgttgttgccgacgattgttctgataatacggctgctgttgcggggagttatggagcgagagttcttgttaaacgtaccggtaataacaataaatcgtccgcggtttcatacgctgtggagcatataaagagtttgagagaagaatatgactgtattgccgtatttgacgcggataataccgtgcatatggattgtataatgagaatgaatgagatgcttaactgcggatattctgctgttcaaggatatgttgacagcaaaaatccgaacgaaaactggctgacagcggcctattcggtttggcatactcttgaaagcaggcttgctaaaatgtcgtgccataacctgggaatagggtgtaaaatatccggaaccgggtatgctgtgaggtttgatgttgtgaagcgctgtatgccttctgacgactgccttgccgaggaccttgaatatactgtcagacttagactgatgggaattaaagttgcctttgctaaaaaggcggtggtatatgatgagaagcctgctgagttcggtaagtcggttaagcagagaatcaggtgggctcagggcgttgttgacgtccagggcagatacggtggtcttttgctcaaaaaaggaaaaataatagactggctgagcctttatggagattttttgggtcagttctgttatggagtttttttggtcataagtattttctccacaatttctattttgtttggatatcagtttgctttatgcagtttgtgggttcgtcccgtctgctatgtggctcttaatttatatttgggtatcggtgctcttagtgcctttgccgggcttatattggaaaacaaacttagccggaaaacaattttcaatttatttggttttctgctctatatagtaagctggataccgattggaatagtcgggatctttaagcataacaagaaagagtggtatcatacggaacataccggttctgttcaatagcacagtgtgtgcagaagctattttgataaaaattatattattttgtgatagatttgtatgatggcaatagctgtcaatattttttggaggttaattttatgtgcggaatagttggatacgttggaacaaagcaggcggcgccgattttgcttgacgggctgtcgaagcttgaatatagaggatatgattctgccggcgttgctataatgactgatgaaggaatagtggttaagaaaaagaaaggccgtttggaaaaactcagcaatatgatagacggtggagacgcaataaaaggcactatgggaattggtcatacaaggtgggcaactcatggagagccgtcggatatgaactcgcatccgcatctcagccagtcgggtagatttgcggtcgtacataacggaattattgagaactatctgaagcttcgcgagtatcttacaaaaaagggttttgactttatttcggaaaccgataccgaggttatagcgcatctgtttgagtattactataacggcgatataatcgacactatgattaaggttataggcaaggttgacggttcttatgcactgggagtgctttgcgccgacgacccggattcttttatagctgtcagaaaagaaagtccgcttatagttggtctcggcgagggcgaaaactttatagcgtctgatataccggctattctgaagcatacgaagaacgtttattttcttgaaaacaacgagattgttgtcttaacaaaagacgatgtaaaaatttataacaccgaccgcgaagaaatttctaaggaaacttttgttgtcgactgggatatttccgccgctgaaaaaggcggttatgagcactttatgtttaaagagataatggaacagcctcgtgccatagctgatactgtaaacccaagaataaaagacggcagaattgttttggatgatatatctttaacagctgattatatccgtgatataaacaagatatatattgtggcctgcggcagtgcttaccatgttggagtagttggcaaatatgtgattgagagcatggttcgcatacctgttgaggtaatagtagcgtcagagttcagatattgcaatccgcttgttgatgataagactttggtgattttgatatctcagtcgggcgaaactgcggacaccattgcggcaatgagagaggcaaagcggttaggggcgagaacatttgccatagttaacgctgtaggaagctgtatagcaagagaggcggatgacgttctctatacatgggcaggtcctgagattgctgttgccaccacaaaagcgtacagcactcagctgacagcgatttatttgatgtctatatatatggctcaggaattggatatgctgacccctgaacttttggcaaaatatataaaggctcttgaaaagctgcctgataatatttctaaacttttggaaaacaaaggcgagatacagtatatagcgtctaagtattttaacagcaaaagcgtgttcttcctgggaagaactttggactacgctgtggcgcttgagggttcacttaaattaaaagagatttcatatatccattctgaggcgtatgcagcaggagagttaaagcacggaacaatcgcattgattgaagaaggcacggttgttgtagcgctgtgcacagtcaagaatttgtttgataagatgctgagcaatataaaagaggtaaaagcccgcggagcggtagtaatagccgtagcggaagaggggcatacggaaatagaaaaagaagcggattatgttatctaccttccaaagtgtgacgagctggttatgcctagcgaagtagtagtgccgctgcagttgttttcgtactatgtatcatcattgaaagggttagacatagataagccgagaaatttggcaaaatcagttacagttgaataataaatattaaaaagcctgcgtttgaggtgatccaaaagagttagaccaaaaatctaacaattgggtcggctcatttgcaggctttttttattgtattttaaagttttaacttaatcggcttcccagaaagggaagccgatctcgcccgggttcggcgggcgaaacagggtctggcgcagcaaagtaagtaattaaagaataattaaatatttttatattcgtattacactttgggtgcatttacatagacaaaaggtctattagtacgcagtttacacagtcatatatataattagtatattaattattttaaggtcacagagtataaaaatatgttcgggactgcgcgccttacgtggtgtactccgtacaccctgccgatgcttgctatatacatttttttgtattgacagatatataaaagcaattcttatataacagtaatatcggtgtatagttgctggataaattaattattaacaaattgtaatattgggtcatataaaaggggagcaaaaaagatgaataataaatttttaaatagcaaattttctaagagagaaaaaagaatacgcaaaacttattaaattgaggatgaattatataagtttttagaagaagcttctttaactcacggtgcctctgtttctgatattttatatttatgtatatcagaattagttagaacgaatgatttaaaaatttatactgctcctaatatgaaaaatccattacataattttaatatagcagtcagcaatgtaaaaggtcttgcaaaattaagtgagaccaccccatttactataaaatcattagtaaatatgtctattaaaaatatcatatagttattattatattataatataattcttaaaattgtggctataatcataaaaaattattataaattaattactatattattgtagattttaataacatttgtagtcgtattttgttagtcgcttaactaaaattatatattttattttgaaagtatttgtattaaatagtatgtatgcagattaataaaggtctattgtaaatatgatagatatttaatagcagcaatattattatagcgaagaaaataatatttcaataactacacaaaaataatctgaatatatgaaaacttaattgaaaaacaaaagaaagaagtaatacaaaaggcataataaaaacccgccgttagaaggcgggttttaaataccatagtaaagtatagcacaaacaatatcttaatttatatattttataaggtcaacaagctgaataaactcatgcttaaatccaaattcatcttcaccaacccctgattgcgcttgtttaattacattttcaagtgtagccgatcctttatattctgaatcatttaaaatcattccaagcagggctgctgcggaagcgaacttgaaattctcagacggattggaatttatatttgatcctataggctcttctataagcttgctttcagtgccgtcagggtccttatacctgattttaagatacataagctcgtcagatggttttgcatttgtatcccggtatctgaagtcctgcgtttcagtcccgtctgccggaacaatttcataaaaagcggttacaacagccccggcgccaagttcaccggcatccttttcgtcgttttcaaaatcttcattgttcagtattctattttcgtatcctacaagtctgtattctttaactttagatggattaaattcaacttgaagcttaacgtctttggctattggatacaaagtctttatcatttcatcagctaatacttttttggcctctttgatgttgtctatatatgcgtagtttccatcgcctttgtcagccaaaatttccattctgttgtctttgtaattcccggttccaaaaccaagcacgctgacaaatattcctttactgcgtttttcagtaaccagttgctcaagttctgtagttgaagaaggtccaatattgaaatcaccgtcggtacataatattattcggttgttaccgtcttttaaatttttctctgccaattcataggctttgtttataccatcatatccgtttgttccgccgcatgcctgcaatgaaaatacagcattttttatagtttctttatctgatgcgttaacgctgtctaaaactatattggtgccgtttgcgtatgtaacaagtgatattgtgtctcgttcatcaagtctgctcaggagcaaattcaaagatttttttacgagcggaagtttgttttctgaaaacattgaacctgaaacgtcaatcaaaaatactaaattgctgggtttgcgttcttcgattggaatttcgtctcccttaatagaaatcatagtcagtttattatcagaattccatgggcacacagcagtttcagaggatactgagaaaggtgttccatcttccgggagaggatagtcgtaatcaaagtaatttatgagctcctcagttcttatagagccgtacttcggcacgtgtccatttagaataaaccttctcatgttgctgtaagacgcagtatcaacatcaattgagaaagtggaaaacggtgatgtaagaggatttttaaaaatattttcgtcttcttttgtatattcctctgtgtcaaagcccggataccacggaacagaagaagtgctgttagatgagtttatcgctgaacctccgcctccgtctccgcttccgtttccgcttccgccggatgtactgccggttacactttgttgtggagtgtaattataattgttattattagtctcatcctgtttagctttttctgcattgctgatttcagtttttagatttaaaaagttttttatattatatgcaatattgattgcgtcactgcgtgatatagcttgttcgctaagcgcttgaaccccgtccataagtccgttatctattgcggctgcgatataatctaaaggataatttttattggttgaaataattcctgttgagacagccgcaatctttgcggcttctttaaataaaatgttttcatttggcataaaggcttgattttcatagccgttaataatatttgcgttctttagcggcattatatagttataagcccaaaaatctgaattaatatctgaaaattctaaagaggtatcatcaaagtttagtattgatgaattttctgattcaagaacttcatagattaattttgaaaactcggcacgagtaaccgggctgttaagttgtaaatcgccgttttcattgcctataactattcctgcattctgcatagttttaattgcttcatcgctttgcgccgccatagccgcagaagatgaaagcagcatagccgaagcaaccaataatgaaatctgttttttcatgacataaaacctcccatatgatttatgttatattagacgaatcaatcaaatattagttcccaaaatatgtaaataatatatattttattattcaaaaaatttgattattaactcattaaagctattgattatgttttaaatggaatattacgaacaaataacatattgcaagcgatataaatttattatataaatatgtcaagtttacacatttttatttttttcggcaaaaaaactttagacaaaattttatttttttcttatatttaactcttgcattttattattgaatgtattacaattatactgtatttttgttgttaatttatatttatatatattggaggaattgtaatggaaaaacttgaacagctctacgaaggcaaggcgaaaaaagtatttaagactgacgaccctgaagttttaatggttgactacaaagatgacgcgacagcgtttaacggtgaaaaaaagggtacaatccagtctaagggtattattaataaccgtgttaccaaccatcttatgaagatgcttgaagagcgggggattccaactcatctgattaaagagatttccgatagggaaacattagttaagaaagttacaatagtacctcttgaagttataatcagaaacgtagcggctggttcattttcaaagagatatggtgttgaagagggcaaggagttattggctccaacgcttgagttcagtcttaagaacgacgatttgggcgacccgcttatcaactcttatcatgttttagctttaggtctcgcaactcaggaagaaattgacactatagctgggtacgcgtttaaggttaatgaaattttaaagaagtatttgcttgatttgggaatcaaacttatcgactttaagcttgagtttggtaaaacaagtgacggcactattgttcttgccgatgagatttctccggatacctgccgtttttgggataaggacacaaatgaaaaactcgacaaagacagatttagacgtgatatgggcggtgttgaaaacgcttatgaagaaattatgaaacgtttaatgggtgaaactgtttaaattataaaaatatacagcgtcagctgaaatcgtttaggaggtttcttgtgagtaaacataatgagatttttggttccgattcacttcatgaagaatgtggggttttcggtatttatgatatgggtgataatcttgatgttgcccggcttacgtattatgggctctacgcactccagcacaggggtcaggagagctgcggaattgctgtaaacaatattgacgaggacggaaaaatccaaattctgcaatataaggatatgggactggttcaggaagtattcaatagttttgtgttaaatgagcttcagggctgtgcttctgtcggacatgtccgttatacaacggcaggttcaagcagccgtgaaaatgctcagcctcttgtttccaaatatcaaaaaggtacgtttgctttggttcataacggtaaccttgtggatatagataaaatcagaaaagagctggaagataagggcgcgattttccaaaccaataatgacagtgagataattgctcatctcatggctaaagaacgtattaagactaattccactgccgaagctatgatgaagcttatgggtgaaatcagcggagcatactctctgattataatgacgcctaagcgtatggttgtggcgcgcgaccctcaaggattcagaccgctgtgtatcggtaagataaagaattcttatgtatttgcgtcagaaacctgtgcccttgattcaatcggggctgagtatataagagatgttgaaccgggcgaggtcgttgttgtagacgagaacggactcagttcttacagggatagatgcggacagccgacagctacctgtatatttgagtatatctattttgctcgtcctgacagcatgattgacggcggaagcgttcacgccgcaagactgaatgcaggtaagtatttagctcaggaaagtcctgtggatgcggatgttgtaatcggcgtaccggattcgggaattgacgcggctttaggttatgcaagagagtcaaaaataccgtatggcgttggatttatcaagaacagatatatcggaagaacatttattaagcctactcaggaagaacgtgagtctgcactgaggataaaattaaacgcaatgcgcgaagcggttgacggaaaaagagttataatgattgacgactctattgtaagaggtacaacctcaggacgtatagttcagcttctgcgcgatgcgggagctaaagaggtgcatgttagaatttcatcaccgccgtttaaaaatccttgttattttggtacagacatagccgacaggaaatatttgattgcctgtaagatgtctgtcgaggagacttgtaagcatataggcgctgactctttggcatacttgtctatttccgctttatcaaagattgccgagggaacaaaatgcggcatgtgcgacgcttgctttaccggaaaatatccggtgtatgttcctcaggaaaataatagataattgcccttttgcggcttacagaaaggtaaaacatatgcagaatgaaacaatagtaattatcgactttggcggacagtataaccagcttatagcaagacgtgtgcgtgaagcaaatgtgtattgcgaagttgttccgtactcaaaaactgttgatgaaataaaggctttaaatcctaagggaattattttcaccggcggacctaacagtgtttttgatgaggacgcgccgaaggtggattctcaagtttttgaactgggtattcctatcctgggtatatgctacggcgctcagctgatgagcatgtcgctcggcggtgttgttcaccatgccgatacccgtgaatacggagtgacggatataacactcgacacaacaggagttctttttgacgggattgcagataaaaatcaatgtctaatgagccacactgacaaggtgtattcgcttcctgacggtttcagagttgtggcaaagacagatgactgcccaatggcggcgtttgaaaacgcagaaaaaggtttttatggcgttcaattccatcctgaagttaatcacactccgtttggcaaagatatgataaaaaactttttgtataatgtgtgcaagttcagcggcgactggactatgtctgattacgcaaagaattatatagagtttgccaaaaataaaattggggataaaaaagttctgtgcgctttgtccggcggagtggacagcagcgttgcggctgttctgctctataaagcaataggcaaacagcttacttgtatatttgtggatcatggtctgctgagaaaagacgagggcgaccaggttgaggatatattcactaatcagtttgacatgaaccttgttcgcgttaactgtgaagacagatttttggacaagctggcaggagtgtcagacccggagactaaaagaaaaataatcggcgaggaatttatccgagtctttgagcaggaagcaaagaagattggtacagtagattatcttgttcagggaacaatatatcccgatgttatagagagcggagcaggcgacgcgtctgttataaagagccatcataacgtaggcggcttgcctgattatgttgattttaaagaaataatagagccgctcagaagtctttttaaggacgaggtaagacagctgggaatggaactgggaattccggagtatttggtatggagacagcctttcccgggacccggacttgcaataagatgtatcggagagataaccaaggacaggcttgagatattaaaagacgccgatgctatattcagagaagagattagcagagcaggactggacagagaaataaaccaatattttgcagtgttgacaaacatgagaagtgtaggagtgatgggcgatgagcgtacatatgactacacaatagcattgagaggggtaacaaccacagacttcatgacaggggagtgggcaagaatcccatatgatatattggatatagtaagcagaagaattgtaaacgaagtcagtcacgtaaacagaatagtttacgacataacttcaaaacccccatcaaccatcgagtgggaatgatatcacactcgcctgaaagccagtaactgtgcgggttacaccgttctggatatatcttgtggcaacgttttggcaacacctgcaacataaattgtattgttccataaatatagagctaactgatttgatttatcagttagctctttttgttggggtctttagacgtggaaaaaaaccttcggttctaccggaggaagataaaaagctttagcataagaaaaatctccatgatataatagtaaatggtttggcgaccgcattacaaaaaatatatcatggaggtttttaataatgttaaagaagagcacaaatgaaataaagagcacagcacactcaaaatacaggtgtcaatatcacatagtatttgcaccgaaatatcggagaaaagaaatatatggtcagttgaaaagagatataggagaaatactccgaaagctttgtaaacaaaaaggagtagaaataatggaagcagaagcctgcctagaccatatacatatgcttgttagtatcccaccatatataagtatagcacagtttatgggatatctcaaggggaaaagttcattaatgatattcgatagacacgccaatttgaaatataagtatggttcaagaaatttttggtgtagaggatattatgttgatacagtggggagaaataaaaaaataatatccgaatatatcaggaatcaacttgaggaggattatgcatcggatcaaataagcatgaaagagtatttaaacccgtttacgggtagcaagaataagtaggcaaaaaatacagccgcacgtgagcggctgcctgtgatagtaatgcggtgtcaaacttctgtgctccttacaggggttaagcctgtattagccccttataggggctgtgcaagccaccagtttactggtggtcttgacttaccaaaataaggaggtggaacagcatggagaaaataatatttgattattactatggtaatcaggcggagcagtacagcttttaccgtataccaaaaattctttttaaggataagacgtttaaatcactatcaaccgatgcaaaggtattatacggatttatgcttgaccgaatgggattatcagttaaaaacagatggtttgacgatgaaaacaaggtatatataatctataccttaaaaaatattatggaggatttcgggtgtgccgataataaggcaacaaaattattgaatgagcttgataaggaaacaggaataggcttgatagaacggagacgtcagggattggggaagactgatattatatatgttaaaagctttgttataacgccggagaaccagcacgaatccggaatcgtgaaaatcacgagcaattaatactaatattaataatactgagtataacaatactgataataataaaactgagtatataaatcatcaatcttatctatcgtgtaatacagcaagtgaaactttttcaatggataggattgaggattatgaaaaatacagagagcttgtaaaaagaaatatagagtatgagggattaattctgcatgaggaaaaagaggtaattgacaacattgtggatattatggcggatgttctgacttttccggctgaaagctattatattaaccatgtacagtatacggctcctgtggtaaaaagtattttcatgaaaataaattacacacatatcagcaatatgcttttggcaatgaatgaaaactgtacgaagatacgaaatgtacgcagctatctgatagctgctatttttaattcatacagcacctcagatgtatatattgactggcgtgtgcgctatgatatgaaaaaatgagagagtaggtgatagctattatggagaataaaatattaaaaaccggaaatggagacaatacagaaataatacagactgtaaacatatcagaactaaagccgtatgagcagcagccgtttaaggtattgattgatgaaagtatggaggagattatggagagtataaaacaaaatggggtattatcgcctattattgcaagacctcatagagaaggcggatatgaaattctttcagggcacagacgtataaaagcatgtgagcttacgggaattacatagattccggttgtagtaaaaaatcttgacgatgatacagcggcaattttactggtagacagcaatttacaaagagaaaatatcctgccgagccaaaaggcttttgcgtatcggctgaagctggaagctatgaaacgtcaaggtgaaagaacagatttaacatctgcacaatttgtgccaaagttaacagcacgggaacaatttgctcaagaagctggagtaaatcttatggaaattacaagttacatacgccttacgaatctaattgacccgttacttgaaatggttgacgaaaagaaaatagccttaaatgcagctgttgggttatcctatttaggcaccaaaggaacaggcagaggttctaaattcaatcgaaaaggaggaggcttcaccatctattgcacaggctgcaaaaatgcggcgtttttcacagaatggtaagctaaatcccaatgttatagattctattatgcaggaacagaagccggaaaagattaaaataacattggcaggtgataaggttaaaaagtatttcccggaagattatactgaaaagcagatagaggatgttatgataaaactattagacgactggtataaaaagcggcagcgtaaaaaggaatatgaacgttaaagcggtatctcatgatattaagggataccgcttttatagtggaggattttatggatatccaaagaataaactcaggatatttaattataaatcaaattaaggttggcgaaatagaaattgtgctggatgttcaccccaaattgcctaatagctttgttacatggaaatgtaaaaacggtgactattactattgggggaactatcatacaagcctgttgtcggcccaaaaagatttctgtaagcgtgctctatcagaaataagaaacattgaacagatatataaaaaacaaaagcaaatagaaaacgagaggttaaggcatgattaatagacctgttagcattccgctgttcaattgtatatatcaataataacttaaatataagaaaatcacatttgtgtgcgattcttttgtgcgatagaacgatatacgttgacatttatggtgattattgatataatattttgtaagattaaacaatgtttcggaggtgtcttaaatgaggaaatagcgataggtaatcctttgatgttatctccggattttcccccgccctaaaccgggcatgaacctttcagctcacccggcttgccatcaggaacagaatttatttcatctcaataactctcaacgtggacaaggcttcttaacttattgagtttttctttctgcttttggtcaaggcctaggatttccatatactttctgataatatcagggtttgtagcatgaatcaggtgatgtacatcttcacataccaacaccagattttgataattgtccttgccgcctaaataccgtggcactttgtgatggcaatgaatatcgccaatagaaagcactttgccagatacggcgcattttcccatttgggccgaatacagtgaaagcctgttatcgttgtattcgatagtacggtacagaaccgggttcctcattaagtaatgaagaaccgtcatgtcgattctgtccagattcttatggatttcggctctgccctcgggcatataggaattgattttgcggttcatggactttgggggcttgtgccgtatgtagccaatcgggacaactgcgtgtccggctacatatcggagctgtttgcttttcccataccgttccctgataactttcggaacttcacacggaatcttcctttttctgacctgttttgcagttttaacccgttctttcagtcttgcccgcaggctcttgtggacagataaggcgaatggcgtaaggtcatcgcagacctttgtggctaattgatagtagtcatggattcccattacataaacgttgtagcggcaaatcgcctgatattcagtacgtttgccttgtgacgggaactcaatgtcgtaaatcagccgttttaagtttggttttattttcgcaatagatttctctctgatatggctctctactacatatttggcgcgtccgttgctccgtttcccacgggggataacctttaacttgaaaccaagaaactctgaatactgctctttcaggttaatcaccttcgatttttcaggactgatttcaagagaaagcctttcatggagccagcttttggttgcgtggaataacttcaccgcattttgatagctgttcgtgaatatcttaaaatcatcagcgtatcggacgcaggtgacttctttcagccttgtcctccgcagtgcggcaaatttatggctcttgctcacgcttccgttgtaattgaccgattccttgtaagggaactccgttggtatttcttcccattggctggcaagccaccaatccaattcgtttagaactacattggatagcaggggagagataatacctccctgcggcgtacccacctccgggaatcctatcccggccacctccgcttttagcatagctgatataatactaagcagcttcttgtcttggattcccattgtccagagctgtttcagcagttttccgtggttcacgttgtcaaagaaccccttaacatctatgtctacgacatagtggagattgcttctctgcatatttttgtgaacctgggcgattgcgtgctgttggtttcggttagggcggaatccataactgtggtcgtggaatttcgcctcacatatcggctccatgacctgcaatacgcactgttgtatcagcctgtccataatcgtcggtattccgagcgggcgcttcttcattgggtcatttcctttcggaatttctacccgccggacgctttgtgggacataccagtttaatttgcgctgtatggcgcatataagctgttcatcagagagtgctgataattctgtgattgtttttccatctgtgccgggcgtcgtactcccgtggttcttcttgatgttgcggtatgccagccgtatgttttcgggtaatgcaatgatttcaaccagatgtttgaaaactttgcctttattgctgtcggcatacagcttatcttgaattgcctggaagtcataatactcggcgtgccttaacttatctttcttctttgcctttcctgttgccatagtcggttacttatccccactttcgtttggattttcgcctttcttagtcctactcgaacctatgcgtgtttattgaatatgattttgtttctgttcctgactacagcccgtccctccaccgcttactttgttcacggcttcacaggtagcatggctgctctttcctcccggattaagaacggttataccgcacctcccataaaaggcggcacgattttcccgcccattgcttcatcatgcgtatccactccacatccggggctttccacgttccgatattcctatctttgcataatacccttaaccctgccctttaggcctgtatgcctgatggtgcctgtaacaccatagggaatttcatatcgacaaatcttactttaccccacatacgccgttttcacggctatggcatttctgccatatcccgttatagacctgtacattcgggcttttgtcagcggtagtcagccgcattctggacataggtactttatagacctccggcctaacacccccggccacctctggctcggctttgctttatcccccaaaggggacagtcgcgggtgcagacagccgacttcagcgtgctgtgtcagtcgcgggaaatacgtcccgtttcttccaacgcagtatcaagggaagcgtttcagggcgttaccccgccattccacttctcggaatatcagttagaaaggctatagcctttccgtcacttttacctctttgcaggaaaatcccacgcagagtttatatgcgacaacgtgtcgctgcactgtcgaatggggctaacctcgcgccgcatgagataagtatgctttttgcggtcttgcccgccgcaagtttgtattttttgtactgcttgactgcaaaatgttccgggtctttttcttccagacgttcaaacatgaggtcaaccgggttctggaaatcctcgtcgtcctcgcgggcttccgacgcatttatcatctcaagcagcgtcgtgaagttcttctcgtcctccggggcttcataccagatgtagccgattagcgcggtgtagtagagcttttccgctttcacccagaaatcctcgccggatttttccccgtcgcctttggtgttggcgataatggtattgactaacttcaaaatgtccttttcgctccgcagataggcaaagggattgtatttcatggattttttgaagttaatcgtatttagcactttgatacggtatttgtaccgctgtaacattttcccggtttccaaaatcagtgttcctttcgggtcagtgacgatatacgacgttggaaaatcctttgacgtacattgcatgagcgacggtttcacaaagaaccgggtcttgccgctgccggaaccgccgattacaaggatatttttgtttcttgcgtatttcggctgcttcgggcggctgttcatggtgagccgttccgtctgcgttaaggggatattgttctcaaataccgggtcggtgtacggctttatgtcgtcagccccgccccaacgcgccgaaccgtattctgtcccgcggcggtatttcttcgcgttcttgcctttggtgtagataatcagccggacaatgaccgcccccgcaatgcctaaagctaagtctgccgggtggaagctcggcgcgatactggaaaaggcggcggtaaaaccgtccccaagatgtagcagctttgcgcttgcgtccgcgccgggggagagccggacagccgcgcccactttatcaaagagccagacaaagagcagatacgggagatttaggataagcagcttcttgatttccggcttcatagcgatacctccctgtccttgttcttgacctttgcccgttccgcgtttctgccctgtgcagcttctttgagggtagagagcagctttcggattgagggctttttctcctgtgtcagcttttttgcggaaaattccttaaaggctgcggtcagtacgtccgcgtcccgccccttgaagaaaaccagatagcggggcgggctttccgtcgcgtcctttttcagcgcaaagtcgataccgtactttttcgccgtactctcaaaggctttgatattgccctcggtaatctcaatgttggaaacgcccgcgttctgcttcataagctgctttaagctctgcttgccctgtggcggttttgcaagctgctttttgccctttgacagtatggctttcattgccttttggagcgtctgcgcggtcagcttcccggtcttgatgtaaagggctatggtcttttcgtttacttcgtcctgcaatttgtcgcgtcctcctttcgcgtttctttatggggcggcggtcagatacgcacccgcagcccgttcaagtcctcggctctgatacccacaagataccagttgtcgccgtactcaatccgggtcggcttccacttgccccgcacgaatacgtcaaagcactcgccgcaatgcaagcccccgtagtagctgtttaagtcaaagcggatgtcgtaacggtcggtgcgctcgtcaaataccaatgctcctgtcattttctgtgccataataaaatcctccttttgtggttgtgggtggttacaggctttcgccctcattgcatgaataatagtccgggtcgccgtactgcggctttttcggtgacagtgcgccgcttgccatgtcatgggcgacaagggaagtgtagtagttgccgattgtggacggggcgttgaaaagggcggctttcagatattgcttgatgttgcggattttggttgtgttctcccgcatacagtcaagcacaaagcggatatgctcgccgtctagtttcataaactttgacttcacaagctctgccgggtagtcgtcccccgcaatccgtacccgctttctggcggtgcatacggtttcaagcatgaggtctacaatctcgtccagcctgtcactgtcaaacttcatgtcctgtttgagaatgtggtagtcgatattgtccttgatgatttcccggtatatatcaactgcgctctgtgctgccgcttccgttcctttccgttccggcggcgcagccgcttctctgcaaggagaggggttaggggaaaggataggaatggaatgggtacttgataaatctgtatttgatttttctttttttggtaagtcagttctttgtatatctttatttaattgcgttggattttccaacgtaggtttttccaatgttggtttttcctgcattggattatccaatgttggattttccaatgtaggtaaatccggcgtaggcggctgcggctgctcgaatatcacatagtccgcgccccgcaagcgtcctttctcgtcgcgctcccttgaacggacgatatacccggcgcgttcaagttccttaatggcttcgcggatagcgtctatcttctcccggttgataagggataagcctttcaaggtgtagtcccaatcttcggggagtgacagcatttgcgacaacagcccctttgcctttagggaaagctccttgttgcgtaggtggtggttgctcattacggtatagcccttgtttcgttccactctgaaaactgccatagttcatagctcctttgctttggatttgttacgcagtagaagcgcggtttcgggggataaggtataaatccctttccgcgccagatacgcgcccggaaaaccgcttgtagcaaggctttttctgcccctactgcgtaacaaagggcatgaaaaaagcggcgttcctgttctcccatgtagagagtaagaaacgccgcttctgcgtcgtattcagtttttagtacaataccctgcttgtccgtcgctcgaaaaaccttgattttccagtgttttcaaaagtatcgttatctaacgtcagcttttgaaagaccggactttaaacgtatggttgcagatatagaaaaaggattaattaacattgttattgtaaaagattattgtgcgataataggactaaatcagaaagaccttgaaaaccaaggcattctggcttagtcccttctttttttgaccgaaaacaaaggactttcacaataatcaagcaagccggagggtgccgctgcacacttccggcagaaggaggatatagtgggtgctatcaaagtcttcttgaaggaagttgtgcttccaatcgcgcttgcgttctgcctcgcgtcatttctcaagccgatctatatgcctgacggcgtatgcgactacttcctaatgtggatctgcgtcggcttgccattcggcatccggaggatgtgcctctggctcgttccaagcggttacggcatctccggctcagtcggcattttcgcattgaacttaatcataggcggtctcatcggaggactcgccttcttcatcgggctgctgctcggtatcattcataccatccgagaaatcatctgaactacatcgtaaacgaagagggtttgtttcttctccaatttggagtaagaagcaaaccctctttttttgttgcccaaaagccggagtatttgctggcgatgcggcgaaagaaaggagtttttaagcatgaaacgcatgacagccggtgatcttcaagcactggaattgctgatgcagaccacacccggctttgagcattttgacagcggcgcggatggcattctccctgagtgccgaagctgccgctttcatcgccccttctggaaatatcagtcctgcgtgtttgcagagtgtccctactgctgcaatcccgtttctaccctcaaaaaccaaagtggcacatctgctgccggaaaggaagtcaatcatggataacaaaatcgaagtcttcaagaatgaacagtttggagaaatccgaacagccctgatcgaaaacgagccgtggtttgtggcggtagacgtatgcagggctttggagatcggcaattcgtcacaagccatttcacggctggatgcggacgagaagatgattaccctcatttcaaatgagggtaataaacgaggcaatcccaacatgacggtggtgaacgaacctggactttacacgcttattctgagcagccgtaagcccgaagccaaagccttcaaacgctggatcacacatgatgtcatccccatgatccgcaagaccggcggctacatgacggactcccttctggaacgtattcagaaggaaccagcggtcattgtggagtttgctcaggcgttgattctggaaaagaatcgcgtaaaggctcttgagtgtgagctgaacacggcaaagcccaaagccgattactacgacgccttcatcaatccggatgactgcaccaatatccgaacgacggcgaaggaactgaaaatcccggagcgcaagttcgtccagtttcttctcagggagaagtacctgttccgatctccctccggtcagcttcttccctacaacaaggacagcaatgccggactgtttatcgtccgcgattttgtgacgtactgctacaccggttctcagacctacttcacgccgaagggcaaggatgtcatccgaatgaagttccagaaaaagtgcggcgaagagctgctttccaagatggcaaggtgatttctgtggcagtctatcgcgtaaacaagaatcgtggctatacggtcatggcgaacttccaccttcgagacaagagcctgtcactcaaggcagtcggtcttctctcaaagatgctctcgtttaatgatggctggaagttctcaaccaagggactttctgcaatctgcaaggaaggtccggatgccattctctccgcgctccgtgagcttgaaaagcacggctaccttgtccggcaccggcagagagacggtaaaggcaggatgagcaacacaatctttgagatatacgaagagccgcaggagtctacaccagaacgggaaaagccacacacggaaaatccatgtgtggagaagccagatgtggataatccacgcggggataagtacgcacaaataaatactgatcaagtaattacccaagaaagaaatactctctcaaagaactatcaatccatcaatcttgatgggatggacaggatggatgagcgaagcgagtatgaagagattatcaaagagaatcttgattacgacattctctgtcaggatccgaagttcgataaagaccgcttccgggagatcatggacatcatgctggatgccgtctgctctaccgctccgaccatccgtatcaatggcgaggatatgccgcagcaagtggttaagtcccgctttctcaagctgaatagcagccacattgagtacgttctggaagcaatgaacaagaacccgtcagacatccgtaatatccgggcgtacctgttgaccgctctgtataacgcctctctgacgatagacaattactactccgccctcgtcaaccatgatttctacgggcaggacagatcagcagggtcaaagaagccgaagacctacgattatagcctttgtgaagacactctttaatgaataccatcgtgagcattgctcggaaaggaggacagtgtaaatgaaaatcatctatcgccggattgtgccgccttagcgtcggcagcagtccccataatcattccaaggaaaggaggtaaacgcagcaatgcaggatgaagtcaacaccaaagttgttgcaatcatgatcaagggcggtaaaatctccgctgaggtgctgaaaaaggctctggacaagttcgttcaggagatcgagaaggcgcagaagcagatgaagcagcctaaaacctatcgcggcaagcagtccatcaagcatctgatgagccagaatgccgccatctccaacatcgaagtgacggatggcaacatcaaatcctttgagcggaccgccagcaaatacggtctggactttgcgctcaagaaagacgtttccgttgagccgcccagctatcttgtcttcttcaagggacgggacgttgatgtgatgaccgccgccttcaaggagttctccgccaaaacggtcaagcagaaggaacagccgtccatccggcacaagctggatcaggagaaagcccagagcaaggcgcagcacaaggagaaggtcaaggtcaaaaccaaggatcggggtgtggagctgtgaacaaacccgatgtgaagaagctcattcttctgaaccttccgtatgtcttcgccttctacttcgcggataagatcgccgccgtgtttcgtctcgcccccggcgcagcgttcatcgacaagctgacaaacggctttgccgtgttcggctctgcctttgcaaatccgctgcccagctttcatcccgtcgatcttctcatcggtctgtcggctggcgtgctgctcaagctggcagtctacgtcaagggcaaaaaccgcaagaagttccggcagggcgaagaatacggatctgcccgctggggcaagccagaggacatcaagccgtacatggacccggagttctccaacaacgtcattctgacgcagacggagttcctgaccatgaacagccgtccaaagcagccaaaatacgcccgcaacaagaacatcctcgtcatcggcggttccggctcaggcaagacgcgctttttcgtcaaacctaacctgatgcagatgcacagcagctacgttgtgactgacccgaagggtacggtgctggtggagtgcggcaagatgcttgaaaagggcggctacgtcatcaagtcgctgaacaccatcaatttccggaaatccatgcactacaacccgttcagctacattcgcagcgagaaggacatcctcaagctggccaatacgatcatcgtcaacacgaagggagacggcgataagtccggcgaagatttctgggtcaaggcggaaaagctctactacacagctctcatcggctacatctggtatgaggcacccgatcacgagaaaaactttactaccctgctcgaaatgatcaatgcctcggaagccagagaggacgatgagaccttcaaaaatcccgtggatgtcatgttcgatgaactggaagcccgtgacccggatcacttcgcggtcaagcaataccgcaaatacaagctggcggcgggcaaaaccgccaagtcgattttgatttcctgcggtgcaaggcttgcgcccttcgacagtgcagcgacacgttgtcgcatataaactctgcgtgggattttcctgcaaagaggtaaaagtgacggaaaggctatagcctttctaacgacagtgcagcgacacgttgtcgcatataaactctgcgtgggattttcctgcaaagaggtaaaagtgacggaaaggctatagcctttctaactgatattccgagaagtggaatggcggggtaacgccctgaaacgcttcccttgatactgcgttggaagaaacgggacgtatttcccgcgactgacacagcacgctgaagtcggctgtctgcacccgcgactgtcccctttgggggataaagcaaagccgagccagaggtggccgggggtgttaggccggaggtctataaagtacctatgtccagaatgcggctgactaccgctgacaaaagcccgaatgtacaggtctataacgggatatggcagaaatgccatagccgtgaaaacggcgtatgtggggtaaagtaagatttgtcgatatgaaattccctatggtgttacaggcaccatcaggcatacaggcctaaagggcagggttaagggtattatgcaaagataggaatatcggaacgtggaaagccccggatgtggagtggatacgcatgatgaagcaatgggcgggaaaatcgtgccgccttttatgggaggtgcggtataaccgttcttaatccgggaggaaagagcagccatgctacctgtgaagccgtgaacaaagtaagcggtggagggacgggctgtagtcaggaacagaaacaaaatcatattcaataaacacgcataggttcgagtaggactaagaaaggcgaaaatccaaacgaaagtggggataagtaaccgactatggcaacaggaaaggcaaagaagaaagataagttaaggcacgccgagtattatgacttccaggcaattcaagataagctgtatgccgacagcaataaaggcaaagttttcaaacatctggttgaaatcattgcattacccgaaaacatacggctggcataccgcaacatcaagaagaaccacgggagtacgacgcccggcacagatggaaaaacaatcacagaattatcagcactctctgatgaacagcttatatgcgccatacagcgcaaattaaactggtatgtcccacaaagcgtccggcgggtagaaattccgaaaggaaatgacccaatgaagaagcgcccgctcggaataccgacgattatggacaggctgatacaacagtgcgtattgcaggtcatggagccgatatgtgaggcgaaattccacgaccacagttatggattccgccctaaccgaaaccaacagcacgcaatcgcccaggttcacaaaaatatgcagagaagcaatctccactatgtcgtagacatagatgttaaggggttctttgacaacgtgaaccacggaaaactgctgaaacagctctggacaatgggaatccaagacaagaagctgcttagtattatatcagctatgctaaaagcggaggtggccgggataggattcccggaggtgggtacgccgcagggaggtattatctctcccctgctatccaatgtagttctaaacgaattggattggtggcttgccagccaatgggaagaaataccaacggagttcccttacaaggaatcggtcaattacaacggaagcgtgagcaagagccataaatttgccgcactgcggaggacaaggctgaaagaagtcacctgcgtccgatacgctgatgattttaagatattcacgaacagctatcaaaatgcggtgaagttattccacgcaaccaaaagctggctccatgaaaggctttctcttgaaatcagtcctgaaaaatcgaaggtgattaacctgaaagagcagtattcagagtttcttggtttcaagttaaaggttatcccccgtgggaaacggagcaacggacgcgccaaatatgtagtagagagccatatcagagagaaatctattgcgaaaataaaaccaaacttaaaacggctgatttacgacattgagttcccgtcacaaggcaaacgtactgaatatcaggcgatttgccgctacaacgtttatgtaatgggaatccatgactactatcaattagccacaaaggtctgcgatgaccttacgccattcgccttatctgtccacaagagcctgcgggcaagactgaaagaacgggttaaaactgcaaaacaggtcagaaaaaggaagattccgtgtgaagttccgaaagttatcagggaacggtatgggaaaagcaaacagctccgatatgtagccggacacgcagttgtcccgattggctacatacggcacaagcccccaaagtccatgaaccgcaaaatcaattcctatatgcccgagggcagagccgaaatccataagaatctggacagaatcgacatgacggttcttcattacttaatgaggaacccggttctgtaccgtactatcgaatacaacgataacaggctttcactgtattcggcccaaatgggaaaatgcgccgtatctggcaaagtgctttctattggcgatattcattgccatcacaaagtgccacggtatttaggcggcaaggacaattatcaaaatctggtgttggtatgtgaagatgtacatcacctgattcatgctacaaaccctgatattatcagaaagtatatggaaatcctaggccttgaccaaaagcagaaagaaaaactcaataagttaagaagccttgtccacgttgagagttattgagatgaaataaattctgttcctgatggcaagccgggtgagctgaaaggttcatgcccggtttagggcgggggaaaatccggagataacatcaaaggattacctatcgctatttaaggaagtccgggaaatcaccatgtatgacgagctggagcttgacctggtgggcgacaggaaaacggcgctgttctttatcatcagtgatacggacgcgacctttaatttccttgtcagtatggcttatacccagctattcaacctgctctgtgagcgggcggatgataagttcgggggcaggctcccggtccatgtgcggtgcctgatcgacgaggcggccaatatcggtcaaatcccaaacctggaaaagctgatggcaacgatccgttccagggaaatatccgcctgcctggtattgcaggcacagagccagctcaaagcgctttataaggacaacatggacacgatcataggcaactgtgattcttctcttttcctgggcggtaaggaggaaaccaccttgaaaagctggaactccctgctggggaaagaaaccattgatatgtataacaccagcgtcacgaagggcacccaggaatcccacgggcagaactttcaaaagctgggaaaagatttgatgtccgttgacgagcttgcggtgatggacggcggaaaatgcctcctgcagatcaggggcgtgcgtcccttcctgtcccggaagtatgacattaccaaacacccgaattacaaatatctttcggattttgacgaaaagaacgcctttgacatagagaaatacctgtctacaagactgcctgtacgtcccggagagctgtaccccaactatgagatcacgccggaagaactggcagcgcagacaagcgcgtaaaatcccgccgtatcatttccttattgtatggcgggtttttctataccatttggaaaggaggcgcctattgcggattcgtgattctccctgacaactgaatatcccccgcaggtcttgtcctgccccttatgctgccgtcatgtttttgtaggttttctatttgaacatggcggcggcttttttcgtttccggcccaatgcggccacaacaataaattctatgaacattaaggaggattaactttatggctttttttacaagcgcgattgacacgctgaaaattctcgtgatcgccctgggcacgggtctcggcgcatggggtgtcatcaaccttttggaaggttacggcaacgacaaccccggtgcaaaatcccaggggatcaagcagcttatggcgggcggcggtatcgccctggtgggtgccacgctgattccgctcctgtccggcctgttcagttaatagccgatgggcagtctgtttgattggataacagactggatcaaagagggcctgatcgaagcgatcaccgggcagtacaccagtatttttgaatcggtaaacagccaggtcgcagatgtggccgggcaggtcggacagaccccgcagggctggaatggcggcgtgttcagtatgatccagaatctttctgaaaccgtcgtcattcccattgcgggcatgatcctgacctttgtgctggtatatgagctgattcagatgattttggaaaagaacaatatgcacgattttgatacgttcaacatcttcaagtggatcttcaagacctttgtagccacctacctgctcaccaactgctttacgattgtcatggcggtgtttgatgtcgcccaaaatgtggtatcgcggagcgccggcgtgataaacggaaatctggatgtcacggcggcgctggctgacctggaaacgcagcttgaagcaatggggatgtgggagctgatcggcttatggctggaaaccaacatcatcaacctgtgcatgtgggtactgtctattgtgatctttgtcattgtctatggccgcatgattgaaatatatctcacggtcagcctggcacccataccgttttccacaatggcaaaccgtgaatggggacagatggggacgaattaccttcgttccctgttcgctctgggattccaggggttcttaattctggtatgcgtcgcgatctacgcggtgctggtccagtcgatcccctcgtccggcgatattcacggtgcgatctggggcacggcaggatataccgtactgctggccttcgccctctttaagacaggctcgttatctaaaagtatattcaactcgcattagtgggtaacaactacattttaacaaggaggaactttcattatgagtaaaaccaataccgaacccatgcagccggacactcaggcgtccgaaggcttgaagctggatgtaaccgtgcgcccgattgccccgatggggaacctcttggcctttgccaacgtgacgattggcgactgtttcaagatcgacggcttccgtatctgctccggcgagaacggcctgtatgtcaacatgccttccacccaggataagcagggaaaatggagggatgtgtgctggccggtgacggcggactttcgcaggcagctcaacgacgccctgatcgaagggtacggccaggcgattgaaaatttgcagaccacccttgaagcgaccaggggcgcggcggaaaagccttccctgaccggcgccctgaaagaaaatgccgggaaggtcaagacgcagccggcaaagcccgcacctaccaagagtgagcaggcccgctgatggcggaggctaagaaatatggcattgtgtacgcagacccgccctggcgctatgacatgaagcgcggcaaaggcgtggcggaaaaccattaccccaccatgagcatggacgaaatatgcgcactgccggttgcagaccttgcggccaaagacagtgcgctttttctatgggctaccttcccacagcttaatgaggcgttccgggtgatcgaggcgtggggcttccagtataagaccctggcgtttctgtggctgaagcagaaccggaaagccgataactggttttatgggatgggcttctggacccgctctaacgcggaggtgtgcctgctggcaacacgcgggcacccgaaacgccagtgtgcgggaatccaccagtttgtgatctcccatatcgagcagcacagcaagaaacccgatgaagtgcgggacaagatcataaagctcatgggcgatcagcccagggtggagctttttgccaggcagcagacccctggctgggatgtatggggcaatgaagtggattgcagtattacaatgccgcaaaacggataaaaaagattctcgcagatcggaggtgacaacgaaatgccttatgtacccgtacccaaagacttaaccaaagtcaagaccaaagtagccgctggcctgacaaagcgccagcttatttgtttcagtctggccgcgctggtggggctgccggtatatttccttacccgcggcgccatcggcaattcggcggcggtgctccttatgatcggcctgatgatgccctttttcttctttgccatgtatgagaaggacgggcagccggcggaaaagctgttaaggaaccggctccgctataagctctggccgaaggaccgcccttaccggacagaaaacttctacaaatccatatccaaaaaggaggtatcacagattgccaaaaaccagacagcaggaggcgcaggaaaaacgtctacaaagaaacgtaaagcaggcaaaaaagacccgcaccgaagcaagaaaggcaggaagtaaaactgcctctcctgccgggccgaagaaaaagcccggctttttttccgggctgaaagcggacgccccgcagacggtccagcagagtattccctataaggaaatgtaccgggacggtatctgccgtgtgagcggcaattattacaccaagacggtgcagttctttgatattaactaccagctcgcacaggcggacgacaaggcgcagatttttgagggctactgcgattttctcaattactttgacgcctcgatccatgtgcagctcaccttcatcaaccagcgggccaatatgcaggactttgttcacagcatagagattcctgcccgtggcgacgagtacgacggaatccgcagggagtacgcggatatgttaaagaaccagctccaaaagggcaacaacggccttaccaagcggaaatacatcaccttcgggattgaagcggaggaccttcgcacggcgaaaatgcgtctggaacggatcgaaacggacgtgctggggaacttcaaagccctgggcgcgcaggcaaggtccttaaacgggctggaacgtctggagcttctgcacagccagctccacccggacggccaggagaaacttcattttaactggtcggatttgccgaaaaccgggctctccacaaaggactatatcgccccttccggtctctccttctcccaggacggcaagaccttccgggtgggcgaccattccggcgcggtgtccttcttgcagattttggccccggagctgacggatcggctgctggcggaactgcttgacctggatgacgccgtgacaatcaacctacatatccagtctatcgaccaggcccaggcgatcaagaacatcaaacgcaagatgtctgatttgcagaagatgacgattgaggaacagaagaaagcggtccgctccggctatgacatggacatcatacctaccgaccttgccacttatggggaagaagcgaaaaatctcttgcaggatttacagagccggaatgaaaggatgttccttgtgacggtgctggtggagaatatcgccccgaagcgcaaaaagctgtttacggatattttttccgcttccggtgtggcgcagaaatacaactgtgccctgaaacgtctggacttccagcaggagcagggccttatgtcctccttatgcctggggcagaaccagatcgagatcgagcgggggcttaccaccagcagcacggccatttttgtgccgtttaccacctgcgagctgttccaggagggtgaggctttgtattacggtctcaacgcccttagcaacaacctgattatggcgaaccgcaagaacctgaaaaaccccaatggcctgtttctggggacgcccggcagcggcaaatctttctctgccaagcgtgagatcgtcaatgtgttccttctgacggaggacgacattatcatagcagacccggaaaatgagtacgggcctttggtaaagcagtttggagcccaggggcagatcattgacatttcccctaactccactaactacatcaatccgatggatataaacctggactattcggacgatgaaaacccgatcaccctgaaaagtgattttatcctgtctctgtgtgaccttatcatcggcggcaaggaggggctttcccctattgaaaagacgatcattgaccgctgcacaaggcttgtgtaccgggactatttgcaggacccgcgcccggaaaacatgccgatcctgggggacctgtacgatcttcttcgcaaacagggcgagccggaggcgcagaatatcgccacggcgctggaaatctatgtcaacggttccctaaatgtatttaaccaccgttccaatatccagatggataaccaccgggtactgtgcttccagttgaagtcgctgggaaaggccctgaaagagatcggccttcttatcatgcaggacgcggtatggaaccgtgttacggccaaccgctccaagcataagacgacctggttctatatcgacgaattccacctcctgctgaaaggccagaccggaagtttcagcgtggagatatggaaaagattccgaaaatggggcgggattcccagcggtttaacgcagaatgtgaaggacctactggcttccagggaaatcgagaacatttttgagaactcggattttatctacatgctcaaccaggcccagggagaccggcagattttggcgaagcagttaggcatttcgccccaccagctttcctatgtgacccattccggccccggcgagggccttttgtttttcggcaacgtgattattccatttgtcgatcacttcccgaaggacacccttctgtattcggtccttaccacaaggccggatgaagtggcaggcgcatgagcgccggcagactaacaaagataattcagactggaggtgatggatatatcccgtgataaagaattcagacgggcaaaagacgcggcccggcagccggcaagaaaaacggaaagcgacgtccgggccggcgaggtgcgcggcccggattttgatctgcgccgggcccgtgacgcgcctgtgcaggaagataaccgctataaagggcggaacctgtatcaaggggcttcggaggacggcgcggttccggcagcggattccagtgtggattctgctgcttcccggcagtcgtccgggggttctgacagcttcattcaggacagccgcggcgatccgcagcaaagcgggccggatttttccgggcgtgacagcttccgcgaaagcaggcagcaggattccgggcacagtgattccggcaggtttcagcgccgggatgcagatttttccaggcgcggcggccaggagttgtctggctttggcaattcggaggctggcagtacaaatgccggggaaacaccgggcagacgccggacgcaccagcacggcaacaaataccagcagcgtttccaggaggcggcaaaagccgaggaaccccaggagaaacagccgggggcagccgaaggagaaccgaaacggccttccaagctggaatttaccgctgacgagctgccaccggaggcggcggataaaaagctgacccaggcaaggcgcagggccgagcgtgtggaaaagaagctggaggacgccgaggcgcgtctgccttcccggaaaaaactgcggatggagacggcttccgacccggagaccggcaaagcaaaaaagcggctgaaatttgagcaggaagtaaaatcccagcgggcgcatgtaaagggctcccttcccatgcgcccggtaaaggccgctgcaaatacggctgtcggttatgcgcataagaaaatctaccaggcggaggaagaaaatgtcggcgtgaaagccgcccaccgcaccgagcttgtgggtgaggcctgggcgcgcaccctgtaccaccgccataaaacagcgccataccgccgggtaacaaagttacagcagaaatcagcgagggctaacgcgcagcttgcctaccggcagaccctttcggaacacccggagctaaagaaaaatttccttgcccggatgtggcagaagcaaaagctgaaacggcagtatgccaaagccgcaagggaggcacagaaaaccggaaagcgggcaaaggacgcagccgtcaccacggaaaagatcgctgtctctgttgtaaatgctgtcaagcgccacccggtgatctgcggcattctgctcctgttgcttttggtggtatttctcattacttcgctgttttcctcgttttccaatatcgggaccgggggcctgggaagtatcgccgcctctacctatctggcggaggaccaggacatcaacaacgcggagcttatctataccgagtgggaaacagacctgcaaatggaaatagaccgtgtggagacagaccggcccggttatgacgagtaccgctataacatcggcgcaatcgagcatgacccctatatcctgatgggctatctcacttctgcctatcagaatttcacctatgagcagatcgagggcgtcctgcggcagctttttaatgagcagtattcccttacctttacggaggaaacggaaatccgctaccggacagagacccatgttgacccggagaccggcgaggaaaccgaggaagaagtaccgtatgagtggcacatcctgaatgtaaagctcacggccacgcctcttgcaaacctggtggtgcagcgcatgagcgccgagcagaaagaaatctttgagattctattgcagaccaagggcaaccggcagtatgtgaaaaatgtctttgggataaactggctgccctatgtcaccagctactacggctaccgggtacaccccatcagcggggaaaagaactaccataccggcgttgacatcggcgtggcccagggcacggaaatcttagccggccatgacggtacggttacgctggcaggaaacgcgggcggctacggcctgtgtgtcgccattgaaggcgaggcttacgaggggcatacccttaccacgaaatacggccactgttcacagcttcttgtgtccgtgggccaggaagtaaaggccggggatgtaatcgcgaaggtcggcagcaccggcaattccaccgggccgcacctgcacctggaggtattggtggacgggcagtatttgaacccgctgtattttgcggataccggcgacaccggcagtaccgggctgccagccattggcgcaggcggaggcggcagctactttgattacgatattccgccggaggcccttgcggatgaacagttcgcggccataatcgcggaggcggagaaatacttaggctatccgtatgtgtggggcggcgcaagcccttccacttcctttgactgttcaggcttcgtttcctgggtagtcaaccataccggctggaacttcgggcggcttaccgcggacgggcttttaggcgtgtgtacgcctgtatcgagtgcggacgcaagacctggcgacctgattttcttccaggggacctataacaccagcggcgcaagccatgtgggaatctatgtgggaggcggcatgatgatccactgcggggacccgatctcttacgcaaatatcaatacaagttactggcagcagcatttttacacctttggccgtctgccttaacagaatggaggtaacaacttgaaccctaaaattgaaaaactggcaaaagacattgaaaagaccaaggcgaagatcgcggagcagcaggccaggctccgggatttggagaaacagaaaacggagctggagaacaccgattttgtggcggtggcccgcagctaccacctgacgccccaggaactggccgaattcttaaaaacgcggcagatggcgcaggagccttcgccgcaggaacaggaggaagtgcatgaggactaaacgaatctctctccttatggcgcttgtctttctcataggcgccatgaccttgcccatgacggcttttgccgccggggggaaggacaccacgccgcccacgcttacggcggtgctggatggggaaaccgtaaagatcgtaagcagcgacgacaattccggcgtggaggcggtctatattgacaagacccgtgtcaattccctggtagacgggaaatcctctgtcgcgctgaaggattatgccggcacagataaaaaagtgagcgtctacgcggtggattatgccggcaaccgttctgatgccgtgcaatttgacaacccctattacaaggaaccggtgtccacggaaaagccggctgccaccacacagcccagccagagcagcaccccggcaacaaaaccggtacagacccaggcagcttcttccggcagcacgggcacccaaagcagcagttccaatacgggaacggcttcgggcggcacaagctcccagggcggcagctccggcagtacaggaaattccggcacaccggagcccaccacttcctccgtcccggagggcgctttcaccccggaggggaccgggaccgtgctggacagcgccaccggcgaggatggggataaacagttttacaccattaccaccgaggccgggaatgtgttctaccttatcattgacggcaagcgtgacgacaacaacgtttactttctgaatggcgtcaccgaggcggacctgatggcccttgcggaaaagagcgacggcagcgtgagcgtgatcccggctgcggaggtctgcacctgcacggagaaatgcgaggccgggcaagtcaatacaagctgcccggtctgcaagaatgatttaagcggctgcaccggaaaggaaaagccggcagagccggaggaaccggctgaaccggaacagccaaagaaagataccggcagcgtcggcacgatcatctttatcatcgtcgccctgcttgcagtcggaggcgtcagctattatgtgaagatcgtgcgcccgaagcagcagacggcggacgaggacgaatttgacgaggacgacggctacggggagggctttgacccggacgaggcttacggcgaaccggaatatctctccgaggatgactttgaggatagcacccatgaggacggcgagtaatgcgccgtccttacctattttataaaagtgaggtctttctatcgtgaatatgaaaacgaatacacaccgccgcggtttgcacaggatcgtggcatttttactctgcgcggtatgcgtctttagtctgcttcccgcccaggcgtttgcggcaggcgtgggccagaaggcaagctcctggctgggcgaccagtatgtaggttctgacgggcagcattattattccccggcgcctaccaatttccttgcttacaattcagacgggaccacggataaacgttccggctccggcggcagcgcctaccggcactacatgctgacagattcggacggcgtgacccattcggtctactgcgtggagagcgggattccctacaacacttccgaaaatacctatacttcggagaacgggaccaacagcgattacctgaatatgctcccttctgctgccaagcgcggcattaccctgacggcgatctatggctggaaacccggcgcctcccttcctgtttccgggatcaatgaggacgattataagattgcaacgcagatcatcctctgggaataccagcaacagcttcggagcgacccctacaacagacacagtaacggtcatgcttcggcggaccagtattacagcgtggttgccgggcgtcctgcggaaaaggcatacaactggattctggaacaggtggcgtcccactccaccgtcccttcctttaccgcggcgaataagggggatgcccctgttctggaactgaaatgggacaccagcagaaaggtctataccctgactgttaccgacaccaacaacctgaatatcgacctgcaaatgctttccggcagcggcgtgaccgtgagcaggaacggcaaccagtacaccttcaccagcaagaacatgattatggatccggtgagttttgagttcagaaaagatattccggttgccaatgacatgctgatctggggccgccctggttatcagaccatgatgaccggcgccagcgacccggtttccttctttatgaacatcaaaacggagacctacggcaccgcgaagatcgtcaagaccagtgaggacggcattgtgtccggcatttccttccgcatttccggcacggatattttgggaaatgaagtcaatgagactgttactaccggggataacggccaggtggaaaagaaattcctgcccggcacctatctggtgacggaaatcccggttgaccgctatgtgaccccttccgcacagtacatcaccattgagagcggccagacttcttccgtccatttcagcaatatcctgaagaaattccgcgtgcatgtggtaaagagcgacgcggacaccgggaccgcccagggcgacgccacccttgccggggcgacctatgggatttataacaatggcgagctggtagatacctataccaccgggccggaaggcagctttatgacccgttactatgtctgcggcgatagctggacggtacgggaaatcgagcccagcaccggttatcttctgaatgatacggtctatgaggtgggcgcttccccggcgctgtacgaggtggagctgaacactacggagaaccaggtcacggaaaccgtgatctatggcaatattcagcttgtcaagcatacggacgacccggacccggatgtgtccgaagatgaaaatacggaagaaccgaatgagggtgtggtcgagcgcccggaggccggcgcggtctttgaaatctacctgaaggcggcgggcagctatgaagcggcgaaggaaagcgagcgcgacctgctcaccacggacagcgacggctttgcttcctccaaaatgctcccttacggccattatacggtccaccagacagccggcgaggaaggcaaggcgttcattcctgattttacggttttcatcaatgagaatggcttcacctacagctatatcctgaataaccgcaccattaccgcaaggctcaaagtggagaaatgcgacgccgaaaccgggaacattattccgatgaccggcacgggcttccagatcaaggacctttccaccggggaatttgtcacccaggaaatcttctacccaaacccggagacccttgataccttctatgtttcggacgaaggctggctcatgctgccggaacctctgcataccggggattatgaactttacgaggtggcggctccttacggttatgtcatttccagtgagcccgtaccgttcaccattgacggcagcgaggcggttgtgaccgtcacacagcacaacatgccccagaagggccggctcaccattacaaagaccggcgaggtgttcgcttccgtccaggaaaacgacggcctgtatcagccggtgtatgaagtggccgggcttcccggtgcggtctatgatgtgatcgccgacgaggatatttataccggcgacgggaccctccgagtagcaaaggacacagttgtagagacccttaccaccggggaagatggaaccgccacaagcgtacttctgtacctgggccgctaccgtctggaagaacggcaggcgccggctggcatggtcgtaaatgctgtcccggaatatgcggagctgacctacgcgggcgagaccgtggaggtcacgcagaccgcagtagggttgtatgacgagcgccagaaagtggatgtcgccctgttcaaagccctggaaacagacgagcttttcgggcttggcatgaatgaggaatacaaggacatttcctttggtctgtatgcttccactgacttgacggcggcggatggcagcgtgatcccggcaggcgggcttctggaagtggtctccgtttccgcaaatgaggcgggcggctatgacgcttgctttgattccgaccttccgtttggcagctattatgtgcaggagcgcaccaccaacagcgcctatgtgctttccgataccaaatacccggtagtttttgaatatgcgggtcaggaggctgttcttgtctctatcctggtaaatgagggcgaggctgttcccaatgacctgctccgcggacgcattgacggtgtgaaatatggcgagagcacggaggttggcgaagatgtgaagctggccggcgcggtgatgggcctgtttaagcctgacaccgaagaatttaccgaagaaaacgcgctgcttaccgtaaccaccggcgaggacagcagctttgcctttgagaatatcccttacggccactggatcgtaaaggaaatctctgctcccgcgctctacacagtgagcccggaggaacaccatatttatatcggtgtggacggccaggcaatcgaaatccgtgtggacgataccctgatccgcggacgggtgcagctccataagaccgaggcggtggatgaaccttcttccgtggagaccgacaaggagaatactttcctgcgcttcctctccggcgcggtgtttgaactgtatgaggacaccaacggcaacaaggagctggatgccgaagatacgctggtcggcaccctgaaagagacagacggcggattccacatggcggagggacttctggctaagggctatttcgtaaaggaaaagaaagcgccggagggctaccagcctgacgaaaaggcttattactttgcgatcaccgaggacggccagaccgttgtaatcgaaaacggcgaggcaggccggggatttaccaatgaggcataccgcggcaacctgaaaatcaccaaagattccagtgacggacgcaaggacggatttgccattgaggtcaagagcgcagacggttcttactgtgagaccttcaccacaccgaaatccggcgtgatcgaggtcaaggggctgcgcgtcggcatttataccgtaaccgagctttccaatcgtgcaagcaaggattatatcattcctgacgcggccacggtggagatcaaggcggaccagaccgcaacggtccagttctttaatgagaaaccggaaaaaccggaaactcctgataatccgaaaacaccgtccaagccttccacaccgtctaatcctgataaggcagtaccgcagaccggtgatgacaatttcattttcctgtacggcggccttctggcgctggctctgatcggcggtgggatgtttactgccctctatttcaagaaggggaaatacagcagacagacccctaagacaaaggctgcgggcattgcggccctctccctctgcgcggcactggcgttaggcagcggcttcctgatggtccgtgacctctgccagtacagtgaaagcgccggggcttatgatgaccttgcaggactggtggagctgccggagcggaccgaaacaccggaggatatggagaccgggaccgcacccattgaaacggaacctgctgggtcagccccttccgtggttcttcctatggtggattttgaatctttgcgggaaagcgggccggacatcatcgggtggcttacccttcccgatacggtgatcaactacccggtaacgcaggcggatgacaacgagtattacctgcaccacctgtatgacggcacctacaataaggtgggatgcctgttcgcggattatgagaacaaggcggatttttctgaccggaacaccattatttacggacataacatgcgggacggctccatgttcgccgccctgaatgagtatgacgaacagagctactttgatacccataagcagatgtaccttgtgaccccggagggcggttatctctgtgaggttttcgcggcgtttgtggcaaagccttccgaatccggcagcgatacctctccctggcgtcttagctggaaggatgacggcgcttatacgacctggcttaccgctatggcggagcgttctgttgtggaaacggacgtcacggtgacaagcagcgataaggtgctgaccctttccacctgcacgcccggaggcgcgagccgcttcatcgtcatggcaaagctggtggaagtaaacaactgaacagactgaaaaccggtgcgggggcatgtgctcccgcaccagtcatttacaaggaggattttttctatggtgaataccattgtttcaatacccggctatgtgcatttgtaccgctcccttcttaggttttacgacatgccggaaaatgagatcagggaaatgctgtacctgctgaacacggccaacctggactgctacgagtattaccacccggagcgggaactggttgagagcggcctggtagctttctgccactggctggagacgatggactgccggccctaccgcacggaggtacagctttacaagtcgctgctgttcctacagcgcagcgtggaccgtgacctgatcgtgacttcccagcgggaggcattgcagacgcttaaatgtattatctccaatatcgaataccgcttttacaaggcttatgaaatggagatcgaggacaagcggaccgtgtacggggaatgtacctaccggctggtccccagggaggacgagccgagcgtgtgcctgatgcacgactggatttatctgccaagcgcgtaaactgtcacggattctatacaggattcgggacaaaaccattttcaaaggagggatgccttatcacgcagaaagaggtcaatgccgtttttgacggtcaggtggctctatgcagggaaatcctgcaaaagaaaacaaaggaatacacaggggacgatacggaccggctgggggctttcaaggctgccgctgctttacagcacacgacaccggagcgtgcccttgccgggatgctggcaaagcatatcgtttccctgtatgacatgtgctttgccgacggcatgagctttgacgccggcacatgggacgagaagatcacagacagtcttaactatctgtttttactgaaagcgattgtaaaggagggacagaccaatcaacagaattgaagtaaaggttttgaactgccaggcggtggcggaggccgagaaaaacatggtgtttgcggccaggcttacccagcgcgggcataagatcaatacaatggaggacctgacggccctttatgaaaagtcgttcagcaatgataccgtaacggcgatcagcaagctcccgcaccccacggtccagaaattcgcggttatcaccgttgccattgtaggcgcaagcaggcgtttccttgcgcagatcaccaggcaccagaacgaggtaaagtttatgagcgcgtccttacagtacagcaactatgcgggacaggcggattttgctgtaccctatgagattttgactgcgccgaaggcaattcaggaaatgtatctggaaagctgtaaatccgatatggattgttacgaagaactgtgcgcggcagggatcgggcacgacgcggcgggctatgccacgccccagggccttaggaatgtgctgattattagcgccacgccctaccagtggaaacatatcatcggccagcgggtatgccggcgcaatacggacgagacccggatcgtgctcctgaaaatctggcaggagcttttttcattgagcccggtactctttgctcccgatcttaccggccctttctgccagagagatcaatgtctggaggggaaaatgagctgcaaaagaaagatcgcgggcagcatgacgcccagcgggattttggcggcggattacccgctgcttatggaaggcggcgcccatgaagattaagctgatcgattttggcgtgccggaggatcagagaccctaccggccacatgggaacgatgccggcgcggatgtgtatatgccctatgactgcaccctacagcccggcgagattgcgaaaattcccctgggatttgggatcgaggtgccggatgggtttgccggatatgtgttcccccgcagcagcatggccgtcaaagggctggtctgcgagctgccgcctgtagattccggctaccgtggggaaatccatgcaatccttagcaatgtgagcagccggacgcagcacattcccaaaggttcaaggatcggccagctcgtcattacaccggtagtgatcgcggattttgtgacagagcttggggagcagcggggcaccggagcctttggcagcacagggaaatgataaaatgcagcaggaatttgagccgtcagacaaaagacggctcaatttaggacaaaacaaggattatcgccggtatagggaatggacattatcaggacattaccgggtacaataaaaagaaaagcggccaaccgctggccgctctaccgtttgctattgagttctttcataatgccgagaatgtattccattgattttgagtccaattttttggcctcagccatgaattcctgtagcgtctgcgggcaggcatttccttcatcaaagaattcctggggtgttacgccgagaaattcacaaaggtagaaaaaggactgcatagatggaagtgacttcctattctcaatgttattgatgtaattgttcgcctggcccagcgacaaagacatgtcacgggcagatacaccctttagcgcccttagctttgccagccgttccgggacaaaatcttcatacatcatagtcacctccttctgcataatagattgtaccttacaggaggcaaatattcggtagatgaaaaagggtatttgcgttgacttgctaaaataaacctactacaatatagcaaggcggtagttttaatctattatcggaggtgccagatgaaaaagaaaacatgctgtgtcacgggacacagggatttaccgcagaatcagatcaactatgtaaaggctgccctgctgcatgaaattgaaaaagcggttgcggatggctttacctgcttcatgagtggggtcgcggagggcgtggatcagtattttgtggaaatagttatggaaaaacagaaggacaatccagaattggaattgatcgctgtattaccgtatcagaaacggttagagaaccttaaagaaaaaggccatacttatgaaatgctggaggcttgccgtgatgtggttgtgatacgggaggaataccagcccagcgtctattcccaccgcaaccgctatatggtagaacactctgaccgggtgatcgcggtgtatgacgggcgagaacaaggcggaaccgtaaggacaatccgtttcgcacaccaaatgaaaaaagaactgcgggaaattcccgtgggagaaatctatctcccgaaaaagtaaaacaggatagaaaaacttggcacatcgctcacttgaacagtgggcgttttcttttgcccgaaaggaggcatttttatgtggagtatcataacacactttattgcatttattgccggtacagtggccggcgttgtgctgttctgtctgatgcaggcaggaaaaatggcggatgaaggttacgaaaatatggaacggagggataacgaatgaatactgaaattgcggaatatatcaaaaaccatatccgggagtatttaccgccggagtatcaggaggctcatatcactctggaagaagtgacaaaaggaaatgaccggaggcttaccggccttttgatccgaaacgacggtgaaatcactgtcccgacaatctatttggaaccctataccaagcagcttgcgcaggggcggccaatgaatgaaatcatgcgagaaatcgtacagatcagaactgagcaagataccaggattccctttgaagtatcggacttaatgaattacggacaagtgaagcctatgcttactatacgtctatgcgaccccgaacaaaaccgggagtatttgaaagataaaccgtttaccccgtgtggagagttggcggcggtctaccggattcaggtcatggagagcaaagagggtgttgcctctgctgttgttacagatcgtatgatggaattgtggggtgttactaaagagcagcttcatcaggacgcggttgcggcagaaacagcaagaagccctgtctgtttttacagtatggaagatatgatggacgaaatcatgttctcgtcaaaaccggaaaatctgtttgagcgcacagaaccgttggatgcagctactatgccaatgtatgttctgacaaataccagcaaagtaaacggttccgggattcttgcgcgggacggggttctggataaaatcggtgagctgcttggaaagaatttctatgttctcccttcgtctatacatgaggtgctgatcgtaccggataatgacgatatgcaggcaagggaactggaaagcatggttaaggaagtgaatgcgacccaggtcgctcctgctgaccttctttctgataaggtacagtattatgaccgggcggcaaaaactcttggccggaaacaggaaaaagggctcctggaacggctggcagaaaataaagcgcaggtaaaagaacatgcagaaaaaacaccaaaggcaaaaaaagcggcaaaacaggaaccgagtttataagggcagctatgcggctgccttttctatattcaaagaaatggaggatgacaagtgaaattagtaattgcagaaaagccctctgtcgctatggcgttggcggcggtattgggcgcaaatgagaaaaaggacggttatctggagggcagtggctacctggtgagctggtgcgtcggccaccttctggagctggcgcagcctgaagcctacggggaacagtatgccagatggcgctatggcgatctgccgatcctgccggacgaatggaaatatgaggtgccgaaggacaagaagaaacagcttgacctcctgtgtcggctgatgaaggacaaacgggtggattccgtggtgtgcgccactgacgccggacgcgagggtgagctgatcttccgtctggtctatgagtatgccgggtgcaggaaaccgatggaacgcctctggatttccagtatggaggacgcggcaatccggaacggatttgaacacctgcgccccggtaaggattatgaccgcctctatgacgccgcggtctgccgggccggtgcggactggctggttgggatcaatgcgaccaggctgttttctgtcttgtacggcgtcaccctgaatgtcgggcgcgtcatgtccccaacgctggcgcttttggtacagcgcgagacagagattcaggcatttaccagcaagcccttctatgtcccggtgatcacctgcggtggttttactgcttccggtgataagctggcggagaaacaggcggcagaggcggtccgcaggaaatgtgacgggcaggcggcttctgtcctttcaatggaaaagcagacaaagaccgtacagcctccccgcctctacgatctgacgaccttgcagcgggaatgtaaccgtatctacggctacaccgcccagcagacccttgattacctgcaatccctctatgagaaaaagctggcgacctatccccgcaccgacagccagtatttgaccgaggatatgcaggcaaccgccgcctccctgatcctgtggctgcgggacaacatgcctttcgggaaaggctgcctgggtgaaccggatattgaccgggtaacggacggcagcaaagttaccgaccaccacgccattatccccaccgtggagatcgcccggacggacctgtctgctctcccttccggggaacgggatgttttggcgctgatcgccatgaggctcctttgcgccaccggccagacgcaccgctttgaggcggtcacggcggtactggattgtgcaagtcattcctttacggcaaagggaaagactgtcttgcaggcgggttggaaggaaattgaacggctctaccgcatggggctgaaacaggcggaaccggaaaaggaggaccccgcagacgcggccttgccggagcttacccagggccagacctttgaaccggtggcagcaagcgtccgggaaggcaagacctccccgccaaagcactatacggaggattccctgttggcagctatggaaacggcaggcgcggcagacgcaccggaggatgcagagcgcaagggtttaggcaccccggctacccgtgcggctacactggaaaagctggtaacaaccggctttgtgcagagaaagaaaaaacagctcattcccacggaaaagggaaccaacctgattatggtcctgccggataatattaaatccccgctgcttaccgcggaatgggaatccagactaaaacaggtggagcgcggcgaaatcagtgcggaggctttcatggaagggatcgccgatatgaaccgggcgcttgtcaaagaacataccgcaccggaggaacggtttgccggcctgttcccttacgcaaaaggaacccggcgcgaggctgtcggcacctgtccccgctgcggcggcactgtgtatgagggcaaaaagggatttttctgtgaaaatcgggactgctcctttgccctctggaaagacaataaattctttacaggtaagaagaaaaccctgacaaaaaccgttgcggcggcccttctgaaagagggccgcgtttctatgtccgggctttacagtgaaaaaacaggccggacctatgacgcggttgtggtgctggatgatacgggcggcaagtatgtgaatttcaagctggaatttccggcgaggaaaggcgggcgcaaatgagcgccccaccggaaagggaactgacacgatccgagcgagcggcggtccgcaggctggtaacgaatctgtgcgccaactatgactgccaggataagctctgccttcccctggactgtccctgtttcatgctgaataaatggtggaccggcgcgttctgccgttatttccgggcggcggtgctgcctacggagccaaagctggaatctgccctgaccggtgaagatacttctctcaggcagaagatatgcccggtctgcggaaaggcttaccttccggtcacaagccaggcgtattgctccgattattgccggacctttgccagacggaaatccgagcgggaacggaaacggcgcaggcggcaaaacaggggatgatgtgtccgcaacttagctcaatcaagccagtgttttcaagggttttaaggccctgtttacggggcgcctatattagaatactcccggcctctgaaatggggttaagttgcggacaaagggcgctttttggcactctatttttatgacagtttggagggatgcctatagaaaaaataccgattgtgccagagatcatgcggatcgataccgggacgcaggccattgacatgcagcagatcgacaaccggcgctttctgttcaatccaaagaccggtgcgctggtcctgggaaaacagtttggaaaaacgaagggacttccaggcagccatgcggaagaactggcggctgctggtatcataaaggattttgatagctttgtacggggctggatcgggactggcaggaactatcccaaaggggtgatccactttgccccatgtgtagattccggaaacatttctctttttgaccgggcttttgacactctggaaatgttcagggaaaacggtgctctggctggaacagtggtacggggcttcgggagccggtgggaacagcccttatctgcgatccttacggatttacagaaagaggaacaaaagccctccctccggcagcagctaaagaaaacgccggagggcaaagctgtccggcacaggaaagaaaaccaacaacaacgataggaggcgattttttgagtatcaaccatattgaaacagaggaccttcgccgtatggagggaaaagacggcctgatcttgcagggctgcggcggcgagctgcaggaatggcttgacgggatcaatgaaatgttcatcgaggccggtattctgaaaaacggcgcgaagttccaggatatttccgcttttgagtatgacggccttacctgtctgctctatccctttgagggtgtggacctggagattggaaaacttgccatgtggcgtttacagacccatgatactttcggcggcacatggctctctgattttgttcccaaccgcctgggcgggtttatcggggaaccggcgccggagccggaaaagccggactgcgcgctgatcgggcaggatggcaatatttttaacctggtggggatcgctgcccgcactttgcgggagcatgggcttacagaccaggcaaaggaaatgaaggaccgggtatttgcttccggcagctatggcgaggcgctttgtatcatcggcgagtacgtcaatatcacagatacggagccggaacaaaggccctccctccggcagcagcttaaagaaacgaaaacagcggaaccgtctgcccgaccaaaaccggaaaaacagcaggaacgataacaggaggtgccgatggaaaaagaaaagacttacggcgtatgggcggtacgcagcgccgcttcaatctttggacgggcggaaagttggtgcaaggaggacgacaagccccttcaatttgcttcccaggaggcagccgaggcttacgcaaaggaatgtaacagccgcacgactgccaacgtccactattttgtaaaggaaaaggaaccggaaccgggtgctgtccgaaaggacggaacacagccggacagagctgcccgtgcccatgaggaacagacgccacgaaacgcggcggtggaaaaactgaatgagattcccggcaggcagcttccgaaagagccggaccctttggtggaaatccgttccgcggtacacagcaattatgccggcatggtcgccatgcttgcggcagacaaccgggtctatctgggccgtgaggaacgctatcactatcaggacgggcttacttcctattacgataacggcgacggttccctgtgctttattacagaccgggcggatatgtattatttcctctacggtgagggctgggcccattctcaggcggaaatgctggagcgcgggcttacagcggatcagtatgcggagtttgcccggctgcaaaacggtctcctccggcagtttgaagcgcagcgggaaatcctgttcgccgggcagcccttccagccgcccgaaagctatctacggaacgcggagctttacgaggaaggacagaccggcaattataatatgctggacggcaggatgaacaacgagcccccggtaaaaccggacctgacagacggccagacccacgaggaaatccgggagcttgccccggagaccttgccgaaagaaaagccctctgtcctggaccgcctgaaatccgagcgcccggagtatgaggcgaggcagatcacaccgcctgtcccggaaagggggctttgagtatggggacaaaatttgaaggcgttgacgtgctggactttctggggcaggtcgtagaactgcatacgcagcattataaagatgattttgatatggataaagagctgattctaaaactggccttattgggagaaccggaggaccggcgccttctctggatgtcacggccctgcggcacctattgtttgagcgagcgggaggtgtatctacaggaaagcaatgaaaataaagtatggatgttctaccatgagcagacgaatgacccgattttagcttatgcccttacattggatggtttgcaggatggaaaagtgaccggcaccatctaccccctggattacccttcccatgtggagcgggtgaaattgctgtcctgtcccattgaccgggtaacggtgacattcaaggacggcgtacagtttactttgccgtaccagtcacggagacggcagatcaatgagcttatgccggagcacggcacgccaaaatccatgcagtacgcgccggaaagcgagcgggagctggcggtgatcctgcgccgggaacggctgaaacgggattaccatgcaaagccgggcaatgttcaggaatacatggaaaaattaaaaaaggcgtccatgcgcggcaggctcaaagaagcgcgaacagccaccgcagcttccccgaagccgccctccccgaacaaggggctggaacgatgaagggcggacgggataagcggtctgtccgtgtggagtttgttctgaccgaggcggagtctgctttgataaaagagcgcatggcagagctggggatcaccaacctttccgcttatcttcgcaaaatggcggtggacggttacatcattcacctggatatgggcgacattcaggaaatgatacgcctccttcgtatctgctccaacaacttaaaccagtacacccggcgtgccaatgaaaccggcagcgtttatgctgcggatgtggaagatctgcgtacccggctggatgacctgtggaatagcatggataagctgctccggggatttgcaaacatttcgtaaacggtgaaaatagccgttgctttccggaaaccggcacggtagaattttggtagagggatatgatattttcccgcggaaggaggcttgacttatgcgtctgatattcaaactgttggcgtttccctttgtcctggttacggggcttctttatctgatatgcaagttcctggtgatcgtgtccggcgcggtgctggggattttatcaggcattgtatttctggcgtcgctggtgctgttctttactgccggagtgtgggccgggcttgcatggctggtgatcgcgtttctgataagtccctacggtctgccaatggcggcggcctggctggtcgggatgattggcggagcaaaccacgcgctcaaggattttgtatttggataaacttacgggcggggcattttcagtgtcccgccctctttttcactattcagggctgtctcacaaggcagcattttctatttggagggatcaaatgaaagacacaacacagctatatatttatccggcttcctatgcgcgtgagcatggagaactggaacaataccgtgcttcctataaggcaaatatcgcctgtaaggaggcaatcgaacaggccattgccgatcactaccgggataaccgcctcggcacggaggcagtacatcaggttttggaacagttcggctatgaccggatgttttatgtgcttgcgggcacggtccgggaaaaagattgggatgggcgtatttcccgcgataataaagcctgggcgaaaaccattccggtctacgagaacccggacggcttcggccaagatcggaatgtttactttgtggtggaccacagccaccccggacttgtcgatctctttcttacgcaggcccggctcgattatacaaaggaacatgggaaaaaagtctcgatccgcgaaagcataaaacagaatacagagcagacggcagccgtacatgcaccaacaaaacggaaagagccggaacgttaatacattttcaaattcgcacaaaacagatattttccctattgtttcgtgcagttcaaaaaacgattatttctgaatccgttcaaaaccgttgtattttctcttgctttgcgttataataaaaacaaaaaggaggctatgcaatggaactatacaaagaacttgccgctttgcgctgttttacacacgatgatatggtgcagctcgccggatcagaaagctccgctgtatggcagataaagagttatctgcaaaaaggatatatcgagcgtgtgcgccgcaatctatatgcggtcatcagcatggaaaccggacaggcgatcccgaaccgctaccagatagcttcccgcgtgacagacgatgcctgtgtgtcccaccacagcgcctttgaatactacggatatgcgaaccaagttttttatgatgtgtacttcaccactgaaaagcgcgtccgcccattctcttatgacggcgtaaattactgcccgatggcctgccggggaaatgcagacatcataaaaatagacaccggcatccgcgtgacttctttagagcggaccgtgatagacagtatagcggattttgaaaagatcggaggcctggaagaattgctgcgctgccttctcctgattccttcgcttgattgtaacaaactgcttgacgcgctggaactgtatggccgggcgcagctatatcaaaaggccggatatattcttgaagtatggaaagaggaactgtctttaccggaaccgttttttgcggaatgtgaaaaacggtcttctgccagtaaaacctatctttttgaaaagcagggcgattttgtccttcataacagatggaaactatttgctccaaaggatttgaaaacgatcataagtaagggggtaactgattatgatgcgctttgaccgtattacgcttggcagacaggccaaagaactcggctttgtccgtgacacctttgagaaggtctgccgcctcgcggacgttctttcttttatggaaagcgatgggctgcttgcggacagccttgccctgaaaggcggcacggcaatcaatttgacgatttttgatctgccccgcctgtcggttgatatagacctcgatttctcaaaggatgtatcaagggaacccatgctggcggagcgggagcagatcaatgaacacatacaaaaatacatggcggcttccggctatacgctgagtttgaaatcaaagcaataccacgcgctggattccttcgtgtacgagtatgtgaatgccggaggaatgaaagacaacctgaaaatagagatcaactatatgctccgctgtcatacgctgcctgtttcccgcagaccggtttatttgccgtggaacgatcaggagcttacagtattaagcgttgatcctctggaaatcttctccgcaaagacggttgccctcttaaaccgggcggccccgcgggatttatatgatatgttcaatatgcagaagtatggattgtttgacgagacgcaggaaccgcttttcagaaagtgtattatgttctacgcggcgattgcttcggaaaccgtgccggaacactttgaccttgatggtattggcaacatatccgcacggaaaatcaggacggaccttacaccggtgctgcgccgtggagaacgctttgacctggcctccgcgcagaaacaggtaaaggattatttagccgcgattctaaaaccggaagatacggagctgtccttctggcaggcttttgcagagggaaactatcagccgggccttttgtttgacgatgctgatattctcccgcgtattgaacatcacccgatggcgctatggaaatgcggcgggcgggtgccaaagcaaaaagatacaccggcgttataacgaatacatactaagggctgtccttccgggcagctctttcattttgacaagggggtgatcctgatagcgaccacaagactaatgccgctgcatgtgggaaaaggccgggatgtgtctacggccattgtggacatcattgactatgtggagaatccgcagaaaacggattttggaaaatttatttatggctatgcgtgtgatacccggattgcggatgcggagttccttctttccaagcggcagtatttgaacctgaccgggcgggaccggggcgcagatgatgtgatcgcctaccacctccggcaagccttcaagcccggcgaagtcacgccggaagaagcgaaccagatcgggcgggagctcgcactgaaactgacaaagggcaatcatgcctttgtggtgtgtacccatgtggataagcaccatgttcataatcacattatcatcaattccaccgcccttgactgcacccggaaattccgcaacttctggggctctacctgggcgatccggcgcatgaatgacaagctgtgtctggagcacggtctgtctatcgtggaaaatccaaaacccagcagggaccactatggcacatggctgggaaatacgaaacagccctccttccaggagcagctacgccgggcaatcgacgcggccctggaagaaaggccgaaaggctttgaggaatttctgaaaaagctggaggctgccggaatcgaagtcaaccgggaacgcaagaacctccggctccgggtgccggggcagaaaaactatacccggtgcaatacgctgaaaggcgactataccgagcaggcgatacaggaacggatcgagggcacccgcacggcaaaaccccgccgtactttttcgcaaaagcccgttccaaaggttgggctgctggtggatattgaggcagcggtccgggccggcaagggaccgggctatgaacgctgggcgaaggtatttaacttaaaacagctctcccaggcggtgatctacctgaaagagcatggagatatgagctatgaagatttgcaggaaaaagctgctgcggctaccatcagctttaatgcactgtcggcaaagatcaaggaactggaatcgcagatgaccgccaatggagaattgcagaaacagatcgtgaactatgccaagacgcgggcggtctatgtggaataccgcaaggctggttatagtaaaaagttccgggcggagcatgaggcggatattctattacaccaggcggcgaagaaatattttgacagcataggaatcacgaaactgccctccgtcaaatcgctccgagaggaatacgccggtctgctggaacagaaacggaaagcctatgccgcctataagcaggcccggtctgatatgaaggagcttcacaatatcaaggccaatgtggactatctgctggacattcctgcgtctcaggagcagcagaaagacaagcaaaaatcccgacaatagttttatgttgctttgggttttcagcgttccgaaggaacgcgcagccgtcaccgcaggtggcgatctcaggggtttggggatatgtcaccaacaagcattttagagggtttcacggcaacgggaaatcctctaaaatacgcaatcttacggaagattgcattgcttgcgaacttgtaaaatagaaacagattcttgacaaaactctctatacatcatataatataacagtgatatataacagtgttatggaggtgaatagaatcaaagaaagtcagactactttagaacgtatccaccgggcagcgaaagcagaatttttagaaaaaggatacaaagacgcttccctacgaaatattgtgaaatccgtgggaatgaccaccggtgctttttacggttactataaaagcaaagaagaactctttgaagccattgttagtgagcattacgaatatattctcaaccgttttataaaagcgcagcaggagtttgccgagcttccagctgtacagcagccggaagtcatgagtgatatttcggggctttgcatggatgatattcttcattatgcgtatgaacatttagaggaatgtaaactgctcctctgctgctcggaaggaacaaaatttgcagagtttattgatgaaatggtagaaattgaaacaaatggaacccatgcctatcaagatgttttaaggagacttggaagatcctctcctcatatcgatccctcgctggagcatattctaatcaccggaatgtttcatactttttttgaattgatcatccacgaaatgccgctcaaagatgccgaaaactacgtcagagaaatgcgcgccttttatacggcgggatggatgaaaattatggggcagtaatgccttataatttttgcctgtaagttagcattaactaacctaaattcggatattgtaagaacatagacgtgttctctttatcataaacacaaagaaaaggaggaatttttttgaaaaaacaatccaatttatcacggctgctggaaattgcaggcagccataagtacctgacctatgcttcctgggtgctttctgccatcagtgccctcattgctctggtgccattctattacatctggaaaatgatcaaggaagtactggaggtggcaccagattttggtcaggcacagaacctgaccggcaatggctggatggcagtattgtttgcagtcctggcggtgcttgtttacatagccgggcttatgtgttcccatttaggggcatttcgtattgccacaaacctgcgtatccagaccatggagcatattgttaagcttcctcttggatttgccgaaagatttggcagcggaaaactgcgtaaaatcgtcaacgaatccagcgcagccaccgaaacctatctcgcccatcagcttcccgacagagccaatgccattgcaaccccctgcggtcttttggtgctgttgttcgtgtttgactggagactggggctgttgagccttgttccggttgtgctgggctttctgattatgatggcaatgaccggaaagcagatgcaggaaaagatgaaagaataccagaatgcgctggatgatatgtccaatgaagcggtagagtatgtccgcggtattccggtggtaaaaacctttggtcagacgatcttttcctttaagaagtttaaagattccattgaccgctataaagtatgggtgatcgcctataccaagcagcttcggacaccgatgatgttctatacagctgcaatcaacggagtttttgccacactgatcgccggaggactgttgctgacacaagacggtgtaacttccggtttcttactggatctcattttctatatcattattacgccggttatttctgttacactgacacgcatcatgttccaaagtgaaaatgccatgatcgtagatgacgctttacagagaattgacagcgttttgcatttgaagcctctggaggaaaccaaacacccaatgcacccgcaaaatgcttccgtggaactgaaatcggttcatttcagctatgatggagaaaaagaagtattaaaagatatttcattgaccattcctgaaggccgaaccgtagcttttgtcggcccgtccggcggtggtaaaacaacccttgccaacctgatttcccgattctttgatccccagagcgggatggtaaaaatcggtggtgtcaatgtgaaagacattccgaaagagaaactcatgaatacggtgtctttcgtatttcagaacagccgtctgatcaaggcgtctattctggaaaatgtgcgtatggggaaaccggaagctacccgtgaggaagttctggctgcccttcatcacgcacaatgcgatgatattctggaaaaactcccacagggagcggatacggtcatcggtacaaaaggtgtctatctttccggcggcgagcagcagcggattgccattgcccgtgtgatgctgaaaaatgcaccgatcatcattctggatgaagccactgcctttgctgacccggataacgaaagccgtgtacaggctgctttctcaaaactttccgagggaaagacagtgattatgattgcccacaggctttctaccgtaacaaatgtggatcagatttttgtcattcaggacggacaggttgccgagtgcgggaacagtcgtgaattgcttgcaaaagacggcattttcagccgtatgtggaaaaattaccagacttccgtgcaatggaaggtaacaaaggaggtgcagtgatatgatcaaaaaactgcagaaaaaatatgccctgtctgaacagggagcaaaagacctgatcaaaggctgcctggcctgtgtccttcagaatctgtcttttatgttcccggtaggacttttatattacctggtcagcgatctgatgaacgggggtgttcccggtgggaaaattccattttatgtggcaggctgcgtgatgtgtatcggcttgattctgctgaccactttctttcaatacaatgcgacctattttgccacttacaaagaaagcggtatccgccgcattaccctggcagagcatctgcgcaaaatacctctttcttttttcggaaaaaaggatttagccgatcttaccagtaccattatggcggactgtaccttcctggaacagagtttttcacattttatccctgagcttgcgggttcgatcatttctacggttctgatttctatcggtctgctctttacggactggagaatggcgctggctgccttatgggttctgccggttgcctttgcgattgtgggattttccgcaaagattcaggaaaatctgaatcagaaagcgatggatgtgaagatggcctgcgcagacgggatacaggagtgtattgaaacagttcgtgatctgaaagcgaacaatgcggagcaggcatatttaaaagggctggaaaagaagatccgtgctgtggagcatcgttccatcctcaatgaatttggtcttgctgcttttgtggtttccgcgtcactggtgctgaagcttggtattgcaacggttgtgctggtgggagctgttctgctcatgcaagggagcctctccgtgcttacattctttatgttccttctggtagtatcccgtttgtatgaccctctgcagggcgcactccagaatcttgcggcagtcatcagtacacgaaccaacattgcccgtatgaatgagattctcgatcatccgatccaacaaggcagtgacaggctttccaatcaggggtatgatattgtctttgaccatgttgggtttgcctacaataccggagaaaccgtattgaaagatgtttcctttacggcaaaacagggagaggttacggctttggtcggcccatctggcggcggaaaaacaaccgtatcccggctggctgcaaggttctgggatattaacagaggaaagattaccgtgggaggcatggatgtatcccgaattgacccggaaacactgctttctctgtattccatcgtattccaggatgttacactgtttgacaatacaattctggaaaatatccgaatcggaaacaaagacgccacagatgaacaggtcattgctgctgcgaaacttgccaatgtggatgaatttgcggaaaaactgccggatggatggcataccaatatcggggaaaacggctgtgaactgtccggaggagagcgtcagcggatttccattgcaagggcttttctgaaagattctccgatcatccttctggatgaagccactgcttctcttgatgtggagaatgaaacactgatccagactgccctttcccgcctgatcgcggataagacggtactggtgattgcccatcggatgcgtacagtggccggcgcagataagatcgtagtcctttctgatggcaccgtggcagaagaaggatcaccaaaggatctggcagaaaagaatggcgtatatgcccatatggtaaaactgcagacagaaagtcagaattggaaacttgggtaaagaaggaaaatgaggactggttatgcaaaaattaggcgttttggaggataccttgtttatccctatgctgggcagaatctatgccagtgagcattgcccgcaaattttatatgataaaaaagcattggaattgaagaacaagctgccgttagacttgattgaacagaatgtgcagaatcagtataccctcttggcctctgcttcccggtttgttaatatggatcgggttattcgggcttttctggaacgcagaccggacggtgcgattgtccagctgggctgtggtctggagacaacctatcaccgatgtgataacggaaagacacactggtatgccgtggatctgcctcatgtgatcgaataccggcggggacttcttcccgaaccagagagggaattctatatttccggggatgcctttgcaaaggattggatcaaaaaagttcgcaatgatgtacttgatgctcctattctcgttactgcaggcggattatttcattattttgaggaacataaggtcattgcccttctgcgtatgattgggcaatttggaaatatggaagttgtttttgatacggtgaacaaaagaggcatgaccatgatgaagaaaaaatatatgaaacaggtcggccatgccgatgcacagatgttcttttatgtggattcagcggaagaactggcagcaaagatcgggggtaatgtgaaggtgattgcggaggaaccatactatcgttacatccctaaaaatggcttaaagctatccacaaaggtcagtatggcggtttctgatcggttctgcatggtgaagatgatacagttgaaattatagatacttttgcgcgaaaaagaaaagaggtgaaatcttgttatgacatataataattgttacctcaatcaactctacagtgatttgcttttcaatgaattagagcgaggatgtattactcaaataaaaattaagcacggggtgattttttctaattggtaatgaaactaccaaaaaaactattatatatttagtttatatcaactgatagggaggtggaaatgagcatgagtgaactccacaaaccagaatggtatggggaatatgctgtaattaaaaataagtataatgattatgttcaagtggagtataaatgcaatggaacaggaagcctatatgactatgaccttttccctggtattgacttgatttttatggattttaattgttcagatattttccatgagcctattcctaataagaatatcattgaaatccggcattaccaaaaaggacgtgttgagtttgagttaagaaataacaaagtgttccacatgaaagaaggagaattttgcattaatgctcttgcaaatattcctgcggcgtattccttcccctttggatatagtgttggattgagttgtgtgattgacaaagattctattgatgcgaaaacaaaacaaattttttcttactataatattgatatcttaaatcttggacaagaattggaagtagaaaaaaagtggtttttatgccggacaccacagcgattgttacatatctttgatgaattatacactgccaaaggcgtggaaggaaaagattacttccgtataaaactattggaactcttttaccatatcaaacaactgcgaattgaagatcaatatgaagcaacgtattattccaaagagcaaattgaaatcattaagcgtgtccgacatcagcttatagaaaacctggacaaaaaaatgtccatagaagaactcctgcaaagagagccaatgagcaaggttacatttcaagctattttcaaacagatttatggcgacacgccctatgcgcatatcaagaattacaaaatgaatcttgcggctgtttatttacaggaaacagatcaatccatcacccaaatagctggagaacttggatattcaaatattagtaagtttgcgagagcttttcaagaagtgtttagaatgcttccaaaggattatcgtaaagtaaaaaaattaaattaacttttgggctgttttgggaaactgccttttcatttggagtagttagcggatgcgaactactgtataatagtgtcgtggttagttatggctaatcacgacgctattatatttaaggaggattctggaatggaacaaacggtaaagaaaaaaataggcgttcgcgatattatgacgattgccgcaatgatggtcatcaatttcgcaattgcaatggtgattggtatggttacattgcctttcccagcagtatatttatacggctctgccggtattgatgcctttattggagcaacattttatttggttgcggcaaatcgtatcaacaaacacggattgttgtttgcttgggctgcggtttatggactaatccaaggtgttatgggttatatgttcttggttccctatttcttgattgtagccctcattgccgagttatgcatggttggcaagaatacataccgaagtgcagttcgcaaccgaattggctggatggtcaactcaatcggaaattttgtaggctgtgccgtaccgctgtggtggtcttgggacagctatcaggaaatggcagcaagcagcggttttgatgcaaataccttgaatatgcagctctctatggtgacttctccggcactgatgcttctgggtgttgtcattactgcggctcttgcaattcttggtacattgttcggccagcggttgctcagaaagcatttccaaaaagcaggcattgtaggatgatggccgaagaaaaaaaacaaaggcggattgaccagatcgacgggcgcacagttctttttctgacgctgtgcgcctgcatcgtgacctttctcgcaaccagtttttgggaacatggaatttttaccttttggatttttttgatcctctgctggtttggcttgtataagcaggctttgggatgttttgcggtctatttggcggcgattgtatggctgatgatcgaaacaaagtatcaggtcagcattccctctccgctgttactcagtatgatttacaaacttttacttcccgccatgccagcctatcttctggctaaaatcccgtccgggaaattgacagccagcctgcggaaaatgccgattcctacccgtatcatgcttgtattgatcgtaatgcttcgttttgctccgactgtgctgcatgaatttggagaagtcaaagaagccatgaaaattcgtggtttcttaaaatcggttggcagtgttttgaaacacccaatggacacattggaatacgccattgtcccgatggtatttcgctccttaaagatcgcggacgagttagccgcttctgccatagtcaggggaattgaaagcccctacaagaaagaaagttactatgtcagccggattgctgcgctggattgctttttgattgttgtcagcgtgggagccactgtgtgctgctgtcttttataggaggaatggaatgggaaaagaaataatgatccgtgacctcaccttttcctatggcgggaacggaaatcaactggaacatatatcgttagacattgctgccggagaagtcattgttatgaccggcccatcaggaagtggaaaaagctctttgacaagagtgattaacggactgattccctatttttacgagggggaattaagcggggatgtttttgtggacgggaaaccgctgaaagaaattccgtcctgggagcgcggcaaaatcgtagggaatgtattccaagaccccaggagccagttttttgccaatgaggttgctggtgaggttgctttcggctgtgaaaactacggttattcccatgaggaaattcggaaccatgttcaccgggcggcggcggacattaagattcaggacattctggattatagtctgcacagtctgtcttatggaatgcgccagaaggttgcaatagcatcggcagaggcgattgacccggaaatctatgtcatggatgaaccgtccgccaatctggatattgcatctacttatcgctttgcggacattatctgcgatttgaaacaacagggaaaaaccattatcatagcggaacaccggctttattatctgatggatctggcagaccgcttcctgtgtgtgcagaaaggaaaaattgtgcgggaatttaccgcacagcagatgaaagctctgactaatcaggaaattcagacgctggggctccgcactcctgatctgcatcagattgagcagacagaaatccagtctgcggcaaccaaagaagttgtcctggaagtgaaaaaactgaaccactcttttggtaaaacgattgtagctgaggatattgactttcaatgccatcagggagaagtgattgccctgattggtcccaacgggacgggcaaaagcaccatagggcgaatcttggcagggcttttgaaagaaaaatccggcgaagtcgttttattcggaaagcattgcagacccaaaagccgcttaggaaaggtctggtacattccccaggatttagacagtcagctattcggtgaggatttgctggacgaactgactaccggcgctgaggtcagtccggaacggaaacaagcagcggaagaaatcctggaggctctggaactgacgccgtttatcaaacagcatccctctacgctgtcaggagggcaaaagcagcggctggctcttggcgtagccctaatgcacgaagcgcctattatcatacttgatgaacctacaagtgggctggacggtacaaatatgcgaaatgtcagccggatgatccgcaaactggcgaagatggggcgcaccattatcgtcattacccatgacgcggagtgtgcgcttgcctgctgtgagcgggcaatacgccttgaaaacggttgcattaccgatgattttcaaatcagaggagcaaagctccttttagaaaaaattgggtataaccaaaaggagggttagaaatggcacagcaaaataaacagcagccgaaggctaaaaccgggctggcacgctgcctggaattggcttcaggtcataaaggacttgtgtttctatcaggttttttggctgcactggctgcaatttgttcttttgtaccttatttatcaatttattacatcattcgggaaatcctgtttgtttatccggatatgtcgctcttgaatgtttctacaatctcaacctggggctggcttgccctggctggaattttggggaacatcgtattttacttttttgccctattgtgttcccacattgcagcgtttggaacgctttatgaattgaaggtggcctttgccgatcacatcatgcaaattccacttgggtatcatttgaccttgggcagcggcaagctgagaaaaatcatggacgaaaacattgaaagcgttgagaaatttattgctcaccagctcccagattttgtagcctctttggttgcgccgcttgttctggttattattcttcttgggattgactggcggtatggtgtggtttgtctggtcggtattattctggctttcatcgttcagtttgcgggcttcaacggcgaagcaaaggaaaaaatgcaccgctttcagactgcccaagaaaacatgaacagcgcctctgtggaatatgtgcgcggtatgccggagatcaaagcatttaatcagaccgcagattcttttaagaggctgagcaaatccattacggactatacatctttcgtgctggagtacgcattgggttggcaaaactgtatgcctgcatttaccacaatcatcaacaatatttatctgtttttaatcccggtgggtgttctgatcgggatgcacactacggatttcagagagtattcgttgacattcattttctacctgattattgtccatgcgatttctggcatcctgaataagattatgtatatctcggagtcctttacgcagattgatggcagtgtagagcgcatggatgaaatcttgcgtatcccggtcttgccggaaaagaatacaacggctgaaatccaaaactatgatattgcttttcaggatgtcagtttttcttatgaaactgattcccaggtcaaagccttggctcatgtctctttccttgcgcctcagggcaaggtaacagccgttgttggtccttccggtggcggtaagagtaccatagccaacctgatctcccgattttatgatgtgacggatggaagtattcaaatcggcggtgttgacattcggaatattccgctggatgcgctgatggataaggtcagctttgtgtttcaggatacattcctctttaagcagagcatcctggacaacatccgcatgggaaatccagatgctacggaggaacaggtgattgcggcggcaaaggcggcaagatgccacgaatttattgagcagcttccaaacggttatcagactgtaattggaagcaccggtgttcatctctcaggtggtgaacgccagcgtattgccattgcaagagctatcgtaaaggatgccccaatcattgtgctggacgaagcaactgcattcagcgacccggaaaatgagtacctgattcaaaaagcctttgaaaagctaattcagaataaaacggttgtaatgattgcccatcgtctgtctacgattcgtaacgctgaccagattcttgttatggaaaaaggatgcctgattgaatccggcactcatgacgagttgctgaagaagggcggaaaatacgcgcagatgtggagcagctatacggagtcaatcaactggaaaattagcacaggaaaggtggtgtgatctatgagtaagctgaaagaaaagttaatgctgtcggagaaaggctactccgacctgaaaaaagcgattacagcctgcacaataaccaatattgcgcttctacttcctgcaacgatagcctgcctgctcttttgggagctactgaagccgtttaccggagaaacaatttcgtgggtcgcgctgtggaagttattgggattgggagtggtagcggccatcctggtctttctggccgccaaaaacgattaccgcaaaacctatattgcctcctataaggaggccagcacgaccagacttcggattgcagagcatcttcgcaagctccccatgagcttctttaacacgaaagatttatctgatattaccacaaatatgatggctgattgtagcagcatggaatccatgctcagcagtacaattccgccgttgattgcgaatattatttccgtcaccctgacctgtatttgtctggcgttttttgactggagaatggctcttgcgattttctgcacgatgccgattacattcctcatcatctggtgcggacgcaagctgcaactccgcctgtttgacaaacaggtagatgtgaaattagaggcgtccagccagattcaagaatacctggaaggtatcaagatcatcaaatcctgcggccttggcggttcccgtttctccacgctggataaagcactccaagccatgagaaaaatcgctattaaggtggaactggcctccggcattctggttcagggagccagcctggtcctgcaagcggggcttggcatcaccattttcattggaacggtgctgataaccggcggcgagattgaactgcttcctctattggttctgctcatgttctccacgcaaatttacggtccgatccttgccatcctttcgcagttgacttctctgttccacttgggaactgtcaccaaccgtatgcgtactctgctgaccactcccgctatggagggcgaggataaggatgtatccaagtatgacattgaactgaaaaatgtcactttcggatataaccgtgatgatgttatcaaggatgtgtctttctctattcctgctggcagtataacagctctggtaggaccctccggtagtggaaagagcacgatttccaaactgattgcccgcttttgggatgtaagaaaaggtcagattaccattggcggtatggatgtcagaaccattgagccggaacaccttatgcgctgtatgtcctttgtatttcaggatgtaaccctgttcaacgatactgtttttaataatatccgcgtaggtaacatgaatgctactgaggagcaggttatgacagcggcaaaggcggcatactgtgacgaatttatccagcgattgccggacggttatcagactgtccttggggaaaacggcagcaccctttccggcggtgagcgtcagcggatttccattgcccgcgctctgctgaaagatgcccctattattcttctggatgaggcaaccgcatcccttgacccagaaaacgaggttttaatccagagggccattgcaaaactggtggagggcaagacggttattatgattgcacaccggcttcgtaccgttgcggatgccgatcaaattctcgttcttgataacggtagactggtggaacatggtacacatgatgaattgatgaaaaagaacggattgtaccataaactgttccatatccaacaggagagtcttggttgggctgtgtaaattgttttagaaaggagatgttccatgaaacttcatgcgtctggggaggactatctggaaaccatccttgttctccaaaagaaattaggtatggtgcgctccgtagatgtagcccggcacatgaaggtgtcaaagcccagcgtgtgccatgcggtggctaacttgcgagacggcggctttctcacgatggatgaagattactttctctacttaaccgatgtaggtcgcaaggttgctgaaaaaatttatgaacgtcattgcttctttacggaacagcttattgcagctggtgttgatcctgaaattgcagaagtcgatgcctgccggatggaacatgttatcagtagcgaaagttttgctcgactaaaagaaacagcaatacaagaaggaaattttagaaacaaaggcggtgatgacatgggaagttagttgtgtttgatatatcggaatctggtaaagaaattggagaaaaattgtttatccttttaagtacaaagcaacagcaggaattgaaacaatttattatggatattgagtgtggaaaaataagactagcagatattttatcttgttcttttggttcccatgttatttgctgcatgaataaaaatgctggcaaagcaaagtttgaaatcgaaaaagatgatctgtttttctctttggaacagcgtcttgttatgattcaaaataaagtgattgctcttactgctaaggaatttgacattctggctctactgatccgtcatcccaaacgggtatttacctatgaaatgataacggaactggtatgggaagaagaatatgcttccttttcccgaaaggcagtgaataaccatgtaagcaatctcaggcaaaagctcaaggtttcgccggatgtaccagactatattaaaagtgtatatggagttgggtataaatttgatttagattaaccgaatatacattatatacaaaaataaatgaataaaattgtatttatgatagattttgccggaacaaggacagttctggaagatttcaagaaaagaacgagcataaaagtttgtataattccttcaaatagatagaaggaggcggataattggcaagcctgtctatccctccttgatttggagggagggcatggttatgctaccgaggtcaacatgccggcctcgatgctgccggccaaatctatcattatgccccgtagtctggttttggattgcggggtttttccattcgacaaaatattatattttccaacatttccctttcaatcaattattagggttgtatgagtgcgcgcctgtcatcggacagacgcgcacttttgcgtttatagaaaaattttttgtctttctgttctctgtggggtgtcgctccccgccctctgatttcggttttagcttttcacacgcaaacaaatcgaaattggaggaaatttatatgaaacaaatcaatttaaaggaatattacccattttacacaacagacacaatcgtagaagtaccggatgaagtcgctgatattttaagagcttataaattacgcgatgaagcatatcggatttatacatatcgacacaaagcatatttttctttggattttggagatggaattgaatatgaagcccttgtagatcaaaaatcaccagcagatatttatgaacagcatagggtgactgaaatgatctataagggacttgctactctatcagaaaaacaacgtcagaggatctatgcacgttattttctcggcatgagccaaacggaaattgccagagtggaaaactgcagtaaaatctcagttcatcagagcattaacagaggtttaaaacagcttcaagaatattttttaaaaaataatttataagcccactaacttttcccttaaaaatgtactgtattatgaagggaccttttggcaggacaagccattgtggttggatcggacagaaccgttccgatatatttccaatatggatcgctttgattgccttctctccctcatggttctttgacaagtgaatatacgttgctatgggtacatcattctgcgtaccgagcggcatatagggcggcgccatgacagacagccaaaggaggtgatgaacccggttgtccgagcgatccacgcaacctattaacccggctgtggcaggttcgggcgcgacgacggcgcagatgacaatggtacttcttcacggcctcctaaagacttggggggagttcctgcggcgtgcgcttgctctggcaaagcggcgacgactgcggggctatgatgcggtcaagctgtccgcagcccatagcaacccctgttctgtgtcaacagaacctgccggggatgcgtggcaaatacggcatataaaatcgaaatcagatactatgaagccgggcttagattacaagtccaggtccggctttatccatgtgattttgatagagaatcaatttacggaaaggagctggaaaaatggaacaaaagacttcttatgatgataacctggtggatattcgcagtgtatccgtcaacaaggaacttccgcgtgaagaacgaattgccgagttcgtcagacagatcaagaacccctgtcatttcaggtgtggaaagtttattgtgcgtgctacttattgtacggacggagctacattagaagaatgtctgcatggtatcttacgataaaaatttacattttaggggctgttttttcccgcgtggagcgttataataagaatcggaaaaggaattgaataacaataaggcatattgcactccttgaattgcggggatttttccgtaatgaaaggagtgtttttgtatgcagatttataaagctgcgaagtatatccgattatcttatacggatgataagtcaaacgaaagtgacagtgttggaaaccaaagaaagctgattgaggaatttgccaaccaccacccggagatcgaacttgtttcggaacgagtggacgacggttatagcggtgtgatttttgatcgcccggctttcaaagaaatgatggatgacattatggagggaaagatcaactgtgtgattgtaaaggatctttccagacttggacgtgagtatattgaaaccggccgttatatgagacgtgtttttccggcttatggtgtacgttttattgctatcaacgataatatcgacacaatcaatgagtccgccggggatgaccttacggtctccgtaaaaaacattatgaacgaggcttacgcacgcgatatttctttgaaaacccgcagttctcttgaaacaaaacgtaaaaatggagattttgtcggtgcttttaccgtgtacggctatcgtaaatccgaagaaaatcataatctccttgtggtagatgaatatgccgctcaggtggtacgaagtattttcaggatgcgcctggaaggtttcagtccttatgcgattgcaaatgagctgaaccgtttaggaacactttctcctcttgcctataagaaaatgaatggtctgccttgtgcaagaaacggatataccgatcgaaaagattgtcggtggtcctctactacgattgtccgtattttgcaggacgaaacttataccggcactctggttcagggaaaacaaggctcacagcactttaaactgaaggaaattgaaaaccgtcctcagtccgaatggattcgtgtggaacacgctcacgaagcgattattgagccccacgattttgacctggtgcagaagatccggcaactggatacccgtacttctcccggtaaaaataaagtctatttattttccggcatattgatctgtggctgctgtggcgcccgtatgatacgaaagacaaaccgctataaagacaaagagtaccactactactattgccctaccgggaagaagagtggctgtacaaaccctgttatggtaaaggaaagcgacctgatggaatgtgtcagggatagtgtaaaaggatttgttaataatgttgtttctttggaagaaattttatccggtatcaatcagagccgtatcaataaagaactgatccgggaatacagcagacagatcgcgcagaacaatcagcagttggagcagatacggacattcaaaaccagtctttatgaaaatatggtaagcggattgatcgagaagcatgagtttttaaatttgaagaacacctacaatgttcgtatcgctcagcttgaacaggcaatagccgctttagaagaaaaacggacagatgttatggaaaaccgcagtgaacgtaaccgctggattgagaacttcaagagattttctgaaatcgaagaactggaccgaaaggtaatgatccagcttgttcacagtatcaaggtagttgggaaaaatgaatttcaaattgaatttaactatcagaatgaatatgagaaagcaatttctctgattgctccggcacaggaaaggatggtggtctaagatggcaagaaagagcagaaaacatatcgcagaacctatttttacatcggtttctccgtttatcaataccgctttatatatccgcttatctgtggaagataacaaaaagcgtggtaattctatcgaaacacagaaaatggttctgaaggactacctttccaacaaaccggaatttcgcatttatgatacttacatagataatggtacaaccggaaccaattttaaccgtgagggatttcagcgtatgctctctgacattgaagccggaaaaatcgactgtgtaatcgtaaaggatctgtctcgtcttgggcgtaactccattgacagcggatactacatagaacagtattttccttctcataatgtcaggtttatcgctgtaacagatcagtttgattccgaaaatcctgataacctgcacggtggaattatccttcctctgaaaaatatgataaacgaagcctattcactcgatattggtcgtaagattaaagcacaggcaagacaggatatgaaagagggaaaatttgttggcgctcgtgcaccttttggatataaaaaggatcctgatgactgccataagctgattgtggatccggtggcagctccggttgtccagcagatctttcaatgggcatatgaaaaagttggtctgaaccgcattgtactgatgctgaatgaaggcggctatcctgcaccaagcaattataagtattctaccggggaaatcacgcatgaaaatttaataggagaaggtttctggcagacacgtaccataatgaagatccttaaagaagaaaaatataccggcgatatggttcagggccatacaaaaactgttgcacataaacaaagacctgcaggaaaagaaaaccttatttctgtcgccggtacccacgaagccatagtttccagggaagtttttgatgaggtccagaagtaccgaatagaagttgccgaaaaatacaaacaacaagaaaagattccatattctccaaatatttttaaaggattgatcttctgttctcattgtggcagaagtctgcaccgccaaagagcacgccgaaaaaagggagatgtttaccgttttcaatgccttactcccagcagggttcataaggaaaaatgtgtcggtgtttccataaaagaaaatgaattgatagatactgtgatcgacattctgaaaaaggaactctccgctgctttaggagattatgcccttttagttgaggatggaacccaatggcgtaaaagggaaaaagaattgcaggatcgccgcaataccgccagccgtatgatccagcagaaccaggatcgtattcaggtattgtacgaagatatggtaagcggcctggtagataaagacgatttctttctttggaaaaagaactatgaagataaaatgagctctgccaaagcagaacttgcagaatgtgaaaaagtagccatagagataaaaaaacagtttgaacagtataagacgcttgaaaaagacgaaaaagaactgaaagctggatgtacattaactgcagagcttgtatcacgtttaattgagcgtattgaagtggatcacgataaacatgtctctatcagattccgcttccgtacagagtttcaggaatacagcaaggcggtggcacaatgaaaaaatatgtgattgctctatatatccgtctgtctttggaagatttcaaaacagacagtttaagtatttccagccagcgcatgatccttcaagaacacgctgccggcttagaagaatacggaaatgcagaactgatggagtttgtagataacgggtatagtggggcaaattttgaacgccctgctgttcaggaacttcttgatctggtacgtgcaaaccgaattgactgtatcatggtaaaggattattgtgcgataataggactaaatcagaaagaccttgaaaaccaaggcattctggcttagtcccttctttttttgaccgaaaacaaaggactttcacaataatcaagcaagccggagggtgccgctgcacacttccggcagaaggaggatatagtgggtgctatcaaagtcttcttgaaggaagttgtgcttccaatcgcgcttgcgttctgcctcgcgtcatttctcaagccgatctatatgcctgacggcgtatgcgactacttcctaatgtggatctgcgtcggcttgccattcggcatccggaggatgtgcctctggctcgttccaagcggttacggcatctccggctcagtcggcattttcgcattgaacttaatcataggcggtctcatcggaggactcgccttcttcatcgggctgctgctcggtatcattcataccatccgagaaatcatctgaactacatcgtaaacgaagagggtttgtttcttctccaatttggagtaagaagcaaaccctctttttttgttgcccaaaagccggagtatttgctggcgatgcggcgaaagaaaggagtttttaagcatgaaacgcatgacagccggtgatcttcaagcactggaattgctgatgcagaccacacccggctttgagcattttgacagcggcgcggatggcattctccctgagtgccgaagctgccgctttcatcgccccttctggaaatatcagtcctgcgtgtttgcagagtgtccctactgctgcaatcccgtttctaccctcaaaaaccaaagtggcacatctgctgccggaaaggaagtcaatcatggataacaaaatcgaagtcttcaagaatgaacagtttggagaaatccgaacagccctgatcgaaaacgagccgtggtttgtggcggtagacgtatgcagggctttggagatcggcaattcgtcacaagccatttcacggctggatgcggacgagaagatgattaccctcatttcaaatgagggtaataaacgaggcaatcccaacatgacggtggtgaacgaacctggactttacacgcttattctgagcagccgtaagcccgaagccaaagccttcaaacgctggatcacacatgatgtcatccccatgatccgcaagaccggcggctacatgacggactcccttctggaacgtattcagaaggaaccagcggtcattgtggagtttgctcaggcgttgattctggaaaagaatcgcgtaaaggctcttgagtgtgagctgaacacggcaaagcccaaagccgattactacgacgccttcatcaatccggatgactgcaccaatatccgaacgacggcgaaggaactgaaaatcccggagcgcaagttcgtccagtttcttctcagggagaagtacctgttccgatctccctccggtcagcttcttccctacaacaaggacagcaatgccggactgtttatcgtccgcgattttgtgacgtactgctacaccggttctcagacctacttcacgccgaagggcaaggatgtcatccgaatgaagttccagaaaaagtgcggcgaagagctgctttccaagatggcaaggtgatttctgtggcagtctatcgcgtaaacaagaatcgtggctatacggtcatggcgaacttccaccttcgagacaagagcctgtcactcaaggcagtcggtcttctctcaaagatgctctcgtttaatgatggctggaagttctcaaccaagggactttctgcaatctgcaaggaaggtccggatgccattctctccgcgctccgtgagcttgaaaagcacggctaccttgtccggcaccggcagagagacggtaaaggcaggatgagcaacacaatctttgagatatacgaagagccgcaggagtctacaccagaacgggaaaagccacacacggaaaatccatgtgtggagaagccagatgtggataatccacgcggggataagtacgcacaaataaatactgatcaagtaattacccaagaaagaaatactctctcaaagaactatcaatccatcaatcttgatgggatggacaggatggatgagcgaagcgagtatgaagagattatcaaagagaatcttgattacgacattctctgtcaggatccgaagttcgataaagaccgcttccgggagatcatggacatcatgctggatgccgtctgctctaccgctccgaccatccgtatcaatggcgaggatatgccgcagcaagtggttaagtcccgctttctcaagctgaatagcagccacattgagtacgttctggaagcaatgaacaagaacccgtcagacatccgtaatatccgggcgtacctgttgaccgctctgtataacgcctctctgacgatagacaattactactccgccctcgtcaaccatgatttctacgggcaggacagatcagcagggtcaaagaagccgaagacctacgattatagcctttgtgaagacactctttaatgaataccatcgtgagcattgctcggaaaggaggacagtgtaaatgaaaatcatctatcgccggattgtgccgccttagcgtcggcagcagtccccataatcattccaaggaaaggaggtaaacgcagcaatgcaggatgaagtcaacaccaaagttgttgcaatcatgatcaagggcggtaaaatctccgctgaggtgctgaaaaaggctctggacaagttcgttcaggagatcgagaaggcgcagaagcagatgaagcagcctaaaacctatcgcggcaagcagtccatcaagcatctgatgagccagaatgccgccatctccaacatcgaagtgacggatggcaacatcaaatcctttgagcggaccgccagcaaatacggtctggactttgcgctcaagaaagacgtttccgttgagccgcccagctatcttgtcttcttcaagggacgggacgttgatgtgatgaccgccgccttcaaggagttctccgccaaaacggtcaagcagaaggaacagccgtccatccggcacaagctggatcaggagaaagcccagagcaaggcgcagcacaaggagaaggtcaaggtcaaaaccaaggatcggggtgtggagctgtgaacaaacccgatgtgaagaagctcattcttctgaaccttccgtatgtcttcgccttctacttcgcggataagatcgccgccgtgtttcgtctcgcccccggcgcagcgttcatcgacaagctgacaaacggctttgccgtgttcggctctgcctttgcaaatccgctgcccagctttcatcccgtcgatcttctcatcggtctgtcggctggcgtgctgctcaagctggcagtctacgtcaagggcaaaaaccgcaagaagttccggcagggcgaagaatacggatctgcccgctggggcaagccagaggacatcaagccgtacatggacccggagttctccaacaacgtcattctgacgcagacggagttcctgaccatgaacagccgtccaaagcagccaaaatacgcccgcaacaagaacatcctcgtcatcggcggttccggctcaggcaagacgcgctttttcgtcaaacctaacctgatgcagatgcacagcagctacgttgtgactgacccgaagggtacggtgctggtggagtgcggcaagatgcttgaaaagggcggctacgtcatcaagtcgctgaacaccatcaatttccggaaatccatgcactacaacccgttcagctacattcgcagcgagaaggacatcctcaagctggccaatacgatcatcgtcaacacgaagggagacggcgataagtccggcgaagatttctgggtcaaggcggaaaagctctactacacagctctcatcggctacatctggtatgaggcacccgatcacgagaaaaactttactaccctgctcgaaatgatcaatgcctcggaagccagagaggacgatgagaccttcaaaaatcccgtggatgtcatgttcgatgaactggaagcccgtgacccggatcacttcgcggtcaagcaataccgcaaatacaagctggcggcgggcaaaaccgccaagtcgattttgatttcctgcggtgcaaggcttgcgcccttcgacagtgcagcgacacgttgtcgcatataaactctgcgtgggattttcctgcaaagaggtaaaagtgacggaaaggctatagcctttctaacaataaaaacgccgcagaccacgcacctctcgtaatccacagcgtttccttatggtcggggtgacaggattcgaacctgcggccccttggtcccaaaccaagtgcgctaccaaactgcgccacaccccgacagaacttgtacattatatatctttaatcgggatttgtcaagtattttatcaaaattttttgaaaaaattttaagtaaaattgatttttttctttatttctaaaaaaattttatgcgtacgtttatgtgacgtaagattttaaaaaaattgtgttactatttatgaaagttaaaaattatttatagggagtttaaataatgcacaaagaagttcaatttaaaaatcgggataaatttgttgaattaggtataattatatcggcaataaggaaatcaaaaggaatgacacagagagaacttgcagaaagagcttttatcagccgttcgcatttaagcaatatagaagcacctaatattattagttcgttcgctttggaaacgttgtttaatattgcggatgcgttggaaataagcgcaggggatttgcttaatattaaacttccgtctcctcaatatattaatgaggatagtgaatttgataatgataaatattaattctttatacaatagtaattttattcagttatttttaactatgtatatgaccccatataaaaatttttattattacataatagggtgtttgaaccatttctttttctcgcaagaaaaagaaacgcttcaccaaagaaaaagtgcttgctcgcttaggtcgcctaacggctccaaggggcgctcgcccccgctaatttcatcttgaatctgcgcttcaagatgaaaaagccttgttactttcccgttgactttgtgaactgccgtgaaaaaagatattccgagttcatatttattacttatcaaaaaactaagtttttagtttaaattattacacaaaagcaggtttttcagtgaacatcggtagggcgcatttatgcgccgcgtaaggtgagccaacatctgaacacgcagtgttcaatatataatataaaatattttgtttattaaggttaattataaaaattgtattaggagatgaaaaataatgatgaaaacacgtctgaaagatttacgtatttccgcaggtcttacacaaaaggaagttgcaaacgcattcggtttaaaaactgtcacttattctcgttatgaaaatggtgtacataaaattccagtaaaagtaatattaaatattgcagacttttatgatacatctgttgattacattttgtatcgtactgatgattctaaaccatacccaattaattaagtataaaatatttttaataaattaaattataaattgcaaaaattgaaggaggtttgacccaaagtgagttagccactaaaatgcaaattatgaatgttaatattgaccagcaaatgattagtaagatagagaataatgatagaatagtaacagactatgaattagcgtgtttctgtattattttaaaaattgatgaaaagaagttattgaaagatttctatgatagtttagattagtttttttgtatatgaccccatataatatttataattttacttataataggtgtttgaaccatttctttttccggcacgaaaaagaaacgcttcacctgtgaccgcacctgtatggtgcgtgtgatacaaagtatcttgttttgccataacctacaatgtcaataatatgtatactcaaaaaaagaaaaagtgctgctcgcttaggtcgcctacggctccaaggggcgctcgcccccgctaatttcttttgcgctctacgcacaaaagaaaaagccctgtaactttcccgttgactttgtgttctaccgtgaaaaaagacgctccgagttcatatttattacttatcaaaaaaactaagtttttagtttaaattattacacaaaagcaggtttttcagtgaacatcggtagggcgcatttatgcgccgcgttaggtgagctaccatctgaacacgcagtgttcaatatataattaacaatttataaataaaaaatattcttgacaaaaatagaaaaagagaatataataaaagcagataaaaggtaaccgtttaacggttgtcacaaaaaagtttattaataattaatataactgtcctgtgtcagaggacagttatattgcttttgtagtgactattataaaaaatattataatagatataaccatcctttgcacgagggcggctgtattgcttttatggacactattataaaaatattataatagtaaaaagataggaagaattgctcttcctatcttttttattagtatcttgtaaccactactgttatgttgtacttctcgttccaaacaactgttcccatatgccaaagctcatctattgatatagctccgcttccgtttatgtcaaaagttctttctgcataaactcccgggtcgtcagggccgttcttaagcagtatgttcgccggctcccaatcgctgagctccagtttctcctcatcgtcatactgtgactgctctccgtaattcggtcccgccgtcaaatccttgtcaacattgtttactattgtgacggtgtctgtggctaaatcatagctcacatcaaatccataatcttttaaatccctaagcattacaacagcacagtccagataattcgtttcagctgttccatagtgaataaatgtcggtatttcccaatcgttgatgaaacatctcaggtcggtcgctactatgtaatccttaggcgtgctgtcaaaatatgtctgaccgttggccgctctgcttgacagcaagtcccagctgtagtccatcatctttatcgtgtcaacataacgcatgtttgttgaactctcacccattacaaccgatacaagacgctttccgtttcttaccgccgttccggtaaaacagcatcctgcggctgaggtcgttcctgtttttaagccgtccgcaccctcatattcgtatgctcctcccggaagcattttgtttgtcggataatatgtataaccacggaagttaagaaatgttaaactcgtataatttaatacatcgggatagtcgcttataagcctattggctactgttgccattcctctcggcgatattttgtttctgctcgatactccggtgcagtcaacaaaataaccgttaacgccccacgctgataaccaattgttcatctcatcaacaaaattcgcttcgcttccgcataaataatcaccgattgccataaccgccgcgtttgcggaaacaacacatatcgcccccaaaagttcgtctacgctgtaagtggctccggcatccaggtacacatttgaatatcccgggtctcttgaataattagccagggcacgccctacgggtatttgtgtgtcttttgaaaggcttccgtctgctaaatgactgtatattacatataaagataaaatcttagtcatgcttgccggaggtatcggtgtgtcaggattatgtacgaataacgcttcacctgtttcggaatccaatacaaatgctccgcgggcagatatacttaccgcataagctgaaacggagcttaacagcacggttaacgctattgtcagcggcagaaaacacctcagtatttttgcggcaaaacttttctttacactggttgatttataattcaaaactttatgcacccatcaaattgtaatcttaatgtaacacaattgtaacattacaagttaagagtatacaacatatcccaggatatgtcaagataattggttcctaaataggcaaattttgtataaatagtctgctgaaataggtgtgggagcgtaagtattttgggcgtttctagaaaatattaacagtttgtaaataattcgaataaaccataatgattataaaaacattaaaaagggctgtaaaaaagcaaagccgtgatagcaaatcacacaaaggaaactctatgactacgcaaaaacagcgctgtcctcagacttttagccattaaaagagcgctgtttttgtgtaatatatttggaaaaataactttttatagtatctatgtctagcgaaaagcggttttgagaaaaaggttataaaacaaagtaagcgtactcagacgaatgaccattgctgaattgagaaatgtttaggaaacgctgtttgtttttcttgagactgcaaagctgcttttttactcctctaaagagtgtcaaaagcattggcatttgtgaatattgttaaacgcttcatactttatttatagtttaaaggatatgtttagcataccttgagtgtaacgaaaattaggttttttattcctttcagcaaaattttgctttgattttattgtaaaaaatcatcgttttgccttccgagttcggcggcaatgaaacagaattttgctgaaagggtttattgccagtcttaagatatgtttgggatatccctagatataattttaatttatttattctctaaagcgtttcgcaaatcggatatatactttttttggaaccgctttaaatatggtttggcaagaagtttcatcatagatttttttggctcaacggcttctgtaaaacatacttctgtttttccgccgtctttttcggtgaatattcctgtccagtgccctgatagattgccgttctccatgtttagttcatatcttttatatggtttgaattctgttatttcaaaggtcgtagcgtatccgcttttatcaaattcgacaaacctttcgccctctttcataaccgtgagtttgctcaggtcgctgcgccagctgtagttttcaagagaagttactatatcccatactgtttttatttcaaaatcaagcactgttgattgtgttacctcaatcattttgtatcatcctttgcgcaaaattatttctaatatctctccgggagtttttaaatataattcatcagtgtcgggcattatttcaggataccatcgaaatcttgaaaagtcagttaaataactcataccgcgacggcagttcgaaaattttttataccacttcggaaagcatttttgagtgtactttttagccaattctacggcacagctgcaataaagccctgattttgccggtgttccgcatatttgaactccgggcggactggaatgaacaaataatatgcttccgtcggtacactctcctattactatgtaaacgtggtcgtttgaagtcattatatcgccgggtctgacccctgaaaattcttttgagtgtttaccgagacccatttcagcaaatagtttcccctggtttttagcatttgtaacatagtctgagcctgcgccgtttttatcttcaaaaaagttatacataacccagcctacatatccgctgcaatccagcccgtttccatgctcatatctgtgttctttataatcataatcgctgtcttgtgatataaagaattttttccaatttggatttactccaattattttggcgtcctctccggcgccgttatcctcgctgttccagccgccgccccatatatacatcgtggaaccgacaggctccattgcggttcgcaaaaaatctgttaagcttttattcatatccgcacctctgaattactttatattcagaaaaatatgccggcggctgatgtaatattccaagaaataataatcagggaataaaattctgagaaacagtatgcctagagtaataattagggaaaacattctgagaactatattataggaaatagtattttactgtttcttctctaaagccattattttttctacacgtctgctgtggcgtccgcctaagtgttttgaatcaaaatatgcttttacaatttccaatgctaaaccgggtccggttatcctctcgcctaaacatattatctgggcgtcattgtgttcctttgccatttttgctgagaacacgtcggttacatgagccgctcttatcccgtctattttgtttgcggcaatgctcattcctataccggttccgcagaccaatactcctgaagagcactcgccgtttagaataccgccgcatacaatttccgctatatcagggtaatctgcaggaacgtctttttgagttccataatctttgtactctatgccgttttcgtcaaaatattcttttatagtatctttaagcgccacgcctccgtggtcactgcctatagctatcataacaaagcctccttaacagcattattttctatatacttgattatatcataagcatattttaatcacaagacaaaagtattaacaaatatatttatttttcgaaattcgtttaatgaatcggtataatccaaaaaaattcacatataattaactaataatacaagaattttctaataaattaatgtatactatatatgaaaacttaaaaaataaaataagtacgcttgtccgttttattgtacacctagcctgttataataatagcatagagtaaggatagaaccagaaaggagtaataatatggcagcagtaaaatcgtttttacaaagtttgtttcaaaaggaaccaagaaaatccgcttctgctgttaaaccgctcaaggacagcgtgaggatgataataataaaaagtccgcgctgattgtgcggcataaatgtgtaaaactctctccttaaaatattggggctgcgccataggcgcagcttcttttttattaaaatttattttttacatggcaaatttttgcatatttaatacaagcttagaatcttatatttcgtttattttatagtgtagaaacgtttgcaaagtccgaaataatgttcgtagcctgatttttataattgttaaatttaacagattatttctgccgcgcattacagaaatattggcaaaaattaactaattacaaatgatataatattatgatatacgtatcattgacattatttaattataattatatatttacggaaataagggttatattggtttggcgacaagtaagcggacaagtcttcaggcttatataatctaatagaaatggaggaacaatcatgaaaaaaagtcaatttttccgcaaaatgtttgcggcggctctctcggcagcgatggtattttgtacgctgaccgggtataccgccgctacggaaccggtgttcagcacaggcagcaggattcgtgtggacctaaacgcaaatgacggcaggcagaattcttacacgaataatgcttacaattggattgtatcgggaaccgcaccaacagctgcttttaacggtgttacatttaaactcagcaacggcgggaacacaggttcaggcattaggtcagccagttataagagtttgacaaagtctgacggtacgaccccaactcttacaatggatggcgtgacgattaaggacgcggataagggcggagctattaagcttgaaatttccggtctttcctcgggaacgcacactcttacgacctggcacagttattttgacaattggccgaacggcagtccggtgactgttactgtgaatggttcaaaatcaagtacggttacagtccccactcgtgtaacaaacgacgagaatgcgggtaagtcatttacgacctttaatgcttcaggcggtacggttacggttttaattcagccaacagacacaagcaaaaacggagccgtgctgaacgcgtttgaaattgacggcgctgacccgtttaagtctgtctcaggaatgaatcctaaagacggagaaagacatttagaaatagataggggtctttcttggactgcgggctccggcgcaaagagtcatgatgtttatatcggaacagattataacagcgtgtataacgcgactaaaaattcggcagagtataaaggaaacagaacatctccgaattatgctttggacgacagctattcttcgctcaacacttactattggagagttgatgaggtcggaagcagcggagttactaagggtgctgtgtacagttttcaggtagcccgtcttgcgtttcctacagctgagggttacggccgtttcgccagaggcggacagggcggacgtattgttgaggtgacaaatctcaatgactccggctcgggcagtttgcgtcaggctcttgaggtggaaaagggtcctcgtattgttgtcttccgcgtcggcggcgttatccagctgaaaagcgcactggttattccaaatgacggcggcgaagtatatgtggcaggtcagacagctccgggtgacggtataactttgataaattatgattttggtgctatgggctcatcagacgttattattcgtaatattcgtgtaagagtcggggatatggacggcaaatcaacaggcggtatgggtttaggcagctgcgattatagtattattgaccattcttcagtatcatgggcaacagacgagggattcagctcaaggtcagctaaaaatatcacttttcagtggaatataatcggcgagtcactgcatgattctgtgcattataacggtgatgaccgtacagacacagaacctcatgcttttgcggcttcaataagcggttatgttggaagctttcaccataatctgcttataaactgcaccggcagaaactggtcattggcaggaggtatggaacaagacgctctcacatacggcggcaatgtggatattagaaacaacgttgtttataactggagagacagaacaacagacggcggcgtaagacggcttaacttcgtaaataactattacaaagcaggagcggaaagcaacactaatatgcacatagtctcaatcgacggcaacgagctgaatacttatgatatgcagaaggcatatgtttcaggtaataaaatggtagcactcggaggttctgtgcttctgaatccaagcgatgacgcctggagcaaaggaaaagcggtaacggcaggcaagggcaataattcatcaggaaataaggtttctgtttccgatgtaagaagcaactcgcctttctttgaatcttatgttaacacccaatcagcagacgaggcctataacagtgttgtaaacggtgtaggcgcaaacgctcagggctgggattatatagattcacgctatataaaagaagttacaacaggaacctatacttataaaggcagcaaacaagggttgaaaggtattatagacagtcagaatgacgtaggcggctatccaaattcatctaactttaaaggcggaacggcgcctgcagattcagaccatgacggcatgcctgacaattgggaaaacagtcatgggctcaatcctaacgattccggagacggaagtgcggtaagtctgtcagctgacggttatacaaatgttgaaatgtacttaaatgaactcgccggcgactctgtagtctttaacggtgggggcggcgaacctcttgagggcaatatgattaaatcgctggttgtaaaagatactgcaaacgctgcagactggtcaatccagaacaatctgcagacaggcgatgtaatctacggcgacagagccaatacttttaccaatatatctaattatctcaaaggcgctgaatggataagagtggcgtgcgattcaaagaatcttcagtctgatgtagccgagttcactgctggaagcgcaatcacagtgtatgtaggattggatacccgagtgtcgaatctgccgtcgtggctgagtggatggacagctaacgattatatactgcaggcgtcaaatgatgtgacctataaaatatatcagaaaaactttaatcaaggcgataaggtaactctgggaacaaacggaccgccgtcaggagtggttatgtatacggcgtttgttaaacaggcggtaactccaacgccggaaccggctcctgtaaccggtgaggtaacatatattgcagaggactttgccaatggaagacaaaacgagcagagcggaacgtttacgctgaaatcctcttatgcaggcacaggcatacaaacgttgttcagttctgacggaacaacaattgataatgagtacgttaagggttataaggactttatcggaaactcaggctcaagcagtacaaaaggagacccatatttgagcggagtgaatctgtcagccggaacatatacaatgtattacctgggaagcaacaacaggggaataacaatgaacctagcaagcggttctggaacagtggtgtcagagacaagaactcagacacctgttgtaataacggaggacggaagcgccagggaactatggctgagcgcgataacatttacactgccgcaggatttgacagaaggatctttaacatttacaaacagttcaacatggctgccggatttatatgcggttaagtttgtttcataataatgacattgtaggttatttaaaacaagtaactttttattacacacacctttcaggtgtggtcacaggtgaagcgtttctttttcttgcgagtgcgaccacactttccttgaaagtgtgtgctatacatatgttcttattttgccataacctgcaatgtcattattatgtatactcaaataaaaagaaatggttcaaacacctattataagtaaaataatatatattatatggggtcatatacatagtagatatatattatttttaataaacaaaatattatatatcaaatttatatattgaacactgcgtgttcagatgatagctcacctaacgaggcgcataaatgcgcccttccgatgttcgctaaaactccgattttttagttaattaagacaatacgaactcgaaatatcttttcttacgggtcacaaagtcaacaggaaagttacagcccatttcttttatgcgtagaaacaaaaaataacagtgtgcgttaacaccacaactcaaaacttatcaacattgttggttatatatacaaactcagccgtacttcgtaacgaatacgaagtgcggctgatattgttttgcgtttactttaacttttaattcaactatattaattcgtaaatcaatgtattcaaaaaatattactatgctttccgcaccgccaataattagcacccctcagttcctgaggctgcttttattaatagccgatatgctccggcgcttctgacaaatctcagtataaccttataataaagaaacacgccatcttaattaaacaagacctttaattccttgtaatagccaactattataaccctaacaaatctatatcttattataatttaagttaacaaataatctatattattcaaagaacaaattaatcaaggaacaaatgacgcggcagtccgtcaaccataaacggagtcagttctcctattataagcggacggcagtatgccaaaaattcatccgaaacatatgttccgtcatttattatccactcgtcaggaacaaccttttcaatattggctattttatttacatcatatgtagagcatattatattatatggctcgtttgacgtcctggtaaatataatcatcttgcctgtctcgccgtttaaggccgcctgaacagcctcgctcccagccataaaagcctcggtaatgtcacgtcttgacactatgtgcgacgcgcatctctgaagcgtgctgaacacaatacccctggacttaacacctaagttggcgccaataaaatccgccaaatataaagcggttccgccaagtgatttatgaccgaaagaatcctcaaaggtcgcctgtttattgtcttcacaaacatattcgccgttagccagctttattccctcggaaaccgcaataactacagaggtttttttctttttaacagccttcacctgctctaaaaatctgtcgtagtcaaaagttacttccggcagataaattagatcgggtccaggacagtcttcagcccttgaaagagctgccgctgcagtgagccagccggcgtttctgcccataatttccacaaccgtaaccgattctgtgggataagtgtttacgtcgcgtattatctctttcagcgccgacgctatatattttgcagcgcttccataacccggtgtgtggtctgtaacagccaggtcgttatcaatagttttcggcactcccataaacctaatatcgcttccgatttcttcagcataatttgacagcttttttatagtgtccattgaatcgtttccgcctatatagaagaaatattttatatcaagctcttccataatactgaacaataatttatatgttgcctcgctttcctccacagacggcagtttaaaacggcatgtacccaaaaaagacgacggggtgcgctttagaagctcaatgtccagttcattttttacgtattcggacatatcaacgacttttttatttaaaaacccttcgattccgtttctcataccatatattttttctactcccgcatcctttgcggctttaaatacaccaaccaaacttgaattaataacagaggtcggacccccggactgacctacaacaacattgccttttaccaaagtgattatcccctttcgactaattaataacttaaaccctaaattttttcaatattatataaaataccctctctattttataatttaaacatcaaaaacatttaggagataataaataaaaatatttgacatattaaataaataatataaaatttatacaaattattatagcagataaacgcctgattttcaatgtcataatggtaaaatttttcgcagcaaaattggtaaaaaacacaagaaacctttgtttttttatttaaagtatattttaagatataagtgggaaatatataattgggtcaataggcatttttttattttcaataacaaccgcaacaaattttagaataacgccgcagacaaaatactaagaatataagtatttaaggagctgaagctttatgaaagaatttgaaaaaagaaaaaagcttaaagatatagaaggaaagtttaacctcggcaacgcctgcagcagcggtgactgcaccggtcttatccaggttgagcctataaccgacgcagaacttgagtcgtattatgaaatttataatttcggcccgcctgatatatctgaataaaagtttaactgtttccggtaaccgtgattaggtttatgcagacagaacaaaaaatgaacaacaccattaaaaactgtaattaaaacggtcagcaaaaaaacgacccccttatggcagaataaaaactaccataagggggttttaacagttattttataatctttttgttatctcatactgtatacgttcagcaaattcctgaaaggtcatactttccgtttggtctgttgctctgtccctgaccgaaacggtttcattttctgcttctcttccgccgataatcagcatatacggaactctgtctatctgccttgcctctcgtatcatataccctattttttcgtttctggaatccaattcacagcgtattccaagttctgacagcttctgatatactttttcagcatattccaaatttttgtcagataccgataacacctttacctgcaccggagcaagccaaaccggaaatttccccgcataatgctctgttaaaatacctataaagcgttctatagagccgaaacacaccctgtgtatcataaccggacgctgttttgacccattctcatctatatactcaagctgaaaattcagcggcatttgaaaatcaagctgtatggttccgcactgccatgtacgccctaagctgtcctccaaatgaaaatctattttggggccgtaaaacgctccgtctccctcattaacctcatacggcagccctttgctctcaagcgctgttataagcgcatttgttgcgttctcccagtcctcgtcgcttcccatgctgtcatccggccttgttgatagttctacagtatacttaaacccaaactttgtataaacctcgcttattaggtcaataacgctgacaatctcatccttaatctgttctttcttcataaaaatatgcgcgtcgtcctgagtgaaacagcgaacccgaaaaagaccatgaagcgctccgcgcatttcatggcggtgaactaacccaagttcgcccaatctaatcggaagttcgcgatagctgtgaggtctgcttttataaaccaaaacgccacccggacaattcattggtttgacacaataatcctcactgtcaatccgcgtcgtatacatattatccttataatgctcccaatgaccgctggtttcccacaaacttctgctcataatcataggggtcgaaacttctgaataaccgctcctgttatgaatttcgtgccagtactctattaaagcgttttttaactccataccttttggaagaaaaaacggaaatccgggaccctcgtcactgaacataaacagctccatttctttgccgatttttctgtggtcacgcctctccgcttcctcacgcagcttcaaatattcctccagttcggcctgatttttaaaagctattccatttattcgggtcagcatcctgttattcttatcaccgcgccagtacgcccctgactgctgtgttattttaaaagcttttaaagcctttgtatagcagaggtggggacccacgcacatatctatatattcgccctgctgataaaagcttattacggcgtcttcaggcaaatcgtctatatgttcaagcttatacttttcgtttctctctttcagcaattcagccgcctcttcccgagacaatataaacggttttatgggcagattttcttttactatacggcgcatttcatcttcgatttttaaaaggtcctcgtcggtaagttttgtatctcctaaatccacatcataataaaaaccacgttctgtcgccggcccaaaagcaaaatcggcttcggggtaaagccgttttattgcctgagccatcacatgcgccgcggtgtgccgcagaacatgaagctcttgctccggctcgcattcttttacagttccgtctctctcaataatcttcataataatctctcctaaaaattattaaacataaaagaaaagcacccttgaacacatagataacctatgtgtcctaagggtgcataaagttcaatgcacggttccacctcagaattttaactttaggttcaatcaaaccctatcctttaacgcaggcgtacggcaaatcttactataagttcagatatgcggctccggagtggttttcacaaatatcttccataagggactctcagcaaacgtccctctctctgaatggttaataaaagctactctctccttctcagcttttctattatgttttaagtaattatatcatgcgctctgctgtttgtcaactcttcttaaactaagtagactatagctatctgtttccaaacttattaaaatacttctttgtttctgacgcaataacgccgcttaacgccactatcgctataaggttaggaagcgccataagaccgttaaatatatcggctattgtccaaacggcagatatagtcatataaggcccgaagaaaacagctaatatgtaaatccatctatagacctttacagcctttaaatttccacccgataaatactcaagacacttttcactgtaataatcccagccgagaatagtagtaaatgcaaaaaacaccagacacagcatgattataaaggccggcactgcaccaggcagaaaaaacagtccattttgaaaagcgtatgtagtaacacctaccccctcaagcgccaattcaggtctccatgctccggtgataactatacacagtccggtcatagtgcagataacgactgtatcaataaatgtgccggtcatagtgacaagaccctggcgcgccggttcctttgtttgggctgccgccgccgctataggcgcggaacccaaaccagcttcgttcgagaatattcctctggctacgcctttctgcatagccaaaaccattgccccaagcatacctcctgcggccgctttaaaaccgaacgctccggctataatctccccgaacgccgccggtatcgcctttatatttacaataagaataattacgcagaccgtaacatataagattgccataaacggaacgacaaattctgatactgttgaaattctctttattccaccgatgattacaagtcctgtacaaacagtaacaataattccggttataataacagtccatgaatattccattccgaatattttaaccgtattgctcatgttagggtcaaaaaaattgtttacagcagaggatattccatttatctgagtgaatgttccaagtcccagcagaccgacgcagacgccgaaaaacgcgaacaactttgccagccacttccactttttgcccattccgtgttctatataataaaacgggccgcccaaaacatgtccgtccggctcaatcaccctatacttaatcgccaaaagaccctctgaatattttgtcgccataccaaacagtgcggcaataaccatccaaaaaagcgcgcccggacctccggcacaaattgcagttgccacaccaacaatatttccggttcctatagtcgccgacaaagcggtgcacaaagccgcaaaacttgacacttctccgtcgccgttctcttcgttttttactataaatttcagcgctttgggcaaatgtttaatttgcagacccctgagccgaacagtcaaataaataccaactgcaataattaaaagtataagaggaagcccccatacaaaatcatctatttttgttaaaacccgacctacgttttcaagcataatttccaccctgtctaattcccgaataatctacttataaccgggataccaatcaaaaatatttaaaaattcagttattaaaatataaaacttgctttataacaacacttataattttaataatgattcgcaatcaaacgtctatacaacataaatgacgagagtattttaaaatattgcttccgccattataaaaaattttaacataacaaggtgaattattcaagaagaatttagaaatacaaaagtaaatactataatttttataaatgctgttggatactttacaatttataaactatatttaaaaaataaaaatatcttcatctttctgcttaaaaaagtttaaaatttttatgctttgtttagtatttattattctatgtgcggttatgaatttaactatttactttatatcctaaataatcaaacctttcaggtaacaattttttttaaagcaatctatttttgatattacaactataattatgtaaaaaactttcgcctatgatcttcttttacaccgataatttgatttgttaaatatacattcacccaataccgctcctcctattatcagcaaagctccgatagcttgcgtaaacgtcataacttcatttaaaaatataacagaaaatataactgctgacaaaggttctatataccccagaattgctacagtctgtatcggcagtttgcctatggatgaaaaataaagataacatccaatacctgtattgcataaacccaaaattaaaataaacggcagacttgaaatattagtctttattacaaaaccttgtttaagacagacaaacacggcgacagtaataaaactaaataataattgcagcattgaattttctaacccttttatatccgacgcctttttattaaagataaccattacagcatatactaacgctgacataagaccgcaaaacaacccccaaaggtttttttgttctccaattgtatacccgtttatcaaaaataatccgcaaacgacaataacgaaccctagccctttagtaaaactcaatttttccttaaatattataggcgacagcgccataactataacaggtccgcagtaatattcaagagatgcaacacttataccaatctgttgatacgcttcatatagaaatatccagcttgttcccattgcagctccggatataacgacatataaaaattgctttttatgtttataaaacgtcagccttcctccggcgataaaaaatatagatataagaaacaaacttcctattaaagttctaaaaaatactatctcatagctgcttaaattaatgaaacttgccactatcccatttgacccaaacagcaaaagagcaaatatatacttaacatacgaaaatttcatagtctaatcccttcccacaaacaatgtgcctgcgttttcaccgtctaaaattttataaaaaatatcaggtgatttaccatttgttattacagtgttaatccctttggaaacagccagctttgccgctttcagcttggttctcatacctcctgtaccaaaactcgctccgcctgccgcctgcataacatttttatctatttttgtaacttttcttattagttccgtttcttccttcaaagcaccgtcaaagtcgatgttcccactttaataacaacgcgattattatgtaagctcatatttataccccacttatttcaaaagatttattgtcctttttatgttgacaaattctatatgttattatatcatttttatatcacttccaaaagagaatgtttataatgttttacattactaattagaataaataaggacggagctttactaatgaatatatctaaatatatggcctttgttgccgcggtggaatacggaagctttactaaagccggcgatatgctcagctattctcagtcggctgttagcaaaatgattaacgacttagaagacgagtggaaaatttcaatccttgaacgaagcaaatcaggcgttaaactcacatcggacggtttaaaaattttcccatatgctaaatccgtctgtgaagagtatgaaaaacttcaaatacagatagatgaattaaacggacttcaatcaggacttataagaattggaactttttcaagtgtagccactcactggcttcccaatataataaaagaatttcaaaaggattacccaaatatagattatgaattattactaggagactacactgaaatagaaaactggatatcagaaggacgcgtcgactgcggttttttgcgtcttccaacccgttctgaatttgacgcgttatatttggaaagcgacaggcttttggctgtactgcctgaaaatcatgagttatccaggaacaaaaatgtccccgtctcagctctttgcaaagagccttttatgcttctggaaaagggcgcaaaagccgaagtatcggaaatatttgaaaataatgatttaaccccgtctgttcatttcaccacctgggacgactacgcaataatgtctatgatagaaagcggattaggcgtcagcattttacctgaactgatactaaaaagggttccatataatattataataaaagaactcgatgtaccggcacaccgagatatcgggattgcaatgaaggacagaaaaactgcttcgcttgcagtaaataagtttattgagtatttaaaatttagataacaaatatattctgatacaataaaaaacctcccaaacaatgggaggttaaaattatatttctgattatctctttgagaactgtggtgcacggcgggctgctttgagtccgtatttctttctttccttcatacgtgggtcacgtgtgaggtatcctgcactctttaaaacaggtctgaactcatcatcaacttcaagaagagctcttgctataccatgacggatagctccggcctgtcctgtaaatcctccgccgttaacattaatcaaaacatcaaacttgcctaaggtttttgtagcgtccagcggctggcgaactacaaccttcagagtttcaagaccaaagtaatcgtcaatatctctcttgtttattgtaatcttacctgtgccgggcaccaatctaaccctggcaacagaactctttcttctgcctgttccgtaatactgtactgaatctgccataattatataagtcccctttcttaaaactcacgtgtccactcaatcggtgactgagcagcatgttcgtgtttgtcgtctgcgtaaattctaagtttctttaattcttttctgccaagactgttatgcggaatcatgcctgtaacagctaattccatagctttttcaggtctttgctccattaagtccttataagaaacttctttaaggtgaccaatataaccggtatgtctgtaccatttcttttgaagaagcttgtttccggtaagaacagcgtctttagcgttgattatgataacatattcgccgcagtcaacacccggagtatattccggacggtgttttcctctcaggattgtagcagcctgagctgcaactctacccagaggtttgccggcagcatcgataatgtaccatttcttttcgatttcattagctttagccatataagttgacatagtaatgaatacctcctaaatttataattaagttaataagtttacaaaataaatgacgtctccttaaagacgtcctctctaacttgcttagctattataatacggtttcataattttgtcaagacttttttgcaaaaaattaatttagctaaacacaaactctttattttagctattttctctctttatctcgtgtttgctcattcgctatttacgattttgtataatttatacaaacataataaaagctttatatttatactgctatattgttattaggaatgatgtatggtataataagtatgaaatgaatatccttttaggaggaacacattatgaaaaaaatggcttttatttttgctttaactatcgttttaacttttttatggagctatactacaaatgcagatactgcaggcaaagaagctccaatatttataaaagacggcattgaaaccgaatttagcgatataaaaccttttgttttagaacccggtataacgtatgtccctgcttcttgttgtaataagatttttaattccggtttttcatatgaaataacagatgaaactattaagcttatacaaaaaggcttagaatatgatacaactttaactgccggagttaaccgcaatacgatttttgtcaataacaaaaaaacaaagattgattatgagccattaactattgacggagaaatttatattcctttaaggtctatagccgaagctttgggatacaaagtatattataatgaaattatctattttgataaagcggcatctaagaatgttgctaaagactctattcagttaaattatattcttgcagatgtttatatatggaatgaagatcctaattcatctgtagatggtatacgatatgctgttactcaacataatgacagccaaacaaacataactgatatatataatagaaaaacttctaacaaagaagatatatttaatatattaaatattgaaaaaggttcattagttaatttatactctctttatcaaacagaaggctatagagtgccatgtggatattggggagaattaatgcagaatttacgtgaccaaaactataatccaatactaactgaaagatggattggtgatagttcttcttctgatatgataatcttagggataggtgaaaattcagatcctgctatctcatccatactcaaaagtatgggggaggataatcttcgccaaaataatggagaagtttaccgactatcatattttggcacctttagcggcaattatgttttaagaatcaacctcaattctgacggtacttcaaccgtaaaatatgtttataatttaactttgtcaaaaatggataatacaaatgaaatccaagaaaaaacattgactaaagaagaaactcagttagtaacgaaaaaattctctgaaactgatttttggaatatgccgctaaagattcaccgcagcggagctgatgggatggatataataattgaagcagtaaaagatggaaattatcatatggcataccgctggacgcctgtaagcggcagtttttttgaactttatgaacagcttgaaagtctccgtataaatctattcggcgaagagtaaaaaagattattaaacaaaaaaccactgctttttagcagtggtttaatattaaatttctggagctggtgatgggactcgaacccgcgacctgctgattacaaatcagctgctctaccaactgagctacaccagcacagctgccgttaaaatattttaacgcgtcaacgaatgatatattaccacagaatttactgcttgtcaacactttttttaaaattttttaaaaaatatatttttggcaagtgttgcatgagaatttttaatatagtataattttaaaatacaattatattctttacacttaggacaaaatttatgaatattatcaagatagaaaatttaaacaagtcatttataaaatccaaaagtccatttaaaaaaatttttggttctttatttggttctcaaaaatttaactctgcagaacttttttatgctctcaacgatataaatttttgtgtcaaacccggagaatgcgtcggagtcattggaaaaaacggctcgggcaaatccacactgctgaaaatcttatcaggaatttctggctatgacaatggatcatgcgaagtaaaaggttcagtttcctccctgctggagctcggcgttggattcaacccggaatatacaggcatagaaaacatatacttaaacggtactgttaatggtctcagtaaaaattttattacccgagacattgataaaattttgaattttgcggaaatctcacctgaatttgccagattgcctgttagaacttactcttccggaatgctggtgcgtttgggttttgcgtccatgatatggcttgatacagatattattttagttgatgaagccctggctgtcggtgattaccgttttcaaacaaaatgttttaaaaaatttgaggagcttaagaaaattggcaagacaattctttatgtttcgcacgatattgattcagtccgcagattctgcaccagagcaatttggttagataacggtaaaattattgcaaacggcgatgttgcaactgttacatcaaaatatattgaaagctgtgtaaatcccggcaataaagctcacggtcaaaaacagagactcaccggtgccttaaaccattacggcagccatattggagcaataaaaaacatttctataccaaaaaacggggagttttatctgcatgaaaacgttaggattacagtcgatgtatatatttccgatgatataagccttgatagtcttggagtgtctatagcgctaaaagacaaatttggtcttgatttgatagtttttcaaactgacgaaccgcttcattacggaaccaatcaaataaatttttgttttgaaaaccgccttaactcaggcaagtacacaatagcagcaggtcttgaaaacaagaacagtctccccatcacttattacgagtatattgaaggagcagcggagattaaatcaattgctcctccgcaaacttttggattaatatccgctccatgcaaaatttatgtgaggtgataatttgaaacgcagaaagaagcccacaatgactttgttaaacgccgccggcggaaaaattatcaatattcgtttatggattaaaaaacttatatgcgatcttaaaagctataagcgccgtaacatcaaaacgacgccgccgcggcttattgccgataacaaatacccactggatatatccgttattgtgtgcacatacaatcggcctgaaaaacttgccaatgctgtaaagtcactttgcggtcaaacccttccgtcggagaaatatgaaattattattgtaaacaacggcgaggaacttaacaatacctttgaagaatacaatgactgtgatataaaaataattaaagaagaacgaaaaggattgacttatgcaagaaatttgggtgcgacagtatccaacggaaaataccttgtctatattgatgacgacgctattgcagaaccgcgtctgcttgaaacaataaaaaatgcttttgacgcacacagcaatgccggaataatcggaggacaaataattcttaaaacaccggaacccaaaccaaatattatacttgagggaaaagaaactttatggagtgaatacaccgttccttacaccaaataccgtgagataaacaagcaatatgaatttccgttcggggctaacttttcagttagacacaatatatttaatgctgtcggcggttttgatgaaagctatgggcgtgtggggaacaactatgcaggaggagaggaaaccgttctatgctttaaagtattaaactgcggctgcaaaataggcatagagccaaaagcagttgtctatcatgacgttgataaaacccgttataccaaagaacacataaaagagaccataaaagccggaatctttaccacttaccgtctgtacaaagatggatacagcccggcggcttgggataaaaactatgcgttggaaagaataaaaatagcagaacgtgaaattgaaaaattaattaaaagcaacgctgacgagctggaattatactataaggaatgtgaaaaaaatggctttattgaattggctgactcgatttgcgaataagaataatgacatacatcatttaactttctccgagtataaaaacaaatttaataatatttataatatttctgtaagagaccttaaaaacttaggagaaactgggctggtctcaattgtgttacctgtgtataatggtgaaaaatacctaaaacatgcaataaattcagtaatatcacagagctataaaaaaatagaattaattattgtcgatgatggttcagatgataaaagcggcagtattgccgaagaatacgcaaaaaacaataacaatatatttgttatttctcataacgctaaccgactccttccgaccgcacttaattcgggttttaaaatggcaaaaggcgagtatttaacatggataagccatgacaatattttgcttccgaaattcatagaaaaaatggtacaggaacttgattattataaggacgccgctatggtttacggaaatatgaaattgattgataaaaatggaaacgtattaagagggaaaggctggtatgagtatccgcccatgagcggcaatgtaatacttccaaccggaacggataatctaaatataactgccaataatactattggcgcagcatttatgtacagagcatctgttgcggatttaatcggcgagtattcaaacgataggtttggtatagaagattatgactactggatgagaataaatgaaattttccccataaggcatactgagttctcagaacctctttatctttatcgatttcatgacgattcgctgacttccaaagacgaagagttgggaataacactgaaccggcctaagctcatggaatttgatgaactcagacgaaacttcctgcttcttcaaaatcaaaaggacgctttagatggaaaagaactgcttaaatcaaagattgataaacttaattcaataactttggacgagttaaaaaaacttttataactattttgaaaatatttgaaattaatttttttatttgtacatattttaatttaggtcataatattattgatacagaattgtcaaataatttttactgtattaaatataaatttctgtttaaaatctcaaattttttgttgattttggcaaaagttaaaaaaaagtttctccaaccacaagatatgacgttttttgctcatattaaataatattatttatcaatacgtacaaaaatgaaaagtatattttgtgcaactttctgagcatttaaaatagacaaaaatttctaattatgataaaataaacttgtataaaatatataataattctataagtattgttttaatatggagcagaataaatttttaggagaacacaattatgaatgattttgacatttacaaaaacggaaaaaagagggatgccggaacctatatagacgatgctccaatgtatttgtttaaccagggagtaaactatgaatcctaccgtatgctgggagcccacaggggcaagtcattttccggaaaagacggttatttgtttgctgtttgggcgcctcatgcaaaaagcgtatccgtagtttgtgacggaaacggatgggacagaaacaagggcagaatgtacaaacatatggattttgggatatgggaagtttttttggaaggaattgaaccgggacagtgctataaatatagtattgaaacattccgcggagatatatttcttaaatcagacccatacgcattctatagcgaagtcagaccggccaacgcatctatcacaactgaacttgactatgaatggaatgacaaaaaatggatagataaacggacaaaaacagagccttatgacaaacctataaacatttatgaaatgcacttttcatcatggaaaacgcacgaggacggaagctatttaacttataccgaaatggcggacgaacttattccgtatgtgaaaaagatgggctacacgcatattgaggttatgcctctctcagaatatccgtttgacgcatcatggggataccaggttacaggttattacagcgcaaacagccggtttggaagacctgaagaactcaaatactttatcgacaaatgccatcaaaatgatattggggtaataatggactgggttccggcacattttccgaaagacggctttgcccttgccaaatttgacggcgaatgcctgtttgaacatcctgacagcaggagaggcgaacataaagaatggggcaccttagtatttgactggacaaagacagaaatttggtcatttctaatttccaacgccttattttggctgcaggaattccatttcgacggcttgagagttgacgccgtatccagcatgttatatcttgattataaccgcaatgacggagagtggctgccaaacaaatacggcggaaaagagaatctagaagctatagaattccttcaaaaactgaatatggcagtatttgaacgcctgccgaacgttatgatgattgcagaagaatcaaccgcttggggaggagtaacatctccggtgaataaaggcggtctgggatttaactttaaatggaatatgggctggatgcacgatgttcttgactatatgcagtgcgacccatactttaggaaaggaaaccactataaacttacatttccgatgatgtacgcttttgctgaaaattatattcttgcactttcacacgatgaggttgttcatggaaagcgcagtctgattgacaagatgtggggaacatatgaagaaaaattcagcgaactgagactattatacgcctatatgtattctcaccccgggaaaaaattattgtttatgggcggtgaatttggtcagtttatagagtggcgttttgccgaacagcttgactgggggcttgaagaatatgataaccataaaaagatgtgggaatattccgcagctttaggacatttttatcaggaacatcctgccttctttgaaattgaacgcgagctttcaggcggcgaatgggaaggttttaagtggcttaaagctcaagattgcgaaaacagcgttctcgcttatctgagactttccaaagacaagaaagacgagatattggtcgctataaactttactcctatagaccatgctatttacactataggagtacctgaaaacggtgattacaaagttgtattaaacagtaatgacaaaaagtttggtggggatggaagcggcaataaaacatatcatgctaaaaaaataccatgcgacgagtttgattattcaatagatataaccttgccggcgcttacggcactttatatacaaaagctgcctccgaccaaaaaggttaagaaagaaaaagttgtaggcttagttaaaaaacagacgagcgaaataaaaacaatagaaaataaaaccaaagcgcttgcagaaacagaaaagtccgaaaaataaatctatatttatttttggaagtaaagcgaacgttaattgtaaaataggaggagataaaatgaggttaaaagaatgtgttgctatgattcttgccggcggacagggaagccggctcggaatactcactcaaaatgtagcaaaacccgcagtaccatttggcggtaaatatagaattattgattttccgctcagtaactgttctcattcgggtattgacacagtgggagttctgacgcagtatcagccccttgagctgaacacatatattgcaaatggacagccttgggatttggaccgtactaacggaggtgtttttgttcttcctccatacacatccgcagaaaagggcgaatggtataaaggaacagcaaacgcaatatatcaaaatttagggtttatggaacagtttaatcctaaatatgttattattttgtcgggtgaccatatctataaaatggattataataaaatgctgtcggtgcacaaaaaggcaaatgctgacgcaaccatagcagttattgaagttccatgggatgaagctcccagatttggtatcatgaacacaagcgacgatatgcagatagttgaatttgaggaaaaaccaaaagagcctaaaagcaatttggcttctatgggagtttattgtttctcttgggatgttcttaagaaatatttaacagaggatgaaaacgaccccgaatcagaaaacgattttggaaaaaatattattcctgctatgcttaatgacggactaaagcttatggctcacagatttgacggatactggaaagacgttggaaccatacagagcctatgggaagctaatatggaacttttagatgaccagccgggttgtgatttggatgatgatacatggaaaatattcagcagaaatcctgtaaagccccctcaatatgtgggcgaaaacggttctcttaagaatagctatactacggagggctgtgaaatttacggccgggttgaacattccattttgtttgaaggcgtaactatcggagacggggctgttattaaagactctattatccttccgggcgcggctgttaaaccgggcgctgttgtgaataaatcaattattggttcagacgccgtaataggtgaagaagccacaataggaagcactgccgataacgcaaacaaatcattttataatactaaaatatgcagcgatgacattacattgataggaccaggcatagagataggagacaagattgaaatcggcgtatgctcaatggttacagaaaatgtataatccgtgcatgaagaaaagtagaaatagaaatttagtagaggtgatatagatgaaaaacgatatgctgggcgttatattttctgaaaacccggaagccagtatgggcgaactcacaagtcttagagctcttgccgctgttccggttggagggagatacagaattatagatttcatattatcaaatatggtaaattcgggaataataaaagtggggattacaactcctgttaattatcagtcgcttaccgaccatttaggcaccggaaaagcgtgggatatggacagaaaggacgacggtctctacatactgccgccgaaagacaccggtgagtcaggtattgaaacacacggcggtgtggatatattacatggtatttcttcatttttagctaaaagcaaccaggaatatattcttgtttcagattgtaatacaatctgtaatatagactttgacatggttcttgaagaacatttaaaaaatgaagctgattttacactggtttatacaaaagctaaacatttgagcgctaaagatgtaaaaaaacatattttgctcgatatcaatgatgaaaaaattgttactgacatgcacgtttatccaagcaaacaaaagacagactgttcatatatgcatatgtttataaccagacgcgaattgcttatggatatggtagaatatgcagtcacacacggaagacatacaatttccaaagacatattgcttacggctgtttccaaaggtttaaaagtttctacatatgagttcagcggctataaaaagaagattgacagtatacaatcctattactgttttaatctagaccttcttaaaaaggatatacgagatgaattgtttggtctaaacacaaacaatcctatctttacaaaaataaaagacaccgttccaactaaatattctaaatccgcagaaataacgaactcatttatagcggatggatgtaagatagaaggaacggttaagaacagtattttgttccgcggtgttcacgtcgcaaaaggcgccactgttgaaaactgcattcttatgcagaactctgagataatggaaaactgtctcctggaaaacgtcatatttgacaagggtgtaatcctgagaagcggtaagaaacttgtgggtcaagatacatatccaatggtaatcggtaaagaaattatagtgtaattattaactcactttttttataaacggttaatgttactgaagaaaagcttagtgaaaggatgtgttttcaaatgagtaaaatatttatggtttcatcagaagtttccccgtttgcaaagacaggcggcttaggagatgttgttggttccctgccgtcagcactcggaaagctgggagatgatatcagggttgtaatgcccaaatacggctgtattcctcatgaatatctggaacaaatggagtttaagttttttatatatataccgctcggatggagaagaaaatactgcggagtatttgagcttgaaaaagacggcgttatatattactttatcgacaacgaatattatttcggcgacccttatctatacaagtggaacgacctcgaaagatttgcattttttgacaaagcagcgctggaaatattaaaacatcttgactggaaacctgatataatacattgccatgactggcagaccggtatggtgcctgttctgcttaacgcatattataataaagacacgttttatcagggaataaaaactgtatttactattcataacctgcgctatcagggaatttactctattgacatcgtttcggatttcttctcacttaaccgtgacttttttacagctgacaaattggaatttcatggctgtgcgaatttactaaaaggcggtatagtttattccgactatatcactactgtaagtccgacatatgcgtcagaaatacaaaccccgatgggcggcgaaaagcttgacggattattatctgcaagatcacagtctttgtatggtattttaaacggtatagattacaatgtttataatcctaaaacggacaaatatatatttgagaattatgatgcaagaaacgttgtaaataaaaaaagagaaaacaagatgaagctgcagcaacagcttggattgaccgtagacggcgaaaaagtaatgattggtatcatatcaaggcttgttgaccaaaaaggttttgatataatagcagaagcaatgggcgagctaatgaatatggatattcagctggttgttgtcggaaccggagaagcaaagtatgaaaatctgtttagacataatgcgtggtgcaattcacaaaaaatgtctgctaatataatgttcagcaatgagctggcacacaaagtatatgcttcatgcgatatattcctaatgccgtcaatgtttgagccttgcggtctcagtcaaatgatttcacttgcatacggaaccattcccgtagttcgtgaaaccgggggattgaaggattcaattatgccgtataatgaattcaccggagagggaaacggatttagtttctatccgtatacttctcatgatatgatgtatacattaagatatgccattaaaattttcagtgataaaaaagcctggaccgatttaattaaaaatgctatgagacaggatttttcatggaacgaatcggcaaagaaatatcaggatatgtataataggctgctaggttaatttttgatttaaaatctattttaagcccgtaagaatcaatttattcttacgggcttagtattatataaaaatataatataaaatttattataataatgttttaatatattagtctaaattattaaaaattataaatttatttttttctaattgttttttgaaaataataaaatataattattaatatgtttaataattaaacagctaccttacattaaataaaatttcttttattgtatataacctttatattaacatatttttataactttatctaaattaattctgctatccatgactgcgcacctaacgaggcgtctgccgccgccctgccgatgtttgctgaaaattatcttatttttttatagttctcaattttaattatatcattttttctttttactcctatccatttaaaatggagctagtaattttcactagaaaacagtctcatatatttattatttattgattatgattttacctaaataattctgttatccatgactgcgcacctaacgaggcgtctgccgccgccctaccgatgtttgctgaaaattatcttattttttatagttctcagttttaattatatcattttttttttaagcaatatagtgagcgaagctggagagaatccaacggtatactatatgggaataaacctgatagcgcagaaagataatgcgggaataagttattatcagtataatgcacacggagacataacaggtttagaaaacacaaaaacaaagatgctgacgagatacgagtatgacgcgtttggaggctcaaaggaaataacgggaacagtatacggatataacggccagtatacagacaaagagacaggattgatatacttaaggaaccgttactatgacccggaaacaggaagattcacacaagaagacccggtaatggacggacagaactggtacgcatactgtggtaataatccagtaaactttgttgacccaagcgggctggtaaatgttgaggatgaagatcctatacaggattattgttcaaatcaaggtcaagttgttggacaggaaagaataaatattaatagcgcaattcatgcttatcaagatggagttttgtcctatgaggatatgttaaaaaatgttgtactcaatggtggaactataaaggaagaaaagaaacttgatgctatccaagttgaagaaacaaaaaatggttttacagtaactgcgtatgtaagatattctgggaatttaagtaatgtaagttatgaaggtaaaacatattcagaatatgcaactgaaggaatcgaaaattattggagtggcactatagatggtattactgtaactactaaggtggttacaacagatgatggaatacataaaaggaaagatatgaaaattgagaatggcagttataaggattcaagtacaagtcaaggtacaaataacatttttcctaatggagtatcaaaggtactttggcaaaacaatagcgaaaatataaatcctaatactgatctatttaaaatagtagcggctcacgagtttggacatttattttttaatattaatgataattgtagagatgcaagacactatcaagttccagtgagtaaatctattcatgcgtactcggtaatgacgcgaactaacatgataggtctatcatcatcaacattagatttagcgtttatgataaaaaattataaaataagtaatttttcgcaaggaattttttattcagattatactaatattttagacagatattctccaggttggtattataaaagattttatgaagattaaaattgtattagaaaggaagatgaatttataaatgaaaaatttacttaaaaaaatattgttattgatagttgttatatgttcatttttttgtagtaacgtgtttgcaagtgaacgggttataagaaatatgacaattgaggatattgcggaaaaaaatttggagttaaattggaaaaatgtcattccaaaagaacagttaagtcctggaatgtatttttgttcaggtgtatataactttggaactacatttcactattacgatatgtcgaatgatatatcaaatgaattatttgtagataataatggtaatataacattaaatccaataatttttcagggtggtattgcaattataaaaacgacagataaaaatttagacgagcataaaacaaactataaatatggatgtataaatagtaaatatgaatggataattccacctatatatgagagaatagtgtattgcgataacggttttattatggctgagagaaacaaaagaatatatatatttaatatttacggagaagtacaaatttcttttagacaagatgaattttatgcagagttttctactggtgatgttattttaaaattaagtaatctaaagactaagagtcaatatttgttggataatagttttaatattataaataagtatgacttaaattcaaaagaagaaaaggaagtaagtcaaggaggttatatcacttttgataatagaattaaaaataatatatattatagagctgatgaaaaaaataacgatataataataaatgggtataattcaaaaggtgaattactaaacgcactaaatttaagtgataaaattggtaaaaaatttaatatttttacaagtcaaatattaaataatggagatctaattttatgtttaaatgttgaaaatgatacacattgcattgtactattttctgcattaacaagtgattgttatacatcttattattttaaagatggatttccatttgaacaagtatatagtttttataatatgttagtatttgataatggaattgttatggataataacttagaatatgtgggtcatttatataacaatgataattatgaagttaaaatttttgtaaataaaggaaaattaatatgtagtttactaaaatatgcagattcatcagatagtatattcagtaaaggtctttaccagttaagtaatgtatacatagtttataataataaaaaagatttgagtaatgatgatatgcttgtagacaaaaatagaataagtaaatatgttgaacctaaagatgtttatggtgaaataaatatatacttaaataataaaagattaaattttgatatagagccgataacagaaggtgacagaacattagtgccaatgagggcaatatttgaagcattgggagcagaagtagaatgggaaaatgaaacccaaacggcaacagcaacaaagaatggaataacagtatcagtgacaattgacagcaataagatgcaaaaaaatggagaagaaatagaattggatgtgattttgctgaccctatggcaagatataaagagataacagagcaaacaacaaaatcgaatcctgaaacaatgggcagatttcatacaaattggctcaatatgatgtatcccagattgaggttagcagcaaatttgcttagagatgacggcgttatctttattagtattgatgataatgaagtgtttaatcttaaaaaggtttgtgatgaagtatttggagaggaaaattgttgtggtattgtttcgcgtttaatgaaaagtggcggagcaaaaggacgatttttttcacctaatattgagtatatcttagtttatgcaaaaaatatgacaaaaataggttgttttagagagtctatttcagatgaaataattaaaaaattgtatacatcggttgaagaatgtggagagcgaaaaggtgaaaaatatcgtccctttggtctatatcaatcttctttagatgcaagacctaatcagcggtattatatagaatgtccagatggaacattagtaattccgccgggcgaaactatgccagcaatccacaaagacggtgagatggttataccaaaaaaaacagatggttgttggcggtggagtagagaacgatatattgaagaaaagctaaagggaaatattgcttataaaaaatcaaaaggtgtgttgcttaattcggatggacaaccggcagaatggaacatatatacaaagatttggttaaatgaccgtcaagaggaaggaatggttcctgttgatttaattacaaagtgggaaaatagacaaagtaaaaaagaattacaacagttggggataccttttgaatttgcaaaacctgttgacttaattaattatcttataagtattgttgggaatacaaaagacagtattattcttgactttttctcaggttcggcaacaaccgcacatgctgttatgcagttaaatgcagaggacggaggaaacagaagatttatatgtgtgcaattgccggaactttgtgatgaaaaatcagaggcgtataaagcaggttataagaacatctgtgaaataggcaaagaacgtattcgacgtgccggaaagaaaatcattgaagaaaaaggcggtcagattggaatagacgacgaagaaaagaagccgcttgatataggttttaaggtattcaaacttgatacctcaaatcttagaatatgggataatacgccgattacgggtgataatcagatagagatgtttacagagcgtatgaactctatgatagacagtatcaaagacgacagaaccgatatggatgttgtctatgaggttatgctgaaaatgggagttccgcttgatattcctgttcaatacatagaagttaacggaaaagtagtttatattgtgggcgatttccttttaatgattgcactatttgataatataacagcagaagatattgaggcaatagctgaatatgctccggcaaaaatcatttgtgccgaacacggatttgcagatgattccgcgctgtcgaatgcacattatattttaaaggatagacaaattgaattgaaactgatatgatgtacatgggttccgtaggggcggattccatatccgcccgaataatcaaaaacacatttatacaaacaattgacatgtatgaatatatattgtccgatttttgttgtaatgcaaaaccatttccgttgtataattgcaatccaaagggatgtggaaacccgggcggatatggaatctacgggcggatatggaatccgcccctacggaaccatatatattttgtgggttgattatattgaaaaattttaacggttcaaataatgaattgttataatcttaaggtgataaatgatgaaactaaaatttaaaaatcaagactttcagacggacgctgtaaatgctgttgcaggtttatttcaggggcaggaaaaactacagtctactttcgaaattgttcaggatgcgcagatagggttatttcagaatgatttgggtattggtaatgctataaatatatccgatgagcagttgtctcaaaatatgcaggaagttcagcgacggaacaatcttcctacaacggagataactgacgatatgcgttctttctgtattgaaatggaaacaggaacaggtaaaacctacgtatacactaaaacaatttttgagctgcacaagcgttacggctttacaaagtttattatcgtcgtgccgtcagttgcaatccgtgaaggtgtatataaatcatttgaaataacaaaagaacattttatgaatcaatacgacaatgtgccgtgcagatattttatatacaactctgcaaagctgtccgatgtaaagcagtttgcaacaagcagcaatattgaaattatgataataaatatagatgcttttaaaaagagccaaaatattataaatcaggcacaggataaactgaacggcgaaacagctatgcggtacattcaagacacaaatcctattgttataattgatgagccgcagagcgttgacaacacgccaaaggcaaaagaagctattgcttcacttaatcccatgtgtgtatttagatattctgcaacacacagagataagatgaatttgctttatcgattaacccctgttgatgcttatcaaatggggcttgtaaagcagatttgcgtatcttcaaacacggtggcaaatgattttaataagccgtatataaagctggtgtctgtatcaaatgataacggcttcaaggcaaagcttgagcttgatatacagaataaagccggtgctgtttcaagaaaaacagtaacggtaaagccgaataatgatttgttcctcatatccggaggcagagatttatatgaggggtattctgttgccggaatagattgtacgcccggaaaggaaagcatcgaattttcaaatgcggaatatgtcgcgcttggtaaggctatcggaagtgttgacgagaatataattaaggaagcacaaatcagacgaacaatacaggctcatttagacaaggaattgcgatataccgaaaaaggaattaaggtgctgtcgctgttctttatcgacgaggttaaaaagtacagaacagcagacggcgaacagggaatttatgctgaaatgtttgagcgctgttatgaggagcttatcaataatccgaaatatgctccattgaaaagtcaatttccagcaagcgtggaaaatgtccatgacggatatttttcacaggataagaaaggaaccttgaaaaatacaaagggtgatacactggcggactatgatacatataacaccattatgaaggataaggaatggcttttatctttcgattgtcctctccgctttatattctctcattctgcactcaaagaggggtgggataacccgaatgtatttcaggtatgtaccttgattgaccagaaatcaacctttacttgccgtcagaaaatcggcagaggtctcagactttgtgtaaatcaggacggagagcgcattgaggataaaaacatcaatatccttcatgttatggccaacgagagttttgcggagttcgcagaaacacttcaaaaagaaattgaaacagaaacaggcgttaagtttggaacgcttcagataagtttattcagcggcatgaaatataccgagacaaatacggttgagcgtactatcacgcaggagcaggcgcaaaagacaattgaagccttaaaacagtcaggcgccatatccgaaagcggaaaggttgagaagaagcttgaagaaataaaagaaattgaaatcccgcaggagcttgagcctgccaagagtgagattattaaggtgattgaaactgccggagaagtcgacacagaaactcttaccgggacaacttacaccgaaacgataattgaagaaaaagaagtctcctatgacgatgcgaaggagcttatacagcattttgagaataagggctatgtttcaaaatccggaaagatgaaggacactatgaaaaatgcgcttttaacaggtacgcttgatttgcctaaaaagtttgaagccgccagagaacgattagaaagtgttgttaaaaaggcagacagtaaattgccgattcgggatgcttcaaaagaggttattgtacatctaaaaaaacaggcgatgttgtcccctgaatttttggaattatgggataaaatcaagcagaaaacagcgtatcgtgtacagatagatactgaaaaacttgtagaaaacagcgttaaagatttaaaaaatatgccgcctataccaaaggcacggcttgtatctcaaacagcagaaataagtattcggaatcccggtgttacatatatcgaaagggaagtgagaaccgccgatatagcagatacatattcaagccttccttatatagtcggtattattagtgaagaaacacttattaaaaaggctacagttgtaagaattataaatgaaagcggcagagcgcaggactttctgaacaatcctcagacatttatggaaaaatgtcttgaaatcatcaggcacaacagacattctttggcaattgacggaataaagtatgtgaagcttgacggtcagcaatactatgcacaggaaatattcgattcagaagagcttgtggctaatcttgataaaaatgctgttgcggtaaataggagcgtatatgaccatattatatatgacagctcaacaattgagaagccatttgctaaggctcttgacgatgatccggatgtaaagatgttctttaagataccaaatcgttttaagattgaaacgccgattggaacctataatcccgattgggcagtatatttagagcgagacggagaaaagaaactgttctttgttttggaaacgaaaggaacgactgaattattcggacttcgaacgccggaacaacttaaaatccattgtggaacagagcattttaaggcgcttgaaaatgatgtcgaaatgagagtggcaaaggactggaaggaatttaaggttcagaattaaaataataatcgaaagattaactattattatacagaataaagtcaaatatttatgagaagtataaaaacatattgtttccggattttgaaatatacaattaaacgttggtctgatacgtttgatttgatataaacaatgatgcttatggttttacaaatttataatagatagaaaagcctgtcggtttagaaatcgacaggtttttttgttgcagtagtttatgggaagcttttggagattataggggaaatatttttattataataaaatcgttagatagaaggtgttgttaagccatcctgtctgccggaatgggcaaaaaacaaactggagcttgaacataaaactaaaacaaagaaaaaatcacataaggaaattgaaagataggagatacctatgttttttttaagaattaaaattgaggttacaaagggcttgtataatgtcatacttgcggaaataaatcagtatatagaaataacggacggtgaggataagacggaggctgatatattctatagtgaacaaaaatgaagatacattgggaatggtaaaccgactttgcagaagtgtatattgtatggacgggtgtgttgaagagatatttgtaagagcgctgagagcaggaaaaataaagtattaagcatggcttgtgagcagctgaaatgctaagaaaaggtgtgaaaaaagtataagcaaataaaaatatatttaaacttaaagaacatattttaaataaaaactattattgttgtctatattaaataatataagattactgcataaggagaaaaaatatggaagatataattaaaaacatttcaagggcagaggtagtaaagctaaaggatgagatatccagtcataaaggacaggtggttagtaagactttagcacagaatgaggcagtgagtgttacattatttgcattttcagacggagaggaaataagcacacatgaatcgggcggggatgcttttgtaacctgtttggaaggagtagggaaaataactattgacggtgttgattatgaaattagcgagggtgaatcaatagtaatgcctgcccgacatccacatgccgtatatgggattgaaaattttaaaatgtttttagtcgttatattttaatatgaggaataatgaatttgcagagtattgaattaaatcaatactctgtttttatatatgggaggtgaaacaaatggcgaataaagtaaagtacatatcggagctgtcaaagtcaacatcaaatgagctgtccggttatgaaagctggacagcttttttacgcagtgcagcatggtagtataaatatccgtttgaggaccagcttctgatttatgcacagcgtcctgatgcaaaagcatgtgcaagtatggaaatatggaataggaatcttcatagatggataaataaaggcgcaaagggtatagcgctgcttagggaaaacggaaaccgctatcatcttgattatgtgtttgatgtagcagatacaaatagctcatataaccgtgaggttagtttgtggcagtatgatgagcgttacgaaaatgctgtaatagaaacgctcagcaattcctttggggatttaaaagttgatgtcacagtacgggatgcggttatttgcgcagtacataatgcggtacaggataatgaggctgattatcttaatgaattaaaatatgcaaaagaaaacagctttctggaaggtttggatgatgtgaatcttaaccttagatttagacagacagcggagacctcagctgcatatatgattatgcagcgaatgaatcttcgtgacatgtttgatgaatatgaatttcaatatatcagggattttaatacgccagagaccatatcaatcttaggtaatatggtaagcgcaatttctgaggaagcgttaagagatatttcccaaacgatacgcgcagagcaaaaacgggaaagaaatcagccggaattttttgcggaaaataaaaacagggtatataatatagacagagaaacagataataatgaaaggaatgaggaaaatgacagaagaaataatctacagccggaacggagattatcagataccgaacttaacggtaccgcaggaggaatatcagataggcaaatacggaatgatgaggaaaacgtatctgaagcagtaccgcagaagcctgtactcgtcgttgatgataaaaggcgagctgttgagccatttagcggagatagacaggacagcgacagaacagatacagcagatagtaccgaaaatggtagaagcggagggagtaaccgaagcaatgaaagtcaaatacccaatgatgtagacagggttaatgaacaactttctgcattctgcggaagaaacagtactgtcggagctggtatacagctaagtcttgacgatatatttccaaacctagagcggcagcagaatattgtaaggcaagcggagcaggcggtaaacggctccgctttttctatgcccgaacagattatagacgaagtcttgacttcaggaggaaatcatcgtgacagtatacttgaaattgctgtacagtacagtaaaaacaaatcaaacaatattgaatttttaaaagagcattacagcacaggcggcaaagggtttattttcaataacagaaaggtatctgcttggtggaacccggacggaatgcgtatatcatacggtgatactgcaatcgggaaaggtcagcttttatcatgggagcagatagatagaagaatatccgagctgctcgaactcggcagatttgcaccgcaggaaacacttgataaaatcaatcaatatgaacgcagcaaagcggcaagcgcattttggtatatggagcgtggaaaatacatcggtttagcaggtccatctctgcgttagagacatattctgtaataattttagttttccattttaattttgaataacttgtagactctatattcaaatcattttatttaatttgttcaataaaattcttttgcttaatatttttctccttttctttattttgtaatattagctcctactaaattatcgattccagaaggatgtttatgaacttttataatttcattcccatttttttgaattcttttttggaattatattatatatgctattgacataattctgtaaaagaattataatcgatttattgatagaaaaaaatataatagaacagagggaggattttaatatgaaaaaaatgtttttgtgtttaagcatcataggtatgatgcttattggaatatgcggtggtacgcttaaagcaaatgcagctttaaatgaaagaaaaactgtttatgtcaattcagtagaggagtttaatactgcacttgcgtctgatacagaaattattctatctgccggaaaatacaattttgggcagagaccggttgaaattataggacttagcaatatagaaattagaggaaccgatatgacacaagtggtggttgaaacaggagatgagtgtatattttatgtagaaagctctgataacatctgttttgataatttgacaattggccatgagcttcaagattaccaaaattcattttgtcctgcagctgtgatatctatatttgattcttatgatattagcatagaaatgtgtgatatatacggatgcggcaataaaggctttgttgcttcacaatctcagaatttatctgtatttgcgacaactatcagagattgttctaagagcatagcacaacttaatgaaagtgatgtatgctttttagcatgtacattttcaggaaacggttactatcaatatccaagcaattatgcatttgatacaatgacttataccaaagataaaagtgtagatattatttgcagatattgtaatttcactgacaataaaaatcctgaattaattgatttaactgaaaaatatcacactgtcaacgctttgttcgaagactgtagatataataataatagtttttcagactttaataattatgaatcagatcctaaccttattattaatagttatcatatgaaaaatggcatgattacaattaattatttcagttttaatttcacttccgaagaaatagttgtgcctgacgatttcgcgggctatcccattatagctatagccgactatgcgtgttccagcgattatgttaaaaaaataaccttgcccgaagggttaaaaaaagtagggaataatgcatttgctgaatgcggcagcttagaatatatatatatgccaagcagcgtcacatttatcggggaaaatgcactgccttctaatagtaatatttcaatttatggagaagaaggaagctatgcacagacatatgcagaggaaaatggttttttatttaataaaaattcacatgatgtatcgaatattttcacatacataattgaaaatggcaaaataacaatagctacttgtaaaaaggatgcaagaggtactattattattccttctgaaattgaaggttatccagttacagctattgcggaaagtgcgtttgatagctgtacaaacttaaaggaaattgaaatcgcagacagtgttgaaagcattgatgatgaggcatttcacaattgccaaagcttagcttcaatacatttacctaaaagcttaaaaagtattggaaatgtaaaaattccgtgctatgttttttcgggttgtacttcattgaaggaatttaccatagatgaggactgtgaatatttttcagtaaaggacggcattttatataataaaaatataaccggaattgtatccataccgcctgggaaagaagagctttgtattccggcatctgtagaggaacatttgaccggtgattttgatagcgtatataaccaacacattacatatcctattcaagaagcggtgtcattaaaaaaaattgatgtagatgagagtaatctaaacctagcgtctgacagcatcgctctttacagcaaggatatgtcaactattatcgcttatcctcgcggaagaaagggctcatacaaaataagtgatgcgacaacaacaattggtggcgcgacatttacacattctaaaaacataacagagctttttgttcctcaaacagtaacagaagcaaaaataggctatggtcattattttggattggtatcttgccccaatattaacatttgtggatacaccggatcttttatagaaactgtggcgcaaaaagaaaaaattccctttaccccggttcagacaatggcagaaataataggaattaaaaagacagaaaaaggatataaggtagatctaaaaattgatcatgatacttctcaggatttacaaaattgcagggttctgtcagcagcatacatggatgaagaaaataaggaaataataggattttcaagtaaaggctttcaatttaataatggtgaaacttctttagatactattgaggttgcagcaaacgaaaaagtaattaagaaaatcaggatttacttttgggatagtatagattcaatgaaagcatattcagcgccatatgaagtttatatagaagaatagaataaatccataaaaaaaccgaatcaaagcttaactcaatcttttttcaaaaacttgcaaactcattttcaaacattttataaaataaaacaggagttaccgacagaagcgctgatactgaatacgtaaacaagaacatgcctgcgatgaataagtttacggatataaaagataagagctactgggcattttatgatattattgaagcaagtaacacgcatatggctgttaaaaactccgacaatgaaacttgggtgaagtaaatttcactaaatattgcatagggcagtttgaatttataattgccctattgctgtatttgtagtataatatatctaacaacaaaatctaagtttatgtgaaagtaggttaaggattaaaatgactaatacagatgaagcagtgaaatatttgtcataatattcattggaggatgttctatctggaataatcgaaatgcagatgttgttatatggtgatggtgtggattcgttgatacctgcatctgaatattttgcaactaatgcgttatttgcatgtaaaaagagtggaaataagccgtttcaatgggaagattatctggaattagaaaaccattgtaaacagctttttattccaattattgaagaattgttgatgaaatactggattttttagatgcagcagatgaagaaaaagagtcgtttttacagtctctaaacatgaaactcaaaaataagatatttcgtggtgatggatatattcatcaacttattagttttgcagaaagcttgtattctaaattagattcggaaataaaagccgaattgggtttttcttttacctcgtgtaaaaaaatgatcttatatattttcaatacatacggagccagaagcgtaaaagcgtgcttggaagactataaaaatgaaaatatgatggaagtagttaatggaaatagtaaactgcaattatcaagtataaaagagggatatattttcagaataaataaaagtgacttgcgaaaagttattaattcaaaagaagtagattgtatttgtgattattttagcgttaaagccttttcgggagattacaaaaaggtggatttagaaggatttaaaatattggtatcaaagccgtttgttgattttggagattatatatacatgccgctgttattttcgacattactaaatttgccaaagctctttcattatacttttatagcagaaaaattttttgataaaaaagtggtaggaatatatactaaaaatagaggtgatgttatagaagatttaacacaactgtattttgaacgattagttaataaagaatatatatttaaatctctgaagtatacagatggtgaggctgatgtgactgtatgtatgccggaaggaactcttttttgtgagtgcaaaagtaaactgttgacgcttaattcattaaatggagtaaatgacaatattaaagaggatgtgtataaagcaattggtgcggcgtatatccaaagcgttcgttcaataaaacgggtactaagtggaaaatcatttataaaatatgctaatggaacagagcagaatgtatatattgaggatacagaagtaaaatatgttatttgtgtgactgctgaacattttggaattatcccttcggaaattacagaatatgttgagattgataaagatgtcaatataataccatatgttgtaaatatttatgatttggatattattacacaggagtgtgattcgtatgaagaatttctagggtatcttaattttaggcaaataaatcataaacttatttcagctgtagatgaattggttgtgtttggtttatataaaaaatacggtaatagaaaaatggatattaaagatgatagtctgtatataacagattacacgcaacagttcgatgaaaagtatgccaaaaaagataaggagtgtttacaaaattttataattaattaaaatataaagtttagtttattagattatataaattatcatgagggcaatccgaaaaaaggactgctcttttttcatgccgcaaaaggaggagataacaataaaaaacagagatgattgggggaatagcagttgaacagacaggagaatacaaaaaccataataatattgcttgcggctcttttcccggtagtaatatggcttgcgttaatagcggcgggctgctatgagccggaactaaaactgtttgatttgattcaaaagtttacacaagcattaaacagaccgacagaaatacatataaacgagtatagcttaaaaactgtactcgtttttgtatttctctacgctatgggtataggcgcatatttttcaaaccgtgagaaccgtcgtcccggagaggagcacggctctgcaaaatggggcaatgtttcaagtattgtaagaaagtataaggataaatccgatagatttcaaaacctcatattatctcaaaatatgagactgggacttaacgcaaaaaagcaccggcgtaatcttaacgttcttgttgtaggcggctccggagccggcaaaacccgattttatgcaaagccgaatataatgcagtgcaacacatcatatataattgctgacccaaagggggaaatgctccgtgccgcggcaccgcttctgctggagaatggatatgatgttaaggtgtttaacttaattaacccggaggattcagacggatacaacccttttacatatatccgtacagatgaggatgttataaaactggtaagcaatttgatacagaatacaacaccgaagaacgcacagcagaacgatccgttttgggagaaatctgagattgcgcttgatacagcgttaatgctgtatttactgcatgaagctccgccgtatgagcagaactttgaaatgctgatgttcttaattgagaatacggcagtaaacgaggacgatgaggaacagtatcaatcgcccgtagatatgctgtttgatggattggaggaagaaaatccggagcatatagcattaaagcaatataaaatatttaaacaggcgtcgggcaaaactgcaaagtctattcttatttcggcagcggtaagacttgccgcttttaatttacctgacattgcaaggatgacttcatatgacaatcttgatttgggcagtctgggagagaaaaagtgggctatattctgtgttattcctgataatgataactcctttaactatcttgtcggaatgttatacacgcaagcttttcaagagctgtactatcgtgcagaccacgaatacggtggtgagctgccaatacctgttcatgtaatgatggatgaatttgcgaatgttgcattgcctgataattttgagaggatacttgcaaccatgcgctcaagacgtatttcagtaagtataataattcaaaatatggcgcagctaaaggctttgtttaaggactcatacgaaagtttggtaggcaattgtgatacgtttatatacttgggaggcaacgaacagggaactcatgagtacatatcaaaaatgctcggtaaggaaaccattgacacacgaacaagaggaattacaaagggacagcatggctcaagcaatacaaattatcagaacacagggcgggagctgttaacgcttgacgaggtacgtcttttggataacagtaatgaacttatatttattcgaggtgaaaagcctattatggacaagaagtttgatgtaatgtcacatccgaatattaagctgacagaagacggcggcgcggagccgtataagcatagtaaaaataataagcgctttaagagcgatattagctttactgaccctaaaacaattaaaattatagaatttaagacggaggaaaatataaatgaaaaaaatagagaagatagaaaagataaaaaacgtaataagaataattaaatactcattggtgctgtcattgtgtatgctgctgacaatggcgtctccggcttttgccgacgaccctcttgcagcaatcaacggattatctgattttatattcagtgcaataaaagcaataggctttattttgcttggctttggtgtagttcaaattggtttgtctttaaaatcgcatgacgcttcacagcgtgccaatggatttctaacattcttcggcggtgtggttattgcgttcgccaaagatatacttgatatgatattataaaaacttattgacaacaccctattggatagggtataataataacaaagcaaggtgataatatgagaagaaaatttgttatgatgcctatttttgataagcagtggaaagctatgggattaactgatgatgatttaaggttgcttcaagaagagctgctgaaaaatcctaagtcaggagctgtaatgcaaggcacaggagggctcagaaaactaagatttgcatttccgggtcgtggtaaaagcggcagttgccgtgtactttatattgattttgttattgacgagtcaatatattttatttttgcatatcttaagagtgagatggataatttatcaagggaagaacgaaataatattaagaagttaattgagcaaatagagagagggctgtaaggaggtgctgataatgagtgtttacgagggaataatgaatggattgcaagaagcaattgattataacaagggaaagatagaagcccgcagtaatgtattgtcaattgatccggttcctaagtttgaagctgatgatataaaaagcatacgtacagggctcggcatgacacaatatatttttgcaggagctatgggagtatcacaaaagactgttgaggcttgggaagccggcagaaatgttccgaatggtccggcgagtagaatgttgtcaatgttaaaatctgatcctgatttacttgaaaaatatcatattgtcacaaaatagataaacaaatgttaatggtgaagagcaatcaatctttaagaggatagattgctctttttgtttgcagtatagtaaaattagtgttatcggaggtgaatcaaatttgagtgataactggatagtagcaaaccttgagaacgcattttcgatttggaatgataaaatgacggagatatgggatttaataaccatgtctcctcagcagtttaaaggcggagctatatagaatataattacgaacataaacggaggcttgcaagcaatcggatacggacttctaatactattttttgcaatgagcatctttaaaagcacggcaagtttcagggactttcagagacctgaatatgcattgaagcacttcatacgttttgtcgcggcaaaagtggcaattacatatgcacttgatttaatgacagttatatatacaatatgcggcggagtggttgagcatatagccggaagccttggaggtatcagcggagcagctgtaacacttccatcggcaattgaaacggctgttgagaacgcaggcttctgggcaagcataccgctgtggcttgttacaatactgggcagtctgtttataatggtcatgtcatttattatgatattgacggtatacggcagattctttaaattgtttatgtacacggctttagctccggtcccgctgtcgtcgttcggcggcgaaggaacaagtcagatgggtaaagcgtttttaaaatcctatattggggtatgtcttgagggcgctgtaattgtgcttgcctgcataatattttcagcatttgcaagtgcgagtacgcctaatatagacacaagtattacaacggtaacaatgatatggaaatatatcggagaggtcatatttaacatgcttgtattagtaggacttgtcaaaggcgctgaccgcatcgtaaaagaaatgcttggtgtgtagaataaaataagcaaaaaattaaaataaaaataggttgtatttatcctatatttatgatataataatacagaggtgattaaatatgactgtagacacaaaactattggtaccaatgacagatgcaaatcaaaatttttcaaaagttgtgaagatggtagacgagaaaggaatggcagttattttaaaaaataacaaaccccgttatcttgttgtggattttgctgaatacgatgaaatacaagctgcaagaaataagatgatagataaagcagcggatgaattaattgatgaaaatttagaagcttttcaggagttggcaaaatgattattttaacagcggaggaaatatagaaagctcattgataaaaccggaggtttagatggagtaagagatgccggacttcttgaatcatctgtaatgagctgtatgcagacgtttgatgatcaagagctgtatcctgatataattgataaagcggcttggataactttttctatttgtaagaatcatccgtttattgatggtaataagcgtactgctgtactttgtatgctgactatattgagaataaataaaatagaaatatcgtatacacaaaaggaactaatatctcttggattacgtgttgcagaaggaagtatgggatatgaacaaataatagaatggatacgtcgacataaaatttaatagcaacataaaaataccgcagtaatgcggtgttttttatacaaaattttagaaaaggagatagctatggaaatatatcggagaggttatatttaatatgcttgtattagtaggtcttgttaaaggcgctgaccgtattgtcaaagaaatgcttggtgtgtaataacttaataaatttcaatcttgctgttgtattttacgatgaattatgatataataattacagcaaatataaaggaggaatttattatgcctaatattagacctgtttcggatttaagaaactatagtgaagtattaagagatatttctgttgatgagcctgtatttttaactaagaatggcagaggacgatatgctattgtagatatggaagaatacgaaaaaaccaaggcgactataaagcttatgtcaaagctatcagaagcggaacagtcggtgaaaaacggtgaatggatttcaggagaggatgtaaagaaagaattaggtatatgatatggcaaaaataagacttactcctgctgctgtgacagatttacaggagataaaagagtatatttctaaggaattatataatcctatggcagcagataggattataaataaaataataaatgattatacgcttcttgaaacatcaccgtttatggggacttcattatcatccatattgcctgttaaaactgattatcgctattttgtgagtggcaagtatcttattttttataaggttgataatgaatttgtttctatttacaggattttatatgggcgcagggattatatgagaattcttttcagtgaaatagattccgaaaatgaagaagaataaaaaataaacaatatttttcaccgcagtaatgcggtgtttttttatacaaaattttagaaaaggagacagctacggaaatacgaattaacaaggaaataaaggactatcatgagagcctgtttttcggactatcattccgtcagtttgcctgctccgttgcagcagtcggcgctgctgtcggagtatattttgggcttcgcaatattgtaggtaaagaaatggtgtcatggctttgcataatttgtgcagctcccattgcggcagccggattctttaaatacaatggcatgaatttagagaagttcgttatagcatatataaaaagcgaatttctctgttccggcaatagaatatataaatcagaaaacgtgctttttaatctatataaggaggttttagcagatgataaaaataaacaaaacaaatctaaaagaagaaaaaagaaaaattcctaagaccgtgcagcagtctataccaattaaaaaaatatttaaggacggtataatacagtgcggaaatatattttcaaaaacatggagatttacggatataaattatgctgtagcctcggacagtgaccagctggaaatgtttcttgcgcattcggcgattttaaacggtctgcctactgatgcagtggctaagataagcatatataacaggcaattagataaaaatgtgtttaagcaaatggtatcttcaagcaatgatgataaatattctatatatacatctgaattaaatgaactgttagcagataaaatggccgaatcaaacaacattgttcatgaaaaatatattacagtatcaaccgaaaaaagaaatatagaagaagcaagaacattttttacaagagtaagcaatgaccttacagcggatttctctaaaatatcatcaaagattacggagcttggaatcaaagacaggctccgtattttttatgagttttttagaaacgaaagcagctttgaatttaatatgaaaaaggaaatggcgcgtgggaatgattttaaggattacatttgtcccgataatattgaatttaaaaacgaccatatcagaatagggaatagatatgcaagagtgctgtttttaaaggagtatccgtcatttttaaaggacagtatgctgtcagagcttacggatctatcaagaagtatgatgctgtcagtggatattcagcccatcccaactgatgaggcagttaaggagatacagaaaaagctgcttgcaatagaaactgatataacaaaatggcagcaaaaacaaaatatgaacaataatttttctgcgacagtgccgtatgagctggagcagatgagaaaggaaataaaagaatttcttgatgacttaactacacgtgaccaaagaatgatgtttgtaacagttacgcttgttcatgtttcggacagctttaaggagcttaataacgatacagaaacgctaaaatctatcggcagaaagcatatgtgtaatttctcaacgcttaaatatcagcaggaggacggattaaaaaccgtgctgccgtatggaatcatcaatatagacgcagtgagaacgcttacaacggagagcacagcagttttaatgccatataaaacacaggagattattgacgacggagggttatattacggtataaatacaatctcacataatcttttgatgtgtaacagaaaggaactgcttaacggaaacggctttattttaggagtatcaggctcaggaaaatcatttgcggcaaaaatggaaattgctatggccgcattgtttacagatgatgatataatttgtgtcgacccggaacgagagtattcaccgcttgtgacaaacttgggcggtgaggttgtaagactgtcgtcggcttcgaaaaactatataaacgcacttgatttggaaagagactgcaataaggatgaaaaccctgtgtcaatcaagtcagagcttctaatgtcaatgttcgatcaggtgcttcaggagagctcttcacgtttgggtggaggggtaggtcctaaggataaatctattattgatagatgtgcgtctaatttatacagcagctactttaataataaaaactctttgccgcctactttaatagattttagagaagagttattaaaacagcaggaaacagaagctcatgatttggctcttgctcttgaactgtttacaacaggtaatcttaatgcgtttgctcatcaaagcaatgtagatgtaaacaagcgtattataagctatgacattctggagcttggagaacatttaaagcccataggacttcttatcatgcttgacaatattatgaaccgtgtaattgcgaacagaaagcggggaaaatatacaagagtatatatcgatgaagcacatctgtttttctctaatccgtttagctcatcgtttttattgaaagcatggaaacgctttagaaaatacggcgggcttttaacaggaatcactcaaaatatagatgagtgtcttagtaacgatacggcaaggctgatgcttggaaacagtgagtttctgcttatgcttaatcaggcggctaaggaccgtgagggactgacgcagacactaaatatatcagaggttcagataagctatataacaaacgccggagccggacgtggactgataaaggtaggcggctctattgttccgtttgttaatgagtttccttctgatacacagttatataagctcatgagcacgaaaccgggggaggaatagaatttatgaaaggtaagaataacccggagctatgcccaaactgcaaaacaggttatgacagctatcttttagataatagaagcccattctgtccatacctcagataccatgacggcacagaatgcaaaatgtttgtagctatgaaggtatttgactatgatattgaaatcgaccgggaggaatcagaaaatgaaaaataataatctttataagctcgcatatgctgatttactgacaggtatgatgaataaaaacgcatatgaagaaagactgcaaagcttcagaaataaccctgacagtataaataaattttcggtagcaataattgatttggataacttagaatatataaataacatatacggacagcatacggtagatgaggcggttaaaattactgcaagatgtattttttgatacactgggggaaataggtatgtgctatcatataggcagcggtaggttttcatgtgtggctgtcggtgatatatcaggatatgtctcggagctgcgtgatttagtttcatttgaaactgcaaacgacctgtctgtttctgtcgggtatgttaactataataataaatttaacgatattgatgaagtgataaggtattgcgataaaatgatacaagacgaaaaaaatataggctagggcactgaaaaaattcagtgtttttttctttagggaatggaggtgataattattgaaggatgtaaaaacaaagcctaaaaatgtatcagcgcctaaggataaagtgaaaagtcaaaagacgtttagcaatgctgcacaagatattaagactaatttaaaaaatcagtatattcatacaaaagcagaggcagctaataaaaataacgaggagcagaaaaatcctgaaaactatgcggtcgataatgttgaatatgaagcaaaaacagtagtacaaagcgtatacagtgcttcaagcagatatataagcagtaagctgaaacaaagaaatgagcatacggatacatacagcaatacaaataataacggtaatactaaatattccgaaaatgcttacaaccctgttaaggaaaatatacagttgaatgagcctaagcagagaaatgatgtaaaagtctgaacatattccggagccgcaacaaaaggtaattgtcaacaattaggaatgggggataccgagaaaagagatagttttattgatgttgttgctgtgtggggcaataaagaaataataaaattagaaacacgtggaaatacaacatttgctttaacgtctgataatattttatatggatggggcgataattcaaaaggacagcttggaaacggcactactgaaaacgaattggagccaatacaaattagaaccggagttaaagatattaaagccggacttgagcatactgtggtacttgatactaatagacgtgtttatgcatggggcagtaatgaatataatcagataaacagttcaaataataaaataataatgactccgtatatgataactgattattcggagttaataggagcaggagattatcaaacatattatcatggtacagattttgaactatgcggtataggaaagaatgaaagaggaatgatttcaaataatcttcattctctattttatatacaaaaaatatcgtgtggtgataaacatgcagctgccattgacttgaatggtcagctctgggtttggggcgacaattcaaaaggacagctgggagtatatacaatgacctcaaagatgtcattcaaggaaaaagaaacagtaacggaaactatagaaggaacagatacaggaggaaaaacatcatatgatgttacagctcagtcaggaggagaatatattttaaaatatgttgctaaaactgatggtacttatacatttaacactgtttcaaataatggcacttcgttagtcgttgctgcatataaggacagtaattttacaaagccatataaacagacaagtaacaatggattgttacaagtaggagctgagaaaaattcaacgatttatttaaggtatataaaccctgataatatttccttttctgcaactaccacagttgaaaaaatatctgatacagttgaggataatcaaacggtatatgcgatattatatgattcgccatatttcgaagaaggatatgcagcagacggcaaatttttaggcagccgctatcttggttcaaatcttgatgaaagatatgaatacaatactaatggaacggaaggaagcaatgagttttttaagaattatcttagcttagtgaaagataaaaatgtggtttttgttatttttataagagatataacatttgatacagatgaaaacggtatttccatgactcttgatgaaatacataaaaactatgcaacaaaagcaaatgatattacacgttttactaatgatataataacaaatatgtataaagcatatatggagcttgaggagtgggaaaagcctggtcagataccgcagatatacatagaaactccggattttagcgcggttggtattgatgaacaagaatataatttaaagaagagttttttggatttgtatctagatatgtgtaaaaaaatatataaagatgttgaaaatcatgttatcgaacttgaaaatggaaatttaaaaaaggtgcttactaattgtattgcaggactatattatggaaaagaagacccatttgattattacaaagatacaaatgaaaacgatggaaaagaattaaaaaaagaactatctgatagcatttatgcgttaataatgaaaaatgtttctgattatattcatgacgagaataaaaagctgatatggtttccatatacagctggtcagaaagaacaattgaagtgtattggtgagatagcaaatacaggcaaagtttcaaatgacaaagatttatgtgatattgttattattcagccaaattatttttattatgaaatgaatatatctgcgggtgatactggatatatggaaacgatgaacgatatttaccagagcgcagctgacaactgtgtgaagtattgggatgaagaagaacagaaatatgttactgccggcggtgagaaaacaaccgatactttggtatcatttcagatcgagtatgatatgtcgcttgtatcaggaagagatactggtgaaaaacaaaatccagtagataaagcagataagcttgcttatactatatccgtatttcatgatttaatttacggtaaccacagtgatcctggaaatatagttgagcaaaaatctttcggaatatatgccggcggaccaaatgaacagggctatacctgggaagttttaaatcctgacggaggcatgaacgtcaacacccatagtaatagaaattttgttaatttattgggagatatgggtatggtgcatttttatgaaatgagatactatctaagtgtatcggattactattggaacaaaatatcaaatgagtataatggaaaattaatttatgatataacacatatgttgttttattgtgatgaagatggaagttatataccagatccattaattacattttttggtcaagatagaataaaacaaatgtttaaattagattaggaggagtaataaatgaagaatatgaaaaagctcattatgatatttataagtattgtaatgtttataggaacatatagtgtatatgcggaaacaagcgataataatttaattcaagacggaacctatatacaaataggtaaatataatgaagatccaatattatggagatgtataagcacaaatgaagatgatgaaaacggaaagctcataataagtgatagaatattatgttataaatgtttcgatagcagaagagcagggacagatcacaaggacactggattaggtttttgggaagaatcaaacttgagagcatggctgaattctaaagaagcaggagaaaatatattatggccggggaataaccctccaaatatagaaaatgctatacgtaatccatatgataaagaaaatggattcttatcatcatcaaatttttctgaaacagaactatcggctatgaaaacagtaagtcaatggcagatattagatatttatcaacaggatgaagtagaaaatggaatatatgacttttttgagatagatggcagtttaaaaacaagaccagattatctccgttgctatggtactatatcatctctcactcatatagagggaggaatgaaaagaatagcagatacaatgtttatattagatgatatacagatatataatttatatactaagtacggtgtattatcggagcctactgaaaaggctctgaaaacatggaattatggcggtaattctatttgggctcattcgcctaactcatattggcttcgaacatcaaatggacctgcaaacgctaattatgttcaggatgataatatacgaggttataggtctccaacaataggagatttatatggtataagaccagcattttatctgaacgaggataatgtcagaatagtgtcaggaagtggggagtggaacgagccatatataatagacggaaacggtcaggaaggaacaacagtattttgccagagcaaacaattaacggatgcgcagattatagaagaaaacggagaaatattagttccggtaagagatgtatttgaaacctttggtgcagatgtacaatattatgatgtagaggacggaataataacagcaacaaatgatgagcgtacagtggtattacaggcgaataatccggatataggaaatggaacagatgttttcacattaaaagtagcgccgaaaataattaacggcagagcgatgatttcattagagggagtaaaagacgcgtatgagtgtaagacagagtatgtggaagaattagaccgaattgtaatagataagccgggaccgcaagattttggagacggagtaggaaaagaacgctggcagcgagctcgccacttgtgggacggatatcaaggtgacatagattaaagcagtgtaatatattttcacttatttatatatagggaatttgtagtgaaagtccattcagccatgtaacaaactaaataacgaacgttacgacacgaattatcgtaacgttttttattatacactatctgtaaatttacagttaaaaccttactttaaatatgaatagaccgcaataatctaataatttggatattgcggtcttatttatttgtaatactgcacaataaatcgtgttatttgcgatttgttaatgtgaaataagacgattgtttaaatatttaaaagtttttttataaaagtttgccaaaacgaccatcggcaaccgtgatagtgaatgaaaggggaaataaaccgccttgcggaaacggaaggaggtgagactctagtggagttgacttcttcccaaaagcagaccgttgaacatcaatttgatagtttttgcaagagagttctaaaataaggagagcgagaaaatattatgttataaaacatacttgcaagctgtaggcaacgaccttatatcagtataatgatacttctatccagttataatccgagcgttaaaagcgtcgcaggtaataaggatagttcgggctgatgccggggaggtgagattcctatggagcattttagcaaaatgccgtccgtctgaattattaattaatggaggcagataatatgccaaaaaaacaagacaaaatagattttgaagttgtcagtcacttttcaggcagtaaaacaatcagggatttattgaagagccttgtaatgcgtgaagtaactgatgacacatcagaaaataaaacagaaattaataacacagtgaaataattgaagtttgtaacggtttatgatatactttaaatatggaaaacaaaaacaaatgctggtttcgctgtgagaaaggagaagctatggaaaaacagcgtgcagcgctctattccagactgtcgcgggatgatggaataggagaatgtgaaagtaatagtatatcaaaccagaagcaaatgcttaacagatacgcaaaagaaaataattttgagatagcaggtcattatgtagatgacggctggagtggtacaaactttgttgaggtaagataacgataccttttttgcagagggtgttatcttacctctttttgatgtatgttagatagcataactctttacgtcggctcctatctgtctgaaataggagatactttcagtaggcttgtcgcctgtatcaactctgccgacaaagctataaaagatttcgattttgcgggtgttcgtttccttatccagttcgtgaataagaatacggtcaataaattcatggacgttttcgtaggtcagttcttcaatcgctgtgtatctgcgtaccagtgcgacaaacctttttacgtccgcgctgcgctcggtggcgttgtcgatttcctgtgacagctccgcaatcctccgggtcagcgtctttttttcttcatcatagccggaagtcagaaaagcaaattgttcatctgaaagtttccctaaagcgttgtcctcgtagagcttgcggaataagatgttcagctcgttaatacggttctgcgccttgtcaagttctttccgctgctgtgtcagcgtcttttgtactgcctttgcgctgcactcgttggcggtttcgataaactcctgttcatgctctttcacataagacgttactcgctgcaagtctgcaaggacaagttctttcaatacgcttttgcggatataatgcgtagtgcagagcatatcatttcttgcccggttgcggtagttgccgcaagtgtaggcgtgtttccgttcaagcgtcccggctccgcgtactgcatacattttgtagccgcagtccccacaaaagagcagcccggaaaacaggtcaatttcatcaacctttgtcgggcgttgccgggtggcaatccgcttctgtgcaagttcaaaggtttcttcatcaatcaaaggttcgtgagtgttggggaagaaataccttttttcctccgggttctttttcgtctttttcgacttataagataccttgtaggttttcccggttatggtatgccctaaatactctttccttgtcagaatgtcgtacagtgtcttatccggccagttgtaccatgcgttgagctgtgggcgggggtggcgtttgctccctgtcctgcggtagcgcagttccccgacggtcaatatctcattgtcccgcagccagttctggatttcacacatacggtcgccccgtacatacattgcaaaaatctgttttacgacgtgtgccgtttccgggtcgggtatcagatgattgcggttatccgggtcgataaggtagccgtaaggagcttcgccgttgacgcgctcgcctttctgtgcctttgcctgtttgacagcccggattttctttgaggtgtcgcgggcgtaaaactcgttgaaccagttccgcagaggggtaaactcgttatcttccctcgctgtgtctacaccgtcgttaatggcaatgtagcgcacttcgtattcggggaaaacaatctctatcagttcgccggttttcagataattacgtcccagacgggaaaggtcttttgttatgacggtcgccacgttcccggcttcaacctcatgcagcatggcttgaagcccctcacgctcaaagctcacgccggaaaatccgtcgtctacaaaaaagcgtgtgttgaaaaagtggtgttcgtcagcatacttttgtaaaatcagtttttggttctgtatgctttcgctttccccggcttgcatatcttcctggctcaatctgcaatataaagcggtaatcttgtctgtctgtaacattttgtcctcctttccgacgacagacaagcatggtatttgtactgtctatattataccacataccgctgcctgtgtcatgtataaaatgtgaagaaacgccctatttccgggcgtttgcggggttcagctccatgtccttgcgaatgagcttctttatctttttatccagtgtgtccgttgcgcgttcacttgcggacgaacatacaaggtaagtaacttttccgattttatgctccgttgtggtaacgggcgtctggttttgcgtcaaagaaaatccccctttctttcgcaaacatataatacagtctatgaatagcagcaagtccactattcaagaaaacaaaggctttaatcggacggttattagcataacctcatgggaatttcaccccggcatggttctcatgcagccctacccattgcctgcgacgctcttaacgctcggactgtggctgtaaggaagtatcattgtatattttgcgtgtcgtcgcccgcaagccgctacacttgctttccggcgcggtgttggtcgctcggctgtccgggcggggataacctcacccggatagcgtcatggcgcacccaccgtatggctcggcgcaaaaggaacgtatccgatttgccctatgctgcgccgccgttatcttgcgccgctttctttgtcaaggttcagaatggctttgctgccgcgtcagcagcggaacggaaaagggggagagagaaagcgtcccgccgctgcggtttattcctctgccttaaaggtgaggacagccatcatcagttttgcttgcagccgttcccgaatgtcgtggtctacgccaaaatagacgttcccgcgctcgtcgtacagcttccgcatggagaggcgggctatgtagccgctgaaatgctgcaagacaatcttcatagcgtccgggtcgccctttgtcgctgccaaaatgacaggatagggaacaagggctttttccgggtagccgggttcgttaccattcgtcccattcatcagcattttcctccagatatttttttagcagctcaaaagagcttgtccgcctgtactgtatcgtgcttctcgacgtatcgaacagctccgcaatctcggtgtcgttcattccctcgaaatagtacaggagtacggctttgcgcttttcttccggcaaagtacggattgcttcaagaagcagcttcggcgtgattttcttcccggctctttcaaaggcgatttcccctttgaaatattcatcaaaggtatgaagctgccgcgcttcttctaaggtcaagtcggaaaaggtaatctcccttgccttatgcctgtgcagctctttgtgagcgtcacacgcttcattgtgcagtaccgtattacaaaacttctggaaagcgcactgttttataaactccctgcgattaggttccacattctcaccccctttctcgttggaaagttggtggtgcttcccccttttcgcggggcaatactgccttttgaaaaaaacgccgaagattttcggatttttttcaaaaaattttttgagcagcaaaatacgcctgtccgaaaagcccggacagacgtataggtattgtaagcggtattcagatgattagacagttcatattgatagacgtagttttccccggcggtggtcgggctttttttgatgtgtcaatgaccgtcggattttgtcgatatggtatgtgcttcatggcggctacctccttttagccgccgcttttaacagtgataccgcgtcatttcattagaagataaaaagaaacggcggctttggtttttcaaagctgctgcggaaatcaaagaacgacaagcaacagttctgattttgctccaatatggttattgggggcacaaattaaatcaaaaaagagccgataacagcagtatttcaaactgcatattatcggctctgcgtctgtgcgtctggctcttttaattaaattatttttgttgttttttggctttattatatgtattagctaactgtccacaagctgctttaatctctctaccatgagaaactctcatggtaacttcaagtcctgtttgctctaattgatgtttgaacgcaaccatttcttgtttttgtggtgctctaatttttgaattactcgtcgggttgtattgcagcacgttaatcataacatttttgcccttaaaccattttgcaagttgccttatatctgaggaacggtcatttatacctggtaaaagcaaatacgcaaataccacttttcgattatgcctttgtgaataggacaatgcttgcttaacaacatcttcaatagcgtacatgtgcatatgaggaatgatgcagtttctcgcagcctgtgttgctgcatgtaaagatattgtcaactgaatttttagatgttcttcgcgcaatttttttaattgattaactggaccaactgttgatacggtaatgccgtcggttggaaagttaagtccatttctatctcgaagaatatggattgctgcaatcaagttgtcgtaattgaataaaggttctcccattcccataaaaacgatacgatttactttttgacgtatcaatatgacctgttgcacaatttcagatggtgttagattacgaacgaaaccattgcgtccggactcacaaaaaatacagccaacagaacaaccaacttgcgtacttacgcaaacagtcccaccatctcgccgtttaataaaaaccgtttcgatatacctgttgtctttcaattcataaacatacttttcagtatcgctacttttatagactttttttgttgatattgatagattttttttgtgaaatggctgtttatacaattccgcatataaggctcttgctttatcctctccaattacttccgacatttctttgtaagtaaatccgtatgggtcattcaatatttccgtaagtgtacttttaggtaagtgtttcatttaatatccttccttttgtttttcagagtttttgattatgatttctaatttttcaacatcaatgatatgtgttaatttacatttagggcagaaaagaggaaaatttcttaataccgtattataaaatacttgaaccctcgtctttccgttacaaattggacattttatccaatatttttcaagcataatatttctccttttgtgcaaaaaaatacaggtcaattctcaacatgagcattgacctgcatttatacatataacactacaacaaaattaaggcatagtttttatactatgtctatacatcgttagttttgttgtatagcatacgcaaaataagcatgacaaaaaagcccatattgaaaatgggaaaaatcttttttgatttcaatgcttatcgaatacgcatgctatgtaacataaacatttcccccttttaataatactatacaaaaaaagcggctaattgtcaacatatacatatgaattattttggctaactgattgaattgtgtagacatatccaagaagaaaggggaacagtaaaatgtaacagggtgaataactatggcaaaaagaccagtaccgaaatacgatttcaaggcttttggggcagcgataaaggcggcgcggacagggcgcaaggagagccgcaagaaagtgagcgacgaaatgtttatctcgccgcgctaccttgcgaacattgagaacaaggggcagcacccaagtttacagattttctttgagcttatgctccgctacaatatatccgtagaccagtttcttttggaaacgccgccagagaagaacacgcagcggcggcagcttgacgcgcttcttgacggtatgagcgatacaggcatacggattgtgagcgcaacggcaaaggagatagcggaagtcgaaacagagggcagataagaagtgtccgtcagaattgaataaggtttagagagcgttgtaatctttttttgaggattgcagcgtttttcttttgcggaagtttggcaaaaccgggcatagctccgtagtaaggcataagggataaaagcattcgtagcaagcataggaagcgggtacccacttccgtattttcccctcccgcgctgcggcgcgtcggttgaaaattgcttgttgggaagtgtcccaaaccctcggaacggaaaggaaaggagcgaatacatgaacggacgcaaaagaacggtgcaaatcaaattcagagtgacggaagcggaacgggatttaatactggaaaaaatgaagctcgtacccacccggaacatggcggcatatctgcggaagattgccattgacgggtatatcattcagatagaccatgccgatataaaggcaatgaccgcagagatacagaaaatcggtgtcaacgtcaaccagatagcacgccgcgtaaacgcgacggggaacgcataccaagaggacatagaggaaataaagggggtgcttgcggagatatggcggttacaaagattaagcctattaaaagcactctaagcaaagcccttgactatatcgaaaacccggacaagacggacggaaaaatgcttgtgtcctctttcggctgctcctatgaaacggcagatattgaatttgaatataccttgtcccaagcactccaaaaggggaacaatttagcctttcatctgatacagtcctttgagccgggggaagtcgattatcagaaagcccatgaaatcggaaagcagcttgccgacgcggtaacaaaggggcagcatgaatatgtactcacgacgcacattgacaaaggacacgtccacaatcacattattttctgcgccgtaaatttcgtagaccaccgcaaatataattccaacaaaaggagctattacggcatacggaacatgagcgacaagctgtgtcgggaaaatggcttgtccgtcgtcgttcccggcaagggcagcaagggaaagagctatgcggagtaccaggcagaaaagacgggtacaagttggaaaggcaagctaaagattgccgttgacgcgcttatcccccaagtttccagttttgaggaattgttgcagcggttacaggcggcgggctatgagataaagccggggaaatatgtgtcatgccgcgcccccggacaggaacgcttcacccgtcttaaaaccctcggcgcggattatacagaggaagccataagggaacggatagcgggcagacgggcaaaggcggcgaaagcccccagagagcagcgcggcgtttcgctgcttatcgacattgagaacagtatcaaggcggcgcagagtaagggctatgaacagtgggcgaaaatccacaatctgaaacaggcagcaaagaccatgaatttcttgacggaacataagattgaacagtacgcggatttagtcagccggattgaagaaatggcagcggaaagcggacaggcggcagacgcattgaaggacgcggaaaagcggcttgcggacatggcggtgcttatcaagaatgtttccacctaccaaaagacaaagcccgtctatgacgcataccgcaaggcaaggaacagggagaagtaccgcgccggacaggaacaggcgattatcctacatgaagccgccgcaaggtcgctgaaagcggcgggcattgcaaagctcccgaaccttgccgcgctgcaatcggaatatgaagccctccaagcgcagaaagaagccctttatgccgactatgggaagctgaaaaagaaagtccgggaatacgatattatcaagcagaacattgacagcattttacaggcagacaggcagccggaacgggaaaagggaacagagcgcggataaggatagcaaaatccccgccgctgtgctatgatagggctatcaaaaagcagaggagcgttgagcatggaaaaccagaaaatgccggaatatgaaaccatacgcgccgccgttgccggggaaaaatgggcggtggagaaagtcgtggagtgctacaaggacgaaatcgacaggctatcgacggtagcggtcagacagccggacggaagcacgaaacaggaaatcaacgaagatatgcgccagtccatcacaaagaagctgatagaagccctcccgcagttcccgcttgaagaaatggaaaagggaaatgtcagataggcaaaaaaagaacagggcgcggaagccagtatatgacttccgcgccctgtctttttatgggtgctgttttcgtgaatgttacgcagtagaacgccatttttgggggtaaaggtataaagtatcgcctatccgattttcacgcccggaaagccctgtaaatcaagggattttccgcgcctactgcgtaacaggggcgcgtcttttcctcatgcgctcggcggcttgtctgcgggtgatacgtttccggcagacggggcagtatttgacactgttagaggttgacgcaaagaacgcgccgcactcggtacatttcttcttatcccctgtctggtaaagctccgcataaagcagcctgtcggcgggaagcaccgcaacccggaaccacttgcagagaagcgaataggaaatgagctgcggacatacgcactcgtccccgtcgtccagtaagatacagttcccgttatcataattgcagcacgtccggcgcacaagggcgttgactttccggctctggggcggcgtcagccgcttaaccccgttcatacttcatcagcggcgtaaatgggaagctctgcaaattccgcttcggtcaaagcgtccactttggaaagggtgcgctttgcaagctcccgcatatccgcgtccatgtagggcagcgcggcgttgacattctcaatcaaagcccgcttgccgccctcgttgtaaatgctcaaaaggtttgtttcttcaacagtcagtctaatcatgctcatacctccatatcgtgattttttgtttttgccgccgcctttttcggggcggtctttgccttgtctgctttaagctgcgcccggatagaggggcggggcttccttatctccctgtcccggttctcccccttgtcaatcagcgcatacgtcccatgtctgccctcgattttggaaaaggaaagggtcttgtagggcagcatggagaaaaggcggtcagtgtcctttgtggctgcaagccgcatgaacgccggggaaagctctgccatgaaatgggtcttgttcgggctgttcggctcgtaatgccgcttcatttcccgcacaatgcgccgcgcttccgtttcaatcagcccgtcccgcaaagcggcaatatgcgccttgaaatcccccggcgaaagctgctcccggctgcgccgttcttcctgtaagagcgattgcagcgcgtccgggtcgttgggtacggcttcaaagcgttcaaatttcccaagctgcgggtctggggttccgtcaaaatatctcccggcttcctgtaccctttccccatgctcataaatcagcttcaccgtatcggcgggcagctccttttccttgacgcgctcataatgtttagagtagtccagttcgtacagattgcccttgattttcccgcgctcctttcccgtcagctcgattgcataggcaagaacgcggtcgcttgtctgctccatgtagaaacgccatgtgttgtggggcgcggtgtctttgaggaaaacgtcgcgctcccggaaacagtgcgtcccggacgggcggcagaaccacaaaagtgttttgtcctccctgtgggggcttgccgccgcctttgcgataatctctttgtcaatgtctaagtcgctctggtaaaagcctgtgttctgcttcataatcgcttcaagggaagcaaacaaatccatgttttcaaatttgctctgttccggcatgggtcagctcctttccaagtcctgtgacttctgctttgcgtttttcttctgtgccttttccttgtcggctctaagctgcgcccggatagagggtttcttttccggtttcgctcccttgccgcgctccttgtcggctttgacagcgttagccaggtcaacaagggaaatctgctcgcccgcctttacctttgcttccagttcgtcaacggtgggggtgttgttgatgataccgtcaatcatgttcccgttctgctctgtggtctgctcggcggttttcaagggattgtcccgctgcgcctgttctgcggcaacggcaaacgcccgcgtcccattccccataatcagatactttccgtcgtccgactggtggtgaaagccatatccggcggcttctatctgctcccggctcatggcggtcacatggaaagtccccctcggtgtcttgacagtttcgcccgtttccaagtcgtccggggtaagctgcttttgctcctgtaaaaactccggcacttcccgaaaacctacactgtcaacgaaatgcgccgcgtcctgtccgtcctgatgaagcactaccacgtcggaaacggaaaggctgtgtcccttaaaatctttggggtggtcgatattgaaacaggtgtaaatatcttcaagggaagtttccggcgcaaggggcgcggaatagacaagctcatagttcgccctgtcaaccacatttcccgccgcctgcaggcggtcgtatggctcaaagcggaaatcccttgtttcgtccccgccctttatctggtaaatggaaaaggtgtctttgtcctgtccggcggtctgcgccgtttcctgtgcctttgcgtaaagctgcttcacgtcgccctcggtcagctcgccgcttttgagctgccccataagctcgcggcatttctccggcgttcccgtataaagcacgtcgcccattttcgcccgcccgttctcctgtgtcacataggcttgcaagaggtagctgttttcccggctgtcgctgtaagggttccggcgcactctgtaaatcgtttccggggtaaaggcttctttcggggctgcgcccgctttttcctgtgcgccggattttcccggtgcggctgcttccggatccggcttctccggcgcggcttcctgtccctctctggtgggctgctcctgtccggcggtctgctccttgtcctgtgccttttgcagctccgctaagttctcgtctatggaattgataatctcggcggctgcgctgcgtatcgtttcaagggagcttttcagctcggacagctcccgcccgctgctccacccggcgacatagccgaaagagtagtccgacgtgtcaagcccgtaatgttggcagacagtataggcgacgctttccgcttcgacttcgcgggtgcggcggtcaacgtggggctgctgctcgtcctttggcgcgttgaggtcaatgtcgtgcagcttcgcatgggcgatttcgtgaatagcggtctttaaggtctgtaattcgctcatgccctcgttgatagcaatgcgcttgtcctccaagtggtagtagccatgagagccgccctcgatattctcaaaggcgataggaacgggggaagtcttttcaagggctgcgaaaaaatccttgtagcggtcaacgtcgcctgtcagctcgtcaaccgcaatgtccggcagctcctttccctcggtctgggaaacgtcaaagacggataccaccttgtaggcgggtatggtgacttccttttcctcggtgacgggcttcccgtccttgccgataacgggcttctgcgtgtgcgggtcgattttctgcatttcctgtttgattttatagggtgacggagcaatgattttaattcccttttgccctttcatcacgtttcgttcaaagttgttcttccaagcggaaaagcccgccacaagggaagcgtccggcttctgcatggcgataaggacggtgtttcggaagctgtaattatggaattttgacatgactttcagatattcccggtaacgctcgctgtcaaagagttccgcaataccctgttccagacggtcggtaatctctttgagcttttcggcgggcttctcgctcgtcagcacgatagggataaccgggcgcggctcctgtggctgctctgcggtctgcgccgttctctgccccggcgcggctgcgtccatttctacctttgacgggtcgggtctttccggctgcgggggctgcggcgttacccggtattcctccggcacgtcgcgcccgtcgtaccattctgtaaaggtgttgcggttgttgtagatatagcccttttcggtaaacataccgtcgtcgttaatggaagcgtcccgcccgtattcctcatacatgaaatactttttcgcttcttcgggaagttccggttcttccagttcatcaaccagataacgcccgtattcttcttcattgtggacggacggataaatccagtagcagtcaaggttctgtgcaaggttgataatgtcctgtaagctgtcggcatggtcgccgtattcaatggctgcaatgaatttctcccggtcgtcgtcaaactgcatttccaagagcttccctaaatagttcagctcgtcggggtgggaatactcgcttaaatgctccgtcaagccggggatagtggattgaaattctgtgaaatgccattcctcatagtgcttgaagtcaatcccgatacggtcaaagacttctttcagatgttcggcagtcgtggggaatgtcacccattcgcccgcgggtctgccctcggtgtacttcccaagattggaaagatagccgcttaaaatcggttctgccatttgttcgctcctttctttttcaatcatgcggtgcataagctcaaaatcctcaatgctcatgctcccgtcaaatacataggggttaaaatcctccccgtcccggtagggcttttcggaaaagggaagccccgcttcatgggcggctgccctcgcttcctcgataacctccgggggaagcctgtcgtcatgcgctccgataaaaccgtcaatgtcgttcatgctgttttcgtagtggtaacgcactccggcggtcagctcgtcaaggctcatgtcctcgcctaaatgcccgcaatagtagccgtttaagataacggcggcggggtcaatgctttttatttcctctaaccggctcctgtcctccgggtagagcgtatcgtccatatcaagatgaaaatattccgcgttccatgaacgcccctgtttccagaacgccacccatgcgataccgtccctaagctcgtcttgatagtcctttacggtgtcccgtaaacttgccatagtgaaaaacctcctttctctgcggcagcgtcataagctgcattttttggctgcatggtctactacgggtacgcccgcatttctgccaaatatttttgaaaatttttagagggtgaagccctccgcaaaagagggtttgggaaacttcccaacaagcaaaatccccgtccggcgcgtcagcgtcgcaacggggatttacggaagtgggtacccgcttcctatgcttgctattcaagtttttagttcttctgcacttcgatacggtagttgacgtatttcccgccagtgtcagccagaacgatagttccgtcgtaggtcttgcctgttttcggggagtagagcttcttcacattcgccttgccggatttaaggagcgcggcggcaatcttcgcggaaaaagcggtcttgcgttcctcgaaaaagcggtcattcttccacatgacaaaggcacattctttgttgctgcaataatagtttttcttcccctcatggacgggggaaccgcaacgggggcatttgccgacagagggcttttcctcccggaacaaatcctttttcccgtccagtgctgcggcgtgtgtctgcacaagctcccgcgccatagcttcaatgccggacagaaattcgccggggtctgcggctccctttgctatctgcgtcagattgttttcccattctgcggtaagctgtggggaagtgagtatatccggcagaatacagataaggctgttcccgtttttggtagggataagctgcttccccttgcgctccgcaaagccgccctttaccagtttttcaatgacggcggcgcgggtggcgggagtgccaagcccccggcgttccgcgtccgggtcggtgtccccgttcccggcgcgttccatagccgacaaaaggcttgcttcgctgtggggcttcggcggcgttgtggtatgctccgttacttttgcggcggggttaggaaagccctgtccctcggaaagcttcggcagcgtcacgtctgcattttccccgtcctccgcttcgggcttatctttcagcgtcgcccggtatctgcgttgaagctctttccaaccctccgcaagtacggtctttccccttgcggtgaagtctgtcccggcgcatgagaaaaccgccgtaaccgcttcataaatatgcggctcggcggtggcaaaaagcagacgcgcccccgcaagggtaaggatattcttctcgctttccggcagcgcgtccgggtcagcctttgcaagctccatagtgggaatgattgcgtggtggtctgatacttttttactgtctaatacctttacaacctccggcgtgaagtccgcgcccgccataaaggggagtttttcgcaaagcagcgcgataatgcccgctgcggtgccgcccatgtcgtcagtaagaaagctgctgtccgtcctcggataagtaaggagccgcttttcataaagggattgtgcaaggtcaagggtctgcttcgcggtgtagccgaaaatgcggttcgcttcccgctgcaaagaggtaaggtcaaagagcttcggcggggctgcggttttcttctctctggtgagggaaacgcataccgccgtttccgcttcgcaagcccctttcagcgcgtcggcttctgccttgtcggaaatcctcccgcttgccgcttccgcgccggataaatcaaggcgcacatgataatatttttctttctggaaatgggagatagccgcgtcccggtcggtgagcatttttaaggtcggggtctggacgcgccccacgttcaaggtctttccatacaggcaggagaaaagccgggtggcgttaatgccgataagccagtcagcctttgcgcggcagagggcagacgcaaagagcgcgtcgtattcctgcccgtctttgagggaagcaaagcccgccttgattgccccgtcctccattgaggaaatccacaagcggcgcatgggcttcttgcagcccgccgcttcgtagacaaagcggaaaatcaattctccctcgcgccccgcgtcacacgcatttaccacttcggaaacgtcggcgcggtgcataagctcttttagggttttgaattgcttccccttgtccgggtcaacggcgtactgccattcctccggcagaatgggtaagctctcaaaactccattttttatattgctccccgtaggcggcagcttccgcaagctgtaccaaatgcccgacgcaccatgaaatgaggcagccgccgccctcgatatatccgtctttcttttccttaacgccaagcgcggcggcgatagtctgcgccacgctcggcttttctgcaataatcagtttcattttctgttctcctttcggttgttttaggtttgaaattggtttatactttaagcattactataagaaacaggtgacaatatgaaatcaatacatactttcgatgtttttgctcctactgatgaacaggaagaagcaatgaataaaaaacgtggcgggcattacaggcgcggtaaaaacaaagaaatggattactttattgagtgtgctacttcgctatttcccaacaaccattattcaaggttcacacctatatatgatacgacaaaagagttttatcaactgattacttcttccgatacaacagaaagagctatactaaattggatagcttctaatcgtgcatggaattatttgtttggcttattacggcattattacagaacaggacaccatgacgataattatatctttccagagttcaaaatcgggtcggcttatgtggctgattatctgctcataggtaatagttcagacggttatcaatttgtctttgtggaattagaagctcccaacgggcggataacaaaagaaaaaggtactcgtttcggggaagtaatcaataaagggattgaacaggttagggattggcaaatgtatattgctgcaaattggaatgtaattgtagcagaattggaaaagcactcattctccaatacaaagttacccagacaattatacaaatattgcccttatcaaatctactatgctgtgatagccggactccgtaaagattttgagaatattcgtgatagaaagctccaactgcaaaatgaaaataacataacacttttgcattacgaaaatctcatagatgttgcaaacgaaaattaaaagtccattttcagcgttccggctcacttgcctttttctcctgtacctgtttcagacagtagcccacacaagggagctgccctttgtacggacaggaagcgcaagccggggaatggggaacgggcggcgcattgtcacgccgcccgcccggtctttgtatcatcatcttttcaaagggattgtcggtaaacagggtcatgcttcctcgtcctcctgttcttcatcagaaagcccgtccccctcgtccggctcgtcctcgtcgtagtcgtcaaaatcgaaatcttcaaggtcggtgccgcccttgacgttttgcttcggcttcataaacttaaaataatagaacgcgcccccgccgccaagaagtgccacgacaaggaaaagcacaagcccgcccgcattgcctttctctttgggcagctccggcggttcctcggtttccggctctgcttccttgccgctgcaagcggtcatgttgtccttgcagacggggcagctcacatttacctttccggcttcgcatttttcggtgcaactgcaaacggcgggcggggctgcttcggtgcttccgtcctccataagtgctaagaggtcggcttcgtccacttgattaaggaaatgtacggtgttctcgccctcgtcgtcccggtcaatgaggatataaaagtaattgccgtttttggtcgttacggtgataagctgcttgttgccgccgaaatcgtctacaagggtcgcgttcccgtccggggtaaggggttcttccttttggggttcctcgtagacaacgccgctgtcgttggtgtcgtcctctccctccggggtctgtgcaaaagcggtgacggaaaagccgcccgaaagcataagggcggcgcaaagtgcggtcagtgttctaaggattttcttattcattctcggtgtcctccatttcttcggtgtcgtggtctgcgggttctgcggggtagcccggcgcggcttccatgcccggaataccgcccccggaaagcatagcggaaagctcatgcggggaaaggcgcatggagcgcacaagctgtacgatttgcaggttttccgcttcggttttctgcgcttcaagcccccttaatttattctggtactcggtgattttctcgcgggtctttgcaatctccttgtcgatacgttcaattttgttcatagccatcaataaatttctcctttcagattttcatttttttgttgtcagttccaattcattaagccgtagcccttgatacaggagtaattgacggggtagctctttatcttgcaggcgtcgccggaattgccctcgacggtatagacgcgctccccgtccgtcccgataacaagccctacatggtctgcgctcccgtccccgtcccagtcgaaaaagatagcgtcgccgggggcgatattctcatagcccctcgcgccccattgcccgcgtgactggaaccagggtacgccctgtgactggcacccggcaaagcgcggctcgcttttcccggcttgattgtagcaccatgaaacaaaacaggcgcaccattccacgcggctgttaaatccgtaccagctccaaaagggtcgcccgcctacgttgccgacttgccgcttcgcaaggtctacaacggcggtgttgccggggcgtgtgccgtttacaagctgtacgccgcttaaatcctcggacgcgcccatatcgggggagccgccgccgaaaatcagcggcttgtttccgcttgtttccagatagacgcggtacatttcaagctgctgtggcgttagaagttcctccgcaatctcggaaatgggcttgttcgtcagcttcacgttgaggatatggtactcgtagggtacttcctcgctggtcgtttcccctgtttccgggtctgtgcttgtttctgtgcggtagcggatttccgtttcttccgtcagcgtcaaagtgtactgcatggcaaagacgcggtttagttctgcctgtgcgctctgcggggtgtaggtctgtaaaagggcggtgaggtaggacgctaactcatgggggttatgcccgatactgtcaaggtcatagcggtattcgtcatagccggggtgggtgctttcgatattgtcaatctgctgctgaagctcgttttcctttgcggcgtaattattttccgtcgccacaaggtcgctgtcctccgacgtgtaggaagtcccaagtatgccgttcatcaagccggagaacatggagccgcaagaggaaagccccgccgataccatgatgaataagagcagcgcggcaacggcgatacatacgcccgccgggtgccgccctacaaaagcgattgccttttttgtttcctcggcggtcttttttgccgccttgcgggtgttctctgcggctttctgcgccgtttttgcgccgcctttccttgccgactttgcatactgccgcttgatttgctgcttctgcatgaagcgggaaaggggattgcccgcaatctgcggattgtcatgtagggatttatggtactggaaatccacattcgccttgaacgccgctttctctgcctttgccgccgcccggtagggtttgagcttgtggctgcggtagccctccttgactttccgcgtcccgtactttgcgccgcgctctgccagttcttcggatttgtgcgccccctcaacgccggaattgtccttttcaacggaatgtatcttgttgtggacgaaaatacccgcttcctgtgcggggcgggatagcgggttattgtggggcttattccttcctatgggcttttcctgttcctcaaaatgtaggcgggtcttgcctttcccggtggcttcatcaaaggtgcgctcccgtacaagtttcttttctttggggatagccgcctttgccgcgtccagacggtcggctgctttgtccgattttcggatatacctttcaagctccggcgttgcccgttcctcgtcggtaaactgcaagcgggaagatttttcttttgctgtggcttctgcctgtgctttcctcgccgcctttttgctcgcctttctggtacgcgccccgtcgatacgctccaagacgcgctcggctgcggcggtgtcctgttcccgttctgcccccggcgcatggggaagcggcggcgcggcggctgtgggcgcgggagctgcgccgcccggtatggtctgcgctgcctgttccggcggctgcggtgcttcggtctttgcaaagtccgcgtcccttatccgcttgctgatacgtttctttttcccggtggcggcgtttacctcgacagccccctcgcgggtcattttctgcgtgactttctcacgcgctcgatactgttttatttttctgtccctccaatccgcgcccttgcaagggcgcaatactcggcgtttatctcaatgcctatataatgcctgtcaagctgccttgcggctgctcccgtcgtgccgctgccgaaaaaggggtcaagcacaacgccgcctttcggacagcccgccttgatacaggtttcggcaagttttggcgggaacgcggcgaaatgcccgcccttgtagggtacggtattgataagccacacgtcccgcctgttccgcatggtcggcatgagggcttcgtcgtagtagctgccgcttctcgcccggttaagcccctgtactttcccctgtccgggtacttcgtccgcatatttctgtcccgcgctgcgcccggtgcggtaccgcgccgccgttgtgggggctaacggctcggctatggcggctgcgtcatagaaatatttctttgacttcgtaagcagaaagatatgttcatagcagcgggtagggcggtctttcacgctctccggcatggggttttctttctgccagataatgtcgctccgtaaataccacccgtcagcgcgtagggcaaaagctaaaagccaagggataccgattaagtccttttgtttgcagccggaaacgcggttgttttttgcaatctgctgtccgtttctgcctttcgggttcttcgggtctgcatggtagcccttgttccctgtgccgcagtaggtgtccgcgatattcagccagagcgtaccgtcagaacgcagtacccggcgcagctcgcggaaaacctcggtcagcctgtcaatgtactgctccggcgtgtcctcccgcccaatctgcatatcaagcccataatccctaagcgcatagtagggcgggcttgtgacgcaacagtgtacgctttcctctggaagctcccgcaaggcatagagcgcgtcccggttgatgatggtgtcagttttcagcccgttcatgcttcgcccacttcctccggcttcgtcgtcattacccggtaaagctcggtgtctttcgggaagcggtctacaaagggcagcaccacgttcccgtagaagataagcccctcgcccgcttcggtgtgggtgacatatttcatctgctgcggggagatgttgagctgcttcgcaaggatagcccggtcgcacgccgcctgattgagcatgaggacaaaatcagagttttcaaagatattctccacttcgcgggaagcaagcaaatccttgacattctgcgtaatggctgtgggtatgccgccccattttctgaaacgcttccagatttcaacggaataggcggcggtctgttcctctttcaagagaagatgaaattcgtccataaaataccgggtggatttcctttctgcccggttgacggtgacgcggttccatacctggtcctgcacaatgagcatacctaactttttgagctgcttcccaagctgcttgatgtcaaagcagacaaggcggttgttcagctccacgttggtacggtggttgaatacgttaaggctcccggaaacatacagctccaacgccgccgcaatacgcgccgcttccggctccggctgcttcaaaagctcgttgtagaggtcgcccaagataggcattttctccgggtcggggtctgcaaggaaagggcggtacacgttcctaacggcgcggtcaatgacggtcttatcgacgggctgcaagccctccttgccgcctatgacaagctcgcagagggagaggataaagtcggatttcagcgcaagggggctgtcgtcctcgctgtaattgaggttaatatccatagggttcacatactggggcttcccgtcaatgcccttgcccgtaggggataagcgtatcacttgcccgtcaagccgctgcacaagggaaaaatactctgcttccgggtcgcagataattatgtcgtcgtcggtaatgaggaaagcgtttgtcatttcccgtttggcggcaaaggatttcccgcttcccggcgtacccaagattaagccgttggggttctttagctgcttgcggtcgcagagtatcatgttgttactaagggcgtttaagccgtagtacaaagccgcgcccgtctggaaaagctcctgtgtgataaaggggataaagatagcggtgcttgacgtggtaagccctctttgaatggggataaggttctccccaagcggtacagaggacataagccccgcttcctgttggtagtcaaggcgggttaaggcgcagttgttcttctgtgcaatgcccgccgccgcgaatacgtcattttccagtttccgcttcgtgtccgccatgttcaccacaaggaacgtcaagaggaacattctttcattccggctctgcaagtcctgtaagagattcttcgcttcgctgccgaaagtggcaaggtcggacggtataatatccatgtcatagccgctgcgtaccgctttcttctgttcctcgattttcattttgtcaaggtcggtaatcttgcgcttgattgtctttatggcttcggtctggtcgatactgtggatatgcagattgacgataacgcccgtttccaagtccagaatgtcagataagatacggtcgtttaattccggcgcaaggatttcaaggaatgaaaccgcgccgattttgcgccccatgcggaaataacgcccctcgccaaaacggaaagaggacggggcgataaagtcctttgtggaaagcccggacggggcaagccatgaaaaatcaaaggcaaactgcccgccctccgggtggaaaatgccatgcagcattttaaggcgttcatagcctgtcatggggcgggcagacacgcccaagagcttaaagttgttgagtacgtccgtttcgatacgggcaaggcgggatttcgccgcgcccagactgtcggcttcaatggcaaaggtgatatattttgctttgacaagcccgttgttgccctttgcaagctggtttttcagcatatcccggtattctgtgcggatagaattgaaagcgtcctcctgtgccgggatattgaccgccttttccgcttcgccgcgctgcgtcccttgattgatgaaagaaagctgcaccgaaacggaagcgtcaaagtagttgaggaagtcgcaccagttctcaaaaatggcggtcttgtcgtctgcctgtgcaagctgatagttaatatcttcaaaggcgacggtctttgagtatttccgtcccgtaaccttgcagataccgtccgggtacatctggatataggggattgtctgctgcgcggtgtgggctttcccgtcgccctttgcctgtctgatgatttccgcaatctgctttttctcggcgcgggtgagcttgcggggcgggttaggctttgtgcttcccgccgcgctgtttcttcgtgtttccttttgcaatcgctgatacctccttttcaagttttctctgccgttctaagacggaataaaagttgtctgtcctgtatggtcgttctttgggggctatgaattttgtccgtatgatgttcttcaccaccacttcaaggggctgtccatgcttctcatacatggcaaagaggaaacagggcagcatgacggcaatcatagccatagacgcaaggcttgtgcctgtgctgtctttgagcagaaagaaaagcggcaagccgaacaggagagccgccgcaaaacatacaatctgccgtttggtaaggttgaaagctacttttgtcttgactttggataagtctttgggtacgggtacatacgccaagtgaaaacctcctttctctgggtttggtgttgctgtaattttccataagggtaatcaaggcaaaggtcaatctatgccctttgcccgcccgtattatatgggggttatccgcgtcaaggtcgggtcgtattttcgccgcttcgctctgaaaatctccaccctgcccttgacacgccgctaatgcgcggagaatatcgacttcgccagtgcgccggatttgaacagggagaaacagaggataacggtataggctgcaagggagaatatcgcgctgtgcagattgtccgctattatcatgttgtttaccagaaccgcgtaaatgccgacgcatatcataatgaggaagccttgaaaaccgatagcgaacagggattttaggtagttgtttcctatctgcccccattcccggttcgtcatagttgcaaacgggataggcgataccgaacagtaaaggtaaatttctatcatgcgcccgtagaggataacggttatcagtacggacatgattttcatgcacaagctcacaaggcttgtttccatgacaagtaagagcagttcggggatttccatagcgtcaagcccgctctgcatggaagcaagggcggcggcaacatcaatctctgtgctgccgccgattacccccgccgcgccggaaacaacgtgctgcgccatatcgaacaccgccatagtaatgtcaaaggtgtgcgtcacaaggtagactgccacaaacgccttgaacacccacttgaagaacatggaagtgtcaacgtcgtgcatattgttcttttccgttaccatgctgataagctcatagcataggacgtaggtaatgacaagccccgcaatgggtacgattacattttcactaagggtctgtatcatggagaatatatttgcgttccacccttgcggggtctgccctacctctgcggcgatagtgccgactttttcgtttacgtccccgaacatagttgacagattaccgtttatggctcctatgaggatttcctttatccattcgttaatcgcgtcaagtatgctctgcataagcctttacccgcgcttcttaaccgaacaagccggaaagcagcggtacaagggtcatgccgataagggcaacgccgccgcccgccataagctgcttcatgccctggctctttgcgcccggattgtcattgccgtagccctccatcagattgattacgccccagataccaagcccggctccaagtgctacaacaagggtctgcaaaacgtctactgcgctattgaaaaatgccataaatatatcctttctgccgcgtctgcggctgtccggcaagcggacaaaaggcggtcagcgtatggtcgccgccgcacaaaaaaaccgccctctggtaaaggcggctgtccccgcgctgcgtaagttctgcggcgcggcggtattcagttgtaaggggtgcggctcctgccgctgtgtactgcgccggaaagtgggggcgcgtatcatgtagccggtatggatagatgtgattgcttcaatcgctcctttctgtgttccgctgtgctgccggacgtttttttcagacttgcgggaagtgaatagcttgcgtagcaaggtgttcgcttcccgcaagttcacaaaggggtagctgccgcaaggcagcgtaggggaagtgtagcttcccctgtcccccggcggtctgccatgctgtcactgttgcgggataagcccccggcgcgtgacatactccgttgcaaaacggcggtgttccgcttccttttcccgccaatactcccataatgcagcgtcggcggcttccgcaacattcattaaaaaccgttcaagctgcttttgtttttcctctgcgctacgtttcctcatggtctgcgtcctcctgtaagtctgccgcgtcaagctcgtaatagtcaaaaacctcgtcgggcttgacaatggcggggcggcgtttaaggtgcttttccatgtcaaaggcgttcttcgggtctgcgtcggacaggtacttgtatttcgggtgcttcgttatgtcgaatttgtccgaaaagaacgggcgcaccccgcgtagctgcaagatacatttccctccgtccatgactgcaatttcatcttccgtcataagctgctttcccaatttctgatagttcagcccatgcgaaagctcccgcccccttgtttcggacgtgttaaagctgtctatcgtttcttttcctaaaatttccgatatttctttaagggtggttttctccttgccgcccaagaaaagcgtggtgtcgcagttgccgactatggtatcggcgttgtctttgtaaatggcttttagctgtgactggctctgcaagatgattgacgcggatatttcccggctccgtatcgttgcaatgagcttttcaaactttggtatctgcccgatattcgcaaattcatcaagtaagcacctaacatggacgggaagccgcccgccgtattcatcatctgccttgtcacaaagcaagttgaatagctgtgtgtaaaggattgaaacgacaaagttaaaagtgtcgtcggtgtcgctgatgatgacgaaaagggcggtctttctgtcgcctatggtgtcaagctccatttcgtcggtttccataagctcccgcagctccttaaatagcgataggtaatcctttgatgttatctccggattttcccccgccctaaaccgggcatgaacctttcagctcacccggcttgccatcaggaacagaatttatttcatctcaataactctcaacgtggacaaggcttcttaacttattgagtttttctttctgcttttggtcaaggcctaggatttccatatactttctgataatatcagggtttgtagcatgaatcaggtgatgtacatcttcacataccaacaccagattttgataattgtccttgccgcctaaataccgtggcactttgtgatggcaatgaatatcgccaatagaaagcactttgccagatacggcgcattttcccatttgggccgaatacagtgaaagcctgttatcgttgtattcgatagtacggtacagaaccgggttcctcattaagtaatgaagaaccgtcatgtcgattctgtccagattcttatggatttcggctctgccctcgggcatataggaattgattttgcggttcatggactttgggggcttgtgccgtatgtagccaatcgggacaactgcgtgtccggctacatatcggagctgtttgcttttcccataccgttccctgataactttcggaacttcacacggaatcttcctttttctgacctgttttgcagttttaacccgttctttcagtcttgcccgcaggctcttgtggacagataaggcgaatggcgtaaggtcatcgcagacctttgtggctaattgatagtagtcatggattcccattacataaacgttgtagcggcaaatcgcctgatattcagtacgtttgccttgtgacgggaactcaatgtcgtaaatcagccgttttaagtttggttttattttcgcaatagatttctctctgatatggctctctactacatatttggcgcgtccgttgctccgtttcccacgggggataacctttaacttgaaaccaagaaactctgaatactgctctttcaggttaatcaccttcgatttttcaggactgatttcaagagaaagcctttcatggagccagcttttggttgcgtggaataacttcaccgcattttgatagctgttcgtgaatatcttaaaatcatcagcgtatcggacgcaggtgacttctttcagccttgtcctccgcagtgcggcaaatttatggctcttgctcacgcttccgttgtaattgaccgattccttgtaagggaactccgttggtatttcttcccattggctggcaagccaccaatccaattcgtttagaactacattggatagcaggggagagataatacctccctgcggcgtacccacctccgggaatcctatcccggccacctccgcttttagcatagctgatataatactaagcagcttcttgtcttggattcccattgtccagagctgtttcagcagttttccgtggttcacgttgtcaaagaaccccttaacatctatgtctacgacatagtggagattgcttctctgcatatttttgtgaacctgggcgattgcgtgctgttggtttcggttagggcggaatccataactgtggtcgtggaatttcgcctcacatatcggctccatgacctgcaatacgcactgttgtatcagcctgtccataatcgtcggtattccgagcgggcgcttcttcattgggtcatttcctttcggaatttctacccgccggacgctttgtgggacataccagtttaatttgcgctgtatggcgcatataagctgttcatcagagagtgctgataattctgtgattgtttttccatctgtgccgggcgtcgtactcccgtggttcttcttgatgttgcggtatgccagccgtatgttttcgggtaatgcaatgatttcaaccagatgtttgaaaactttgcctttattgctgtcggcatacagcttatcttgaattgcctggaagtcataatactcggcgtgccttaacttatctttcttctttgcctttcctgttgccatagtcggttacttatccccactttcgtttggattttcgcctttcttagtcctactcgaacctatgcgtgtttattgaatatgattttgtttctgttcctgactacagcccgtccctccaccgcttactttgttcacggcttcacaggtagcatggctgctctttcctcccggattaagaacggttataccgcacctcccataaaaggcggcacgattttcccgcccattgcttcatcatgcgtatccactccacatccggggctttccacgttccgatattcctatctttgcataatacccttaaccctgccctttaggcctgtatgcctgatggtgcctgtaacaccatagggaatttcatatcgacaaatcttactttaccccacatacgccgttttcacggctatggcatttctgccatatcccgttatagacctgtacattcgggcttttgtcagcggtagtcagccgcattctggacataggtactttatagacctccggcctaacacccccggccacctctggctcggctttgctttatcccccaaaggggacagtcgcgggtgcagacagccgacttcagcgtgctgtgtcagtcgcgggaaatacgtcccgtttcttccaacgcagtatcaagggaagcgtttcagggcgttaccccgccattccacttctcggaatatcagttagaaaggctatagcctttccgtcacttttacctctttgcaggaaaatcccacgcagagtttatatgcgacaacgtgtcgctgcactgtctcattcagtttttaaagtcaattatcagtcgatattcttaaatatacgtatatagcgttgtttgttccaggttcaaatcctgtcacctcgaccataccgagtgtccttattggacttgaaccaataaggacattctttttttgtgttcatacggcaagcgcagcatactgaacatttacgccctgacgtgtatgtactgatacgttattttcaggtaatttacttaaatcaggtatttcaatagctccgatacagttataatgaattttaagccgctgtacctttttaccgtctattttttcagcctgatatacttctatcttgtcaatcaattcgtttaacattctcggtgtcagtttccttgcccttgtatatttacgaacagaagataaaaacatatcgcttgtaacagctctattctgttcattatcaagctccgcttgaagttcattgatttttacttcattttctttttgttctgtttcatattttacagacaattttgaaaatctgtcgtcgcttatgcgtccaagagtgttatcctcataaattttttcaaaaagtaagtcaagctctttatcacgcgcaagcaaggagttaagttccttttgtttggagcgtcgttcctgctctgccgttttaatcgaatttcccataacaattttagcaaattcattttcatatagagtggcaaatttcattaagcgtttgatttcaccgagtacaacctgctctaaaaaatcagtacggatataatgtgttgaggtacatatttttctgctgcccctgttatatcccatacaattaaaataggttatatcgtgattagcctgattgaaatgataaccgagtttgcttccgcagtccgcgcataccagcaatctcgaaaacatattcttatcttcgcctgttactggctttttgcgtgttcgtctgcttcggcgttcctgtatcttttcccaaacggtacggtctataattggttcgtgaatatctttaaatatcgcccaattctctttgtcattctcataacgctttttatttttgtatgacttagaataggttttaaagtttatcacatcaccgcaatactcctgtttggaaagtatattgataattgttgagtggtgccatttataaggatattcctgagagcttttcaagcccggacggcttatccctttactataccaatagtttacaggagtaaggattttttcttcctccagcctgcaagcgatttggtctgtacctaaaccgccaagcgccatatcataaatatgtttgactacctttgcggcttcttcatcaacaatccaattctttccgtcaggatttctgatatatccatacgggggaagtccgagcggttcgcccgcattaccctttatcttgttactgatacggcgtttttttgaaatatcgcgcgcataccattcattaaaaagattttttattggcgcaagctcattttcgccctcttgtgtatctatattatcagaaacagcaacaagccgtatatcatattcagggaaaaattcttccgtaagtctgccgacctcaatataattacgtcccaatcttgaaaggtcttttacaaagacggctgaaattttattgttttctatcgcttcaatcatagctttatatccgggacgttccattgtaacgcccgaaataccgtcgtcgcaaaatatcaataaatttgtatagcctttttcctttgcaattttggttagtaatttcttttggttgcctatactgtaactatcgccctctaagttatcatcacggcttaaacgaacatataaagccgctgtcatttctttttgtttgttatttgaccgcttcattatttcctcctttcagacagtcaaataaacagtattacatttatattataccgcgcttttaaccgtctgtcagcctgttttaaaaattttattcgcttgatgtcataagccgtaataaaacagagcctaatgtttcgaaagatttctctttgaatatcggttgtacaacaaatgaggttccattgacttgatatgtaatttcagcgtcaagggattttttattacaaatatttttgtgttctaagttttgagtagtgtcattcataaatagtgaacctccataaatattttatgttaaatccacctaccgagagtaataacccaatcactcaaacaatcatcaaactactgatagctaatcagtatcacgggaatttcacccctgcacggttctcgtccagccacccaatgcagtgacgcgttcaaggcgggagtatcattatacttttcgtcaatcgtggccgtatcggttgcaagccgatagttattgacggtcttatcgctaaaatgtaaaacgtccgtactcggcatactgtttgtatggtagaagctgttacattcattacggcgagccgccggctcctgctcggaaagaaagtatttgatgattggattattcagttgtcaaagaacaaaggggattttagcccatataagcgcattagagatataatgcgtttatatcggataaatcgtgtactttacggagtgcttaaagcaccccgcattattttaagacaagattttaaacttttttataatactataaattagtttactttcaagtcttgaacgcatatcatcatctacatacatatattcattattattttcatcacgggcaactctcgtagacaaacgaattatgtaatttctataatgagcaagtatgtaatcaatggcttctatgtcttcatttattgctttttcgattattgaaaaaggaatgtctgataaagtttttttcacttaatgccctccgtactgataattgcctttaatcgttttaatgcgcgtatgcgcgcccgaaaaacaatccaatagcttaaatcaagctgttttgctatttctatatcaggcatatttgcaaagtatgatagtaaaacaatatctcttaaatcacaaggaagtttgtttatagcttctgccaacatattgttagatactatgatacgaatatcacatacattgaaaacattatcggttacaaaatagcaatcaaatgtatataattctgcctgttccttgtcacttaggaaactaaaatccatttccaaatctgcatagtgtttatattcagctcttatattgtttgcttcattttttaggacgctgcaacaaaaggaacaaaattgttttgatatgcgctgcttgtcctgttctgaaaattctctcatagttttaactcctaacaccgaaaactgattttttatccctcatatggggaacaaataattagataaatttctgcttgttttcagaaaaaacatttaataaaaattctctgtattttagcaaaaagtttgtaagaaaaatcaagcatatcgggcggaggtcttataaaaaaacatatcattttatttatcgaaacaaaaagatataattcatacacttttgatataataaaacaaaaaaacgatttataatattgaatgaacgatttttcgtaaagatacccaaaaaaattttgatatatatttagcattgccgtataaaaagaaaaaagcataatactatctgtcataaatacacataatattacgctttctatattatttagtcttaaacggtcatttttcgcattagaaactaaaaaagccgaacctatcaaacaaatttttttgacaagtccgactttttattagtccctataatcctataatagcgcataaatttttgacaatccacacattgtggctgtacgctgttcactccttattacaaaaacattataaaagtaaccatattgtaccatattatattgattttgtaaataagttattctgtataagaaaaatattgaggttttatcctcaaagtattttaaagtccagaaacaaaattacttatagtgtatgtatctctatctttatgaactaatatataacaagctcctttgttattcccattattattacttgcgttaggagtaaactccacattatcgaaagtgcaattaaaaatcaatgtatcagtagaccaatctgaactttcttctatatactcaattcccgataatgtggctgatttcataccatatacaccattagaaatatcatattgagaaaatggctcgctaagaacttttttcatttcagtataattattttctgcaaaatcatcaaaaaatgttttaattacatcttgagctttcataacttcttgataggaaaatggttggcagatttcaacggtttttgtttcgtcattccaatccacacgttttccaaaggcctgtgaaatagctctaatagggacatatgttgtaccctcatatatgaatggttcaacaatatttccgtccgtatctttcggaatgcactcttgtccgaaaactgatattttaatgttattatacgcaatctctattgtgtcatttatctgttttgcatatattgtgcccgtcgatataactataccaattattaaacctaaaattacctttttcataaaaacctctctttctttacttataacttatcataaaattaaaaattctttataatatagaatgaatatccgccattgatattagcctgagtaaatggttggtctttacaatttgttgtgtgcgctgtatatgcaagtgttacagtgtcattaagagttaccaatacaatatgtccttgtcccgccgtagtataagcgaaatttccagcattagtttcccaagcgtcctcttttgttgcatatccatactgcaacatattattttttaaagacgctgcgtttatccacgcaacagagtcagggctccagccaccgtgaataggcactccaccagcatatacgcactgagaaacaaagtttgcacaatcaccgcccttacctacataattattatatgccggattataattacttgtgtacgggccccaccatttccgagcataatcacgggctgctattctgttataattactccaattatcaacatttttcataggttcaactgttgagctgatttcctctatggttgctgttaattcttctgcgcctgattggtacattgtttcatatgttggaagtaagtattcatctgtgctgactatattacccaagctatctatacaattaagctgtatattatcttttgtaattgctgtctgcggatttattgaaacataaaaatccatacttatttctgtttcttcgccgatatactcatttactgcgtctactctgtcgcttattacttttaaaacgcgttctgcatttaatactgttgcattttcatttaatacagatgaaacatctgtacttttttgaatatccgcatatgatgatatgcccgccgcattcaaataaccctgaatatatggtaattcttcaacgtcagaagcctttaacttctgtctaatagtagcggttgtttcaaacgaaactttattatcggattcatattttatatcaccgtcattaaatgatacgtctgatatagtataatattcttcaccgcgttctacaatataatcatatattgcgtcctttgctgtgtcgataaaaagctgttcgtcaatcgttgtattattctcggcaaatgtcggaatactcatagctgaaactgacataatagcagctaaagctattgttattaaatttttgattttcatagtaaaacattcctttctcttaacttatcttgttattattgttcatatgcagcgtcataaaaaatgtttatagtatctctgtcgcttgtagcggtacagcttgcattatctctgtcatatgtcagtcaccacctgaaagtattttaattgataacatattaaatacagttgttactattgattattaaactgatttaataaagtttttaattcattttgtattccatcacatataacaaattcacaaattataacacctttttcatcttttattccgtgaagttctctaataggaatattgatagtattataaattatttttgcagcttgttcacgagtaataaattgtgttgcatctaattcaatgccttcagaaatattcaaatcttttgccttttcaacataaggtttataccatataacatctgtatatgacttgtcatatcctgttatttcaacacatatttttaagatttcaccaaaagatattgggtcatcaggacgaaatataccatacccatcacctgtcataatatttctcgaagatacctgtgttatattagaatatgcccaatgtgttggttgtacatcttgaaaaatggttatattgtttatatcatattctattttacctaataaatttgtgattatagtcgccatttctgctcttgtcaatgttttagtcggattgaatttattatcatcattaccaaccataatattatatgatattaaagtatctatttcttttttgtaattaacatattctatatcattataatctgccaacactgataaagtatgactacaacatatacttatcaacaatataaatgtatatatttttttcataattatttgctcctatcaaaagaatggttatatgaaatttttgattgtatgaaataaagatggggattataccccgtctttataatgcttagttatatacacctgtataaaccgtagctttcgctgttcccggtgaagaatatgtgctaacatagaaggcatatctgtaattactgctaatttttacttgatttccgtgttccataaatgaattgttaactaaaattaccgttaaaccgttattttgaatgtttatttcagtcgtataagagtcggaatttagtgattcatttctaagtcttacatttacactttcaacctgagactgtatatcttctaagcatagtgcaactgcattagaaccgctcgccggatagaaataccttccaatagcccaattagaagaatcagcgtgaggaattgtaccctctcttctatttagaggtactctatttatctttaatcaggcttgcgtgcgtagatttaagattgagggtatctcttgttttatgtctaacataaaatcagcattatatttgttttttttgtttttgaaactttgcattatccatacagaaaatccataagaccgtcctatgccgatacgcgtatcattttgccggcttgatatatgcttttctgcaacatcaaaatatcgggtttgcccctatgtgataagctcactaaactaacattgagaaatagcatttatcgcgcatattcagattttacaaactgtccgtatcagacaatgcaccgtttcgtatgtactcaatccctgtttataaatcataaacaatttaccatatatcccatagtattgaatactatattgtgattggttgtgaggggatatataataagctgttttgcttatatctgcattatacggcaggaaaattttgatgtcaatagcttttgcctaagcggtcgtatatttgccccagcggttaaaatttgacaaaaaattacccttatccttttttggataagggtaattcttaattgtgttttcgtacagttaaatacattttaccggctataacaaacacagcaacacttataatactaagcgatatgattttagataatataagctgacgaaagactatggctgttacactccagcataccgcacttatgattattaaaattctcgccgttattccgaatatccgctgttctttttcgtcaagcggcttgttcgccgcttcaacaggtgaaagaatagaaagtattatcagcgctgttaaggtaagcaagccccatacggtcatactgtacggaacataccttacaactgccaatacaaccggacacataatgcaagatgataaataacatttcagcgatgttgagaaatgataccctccgcaatatttacgcaagattttatatacgagccagaataaaatacattcccatatcatacccatagcaagtcctataattatcatagtaatatctgtaatcaatatatttaagataatttcaagggcatatacatattcgtcatattgttcctgttttatgtagttattgaggattgcatacataattgctttctctgaaattttatgtatcatagcttaaaactttctgtacttttttatgctgttcggcggcgtcggctgaccgtttacaatacagcaggttgagtttgtgtgaaaaagaagaaatgcaggtacaataacaggcaatgccttgattgcaaatgacgctcctttttgacacaacttttttactctacttaatagcatagtaaattcctccttctcttttgatgaaattattttagcaaataatgttatttaagtcaacccaaattgcctaagcggtcgtatatttgcctaagcggttaaattttgtattattatcgttgtggaaaatatcttttgttctttgttatatttccaatccaaagaaccattataagctgataatgctctgctgatactgttcattcctataccgtgcagcttcgcattatccttgtgagtttttagtctgccgtttattacaataggctctatatctgatgtattttctatctttataactataaaattttgattttcagtatgtatattcaaataaatttttttctctgatgaatgggcgcagctttccatagcattatttattaaattagaaaatatagttacaatatccatatcgttaaaaaacgacagctcggctcgtatgggatctatcaaaaattgtatattttgattttcacattcttctttcttcttagataaaagcacatttaagattttattatctgaatattcaataaatttaggctgagaaaatttgccgcaaatagattttatatattcctgagcggtttcattatcagctccgattaaagagcttaaagcacctatatgttctttgaaatcgtgattaagtattgaggcttgctgattattttcttttaacatcatatattcgtcataatcaaatttttcttttaattgctgagcttccaactctgctttctctgtttccattatcatcaatttttgatttattgcaaaaataataatattcattattattagtatgaagcacaccaatgacaataagtgtgatgttgtattgactttcatcacaagcataattataataacagtcaaaataggaatagataaaagtccaagagaggtagcttgtacatttttctgttttttgcagaatacgcggcttattatcattattccaattaaatataagagtttgcttgcaaatgtcaatataagcgactgtgaagatgtcattgctatggtattgtcaggtataattctaatatatggaataaatataactaaaaattcacacgccgaagttatagccgcgagtaaaatactttgaaacaatgcgcttttccagctaatgcgataacatacgccaaaaataacaaggtgtattacaacaaaagttaaagtatttacaactatctttccgcgtgcacatataaacaaatcagcaatataaactaatgcaattattgcataacaaagatacttatttctttttctgtaaaataaagtgtcagcataataaataaaaattatatattcaaatattattgctaataccattcctaaatcaatccgcattatttttctccaatccatttagcaaagtttttttgaaaatcctcttgcttacgccgcgacaaatatatttcatattctgtctccctatatccgcaatagattttatctttgccatatctttttatataactgaaatttatacaatatcccctaaaaggctcaaaaaaatttgtgtaatcttttacttgttcaaaaaccgtctgatacggaatacttacaataatttcacctttggtcgttataatatgtgttttcttgttttgaacatatatgtaaataatattactgataaatatttgtatgttttccgaatttaccattacattgatgaattgattatttttgtatagctcctgtatagctgagtcaatttcatagaccaagcggcgcctgtctattggttttgtccaaaatctgaacggtcgcacattagacgcattatcaaaatatgcttcgtaattggttacaaaaaagaataaacagcttttatttgttatacttattttttcagctaaactaataccgtccatttcagccatttcaatgtctaaaaatataatatcatagacagtgtcggactgtaacaacttttgcggtgaactaaaaatgtcgattgagtgttttattttcttttcatttaaaacatcttttataagccttaactcattatttaaggctattttatcatcatcacataaagctatacacagtgtcattatttcatctcactttcaatgtaaattaaaaatatttttcagtaaattcgtaatatctttatgtatattacaacacaatcacaataaataaattttattataaaagctataaattgtcaagatttttacactgttttgctatattttcattaaagatgtgcagaaaaacttatttttatttgttacccatatataaggggtttttgctaccagcaagcaaagccgccgggtacccgaacggcgattttttgtttgtctatgccttgcaaaagtcacaaaaaatattttgggaacaaatcccaaacccagataaaaaacggaggtaaatatatggaaaagcgaaaaagaaatattcaaatcaaattcagagtaacagaagaagaaaaacagttaattgagcagaaaatggcgcagctaccgacacgacagataggcgcgtatttacggaaaatggcgattgacggtttaattatttatactgacacaaccaacattaaggaaatgaacaaggaattacattctatcggcgttaatataaatcaaattgcaaagcgcgtaaatgaaactggctccatttatgaggaagatataaaggaaattcaagaaaggttaaataaaatatggcaattacaacgaaccatactattgacactaccctaagaaaagccattgactatattttaaatcccgataagacagacgcaaagctgcttgttcacgcatacgcctgtactcctgaaattgcagatattgaatttgattgcacaagagaacacgcatataataagggagaacatctcgcgcgtcatatcatacaggcattttcgccgggtgaaaccacacccgaacaggctcacgaaatcggaaagcgtttcgctgatgaactgctgggcggtaaatttgaatacattttgacaacgcatattgacaagggacatattcataatcatataatttgtaatgacgtcagttttgttgattacaagcatatccacatcaatgaaaagtggtataaccattcacgccgcataaatgacagactatgcaaggaatacggattatccgttgtcgaaccaaacgctgaaaggaaaaataaaaataccaagtatgagaataaaccgacaagctggagggcgaaactgaaaaccgagattgacaagataattccgcaagtaaaagattttgaggattttttgcgtcttatggaattacagggctatgagataaaacgaggtcaatatatatctgtccgcgccaaagggcaggaacggtttatacgtctgaaagctcaaacgctgggcgaaagatacagtgttgagggaattacaaaacggattgaaaaatcgcgcaaacgcaagccgattattcgtgataaccgtatcagccttattattgatattcagaattgcattaaggcgcaagaaagcaagggctacgagcattgggctaaaatcaataatcttaaacaggcttcaaagacgcttaattatttgaccgagcataatataaacagctattcggaattggaaagccgtattgatgaaacgtgcaaacagtttgacgataccgccgacaagttcaaatcagttgaacggaatttgaacgacataaatattttacgaaagcatataagcacatataaggcgctccgtcctgtatatgataaatatgtcaagtcgaataacaaggcaaagtttgaaaaggaacaccaacgggaaattattttatttaaggcttctcataaatatttatcgcaggagcagaccgatagaaaattaccgacgcttgaaagcgtaaatgttcagcgtatggaattagaggagcagcggcagaaattatataccgattacagaaaagcgaaaaaagaggtgtccgaaattgatattgtaaaagctaatgttgacgctatgctgcacactccgcaaaggagcgaaccgacaagagaaaatcagatagaatagtcattcggcgttttatacaggctgatgttaaaaccttgtgcgcttttccggctgggcgcggcatatagtaagtgatataattagtatagagaaaatatattttaatttcaggaggttttcactatgaaaaagaaaattattacactaacactaatcgctgcattatcagcgacagcgacaacagcgtttgccgccccgattccaagagaaagcgcgccgcttaatgcgacagaagcacaaatccaaatcactgaaaatattgtaggtgatattcttgatgaagtgcagacgggcaagctcggttacacattagctgccggatatgctaatacaaaaatccgcaaggctgtaatggcaaatcagacagacggtaacggttacggtatcttatcgccaatcgcgcagaacgcaatccgcgttatgagggataaacagttaagacctgacgcatacgcaaaagcggaggaagaattaaaggtattgattgcagatgtgattacagcggttcagaacggtatggatattgacactgcaacaaaaacggcttatgagaaaatctatcaatcagcagacacgtcatttaattatgacgagcaattttcacttgatacctgttatcgagatattcccgctgtcggaatggaaatgtttacagtcgcaaggaaattgttattggaggctgccgtaaaatgaaaattgaagaaatagataattgtgatgatttagacgatataaaggttttcgcaatattggttactgatgttccaagcaaatatgtagcccaagcaaagaaaatagacggaaagtattataaagaggattgttttggaatagagatttcatatcacgctgacgaggacaaatatgttatatcgtccgaatatgataaacaactgtattatgtggattttaacggtaattggcattggttggattatacttttacacaagcagaaaaagacgcagcaatagagttatgcaaaaaggatttacaaaaggaagcataaccaaagcggttatgcttcctttttctctttgactatataatattcttttctaacaactcggtaacttctcttacgctacgtccttgtgaatgtatggcattgagcaaattttggatttcttcgtttgttggcttttgtacactattcttcgttttaggagtatggtcatttatatatttttgaataagtaatactaattcgttaatcccaatttcacccaaattctttattccccatatttgcggcaaagtcaaatttagtagtttttctaaatcaataatatttttaaatcgtataatagcagacacgactcttgcagacaaacaaagttgtgagagcggaatgtttttgtagatttcggattttacattaaaaatttctgctaatgtataatcagatgttttatatttattcgttaattcttttatgttttgtttatcttgttctgataatttttgatatagggtagattttaaatccatatgtaacaactcttttcattaaataaaattgcataataaaagtgcgtcgcttcaatagaggcaacgcacaaaaaatgcgatactctattgtctgcgaaaacaatttttatactttccaatatacgttgtaacatatggcacaaagtattaaaaagagtacgcatttttatcatatgataaaaatgtttttcttcgtgccaaaaaaaattgtatgcaaaaaaagctataaatataaaaattgttttcgcatttataaatatatcataaattactattattgtaaatacctttttacatcaaaaaaataagacaggaataacggctaatataacagttattcctatctatatttaatataaaatgtccgcgttttcaatcctattttaagggtatttgatatgctatcattactttatcaattttaggctttgaaacacttgattttatgcggttttattcccttaaaatgcggacatagaccgcttatttcttttccgttcagcgtctttacgcaatcgtatctttcggcggcatttatcacaatattttgaattgcgccctgtcggcgtatattcattaccgcaaaccgtacattttttcctgttcttcggcttcatcagctttatgtacaattccttatcattcggcaaaaccgctgttctgaaccatttacaattaagtgaatatgaaatactttgagggcagacgcaaggctcgccgtcatcaagtaaaatacaattcccgttgtcataattacagcattgattttttatcaatgctcggctccgccgcgcctgttcgggcgtcattcgtataatatcactcatagcgtttcctcacgcggctttttctgcggctgcggcttatcagtattgttttgttccttttgcaatctgtctaactttgctttaattgagggcttgacctcgaccgccgttatttttccgttaattctcataaacatttcaggtttagcaaaacgctctgaaaactgctttatctggtctttatcaaggctgccgaagttgtcgccagataatcctgctaatacaaatgttcctgcgataatatcgtacatattatcctctgcgtcataaagcgcacggtttaattccattctctcatttttgccctcgtcattacaaataagaccgacaggctccgcaaacggatatacaacttcaattctgccgccaacctctttctggagggcttcaagacctgtcgaaatttcctttatataaggctcctgcataggcggcacaattagaacggtcattttttgcggctccgtaggtacggtaacgcgatattcgtcaggtatgtttttaccgtcatacactttgtcaaactccgtccagcctgtttctaagacaataccgtcaagcaaatatccgccatgatcgtatgcgtgatgtttgccgtattcttcataattcatatttctttcatcaagcatatctcggtgtgcaatatactttccgtaatctgcccaattagatatattgtcaacaatattataatactccatattgtatgtaatatttattgcgtccgttatatttttacattcgccggctttaagcgcggtttgaaaaacggtcatttcagtatcttccaattccgatatacgcatagcaaaataatttagcgcgtcaacgctttcatacatagttaaacacttttttaaatcatcattgccgcaagcgtaatcatcaaaaaagtatgtatcagggcttgcgttttcaggtaagcctatttctgcaaatgtccgctttaccgtttccgcgtctgtcgggaaagacagttccgtaccgcttgtttctctgtttccgttgtcatattcggaacggttgacgataaaagctgcaaatttatagtcattcatattttttaacactcctttttcatttttttgtttttcggctgtctgttcaatattacggttgtaatcgggataattgaacggttcaccattaaaggttatttcccgtatgggctcaaattttgataatacacctttttgcaattccgcaaattcctgataatcactttttgtaaaagctccgttttctatcatttcagattgagataatacccagccagaaccgcataggaaagagaacatttttttattatcggaaataaaggttaaggaattatccgaattgttataaaacggcaatgattttttttcggaattatatagattgcgttcactttttcccaaataaacattaccgtcttttccgagaaaagccgtcagacctttataattatttaatgccgccgatgttatatgaacccctgtaaattcgggagcttctgtatattcctttaatcctttgaaatatgccttttgttgaccgtcataatttatgacgataatatcccttaaatcaggctgataaacagcagcgccggcggctttatttatcattaagcctacgtctatttccataggcgttttatactgttcaagcggttcggaacgaacaatctcatacatatccttatttatataatttcctttttctctttcagactttaagctatatccgcattttttgtcataatccgatttcagatgatagacagaatattgattttttctaaattccgtttcataagcattaaggcggttcatcagtgcgtcgccctcgtgtcccaatacggaagatatgagatgtttaatataaaatgtgtcgctttctaacattttatccgcaagtatttcacgctgcctttgttccataggaaattttgtcctgtatttcaaattatgcgctcttaaaaatgcgtctatttcaaaagcaagttcaaatacttcgtctaattcgtaatcctgagtagcaccgtccggctctctaaaatctttttcatctgccataggctaatcctccatatcaatatcaggttcaagctccagcttagaaaattcatcattcgtcatacgctccagcttgtcaataaccgtttccgtaatttcctttaattccgtatcttcaatgtacggaacagaaaaacggagctcttttaaaagctccgtcttatcagatgtatcataaatacacatcaaatttatttcgtcctgtgaaaatgtcatagtaaaatatcctccttttgttgttgtgtttttgatttcatcggttcggatttacccttgttttccgcaagctgctttttgattgatggctttttcgctgtccgttctgcaattatggcattgtataaatcaatatctgcctgcgttagtaaatctgcttcgccaaaatctttgcttaattcgacgtgggttataatatcctccttttcagcttccgtcattttatcaagctgcgccttgattttcttttttgacaaatccgcaatatgattgtcaatattgccgcatttcagcttttcaagtcgtttatgctcgcacgatagagtaaattttaattcttcatcagcggaaacactatcggcacacaccgaaacatttataacgtgtttaaaatgcttcggataatctaattcataaagattgcccttgatgacttcattttcaaaacccgttattttaatagcataggcaataatattgtcgtgtgcctgttcgccatagtatgtccaagtattatatgctgatgtatcttttgtaaagacgtccgtttcacaataacagtatgtaccgttcagacgcgacataaaaagtaaatacttatcttctgcactgtcgcttaacgctgccgtatgtattgtatcaacatcaagaaaaaaatcatttttgtaatgctcggtatttatgttcattattcggcgcagcgaatttataatatccacattttcaaacttacgcatagcttaaacctccaaagccgcatttttgaccttttcggatttttgcggctgtttatctgcctgcgcctttgcttccgccaactgctttttgattgacggctttttcttagatgtctcatttttggaaggcgttttgcctttcttaactttttccgcttcatttgccgcgataatatccataatagcgacaggttcgccattcttcgcctttgcttcaagctcgtcaatggtaggtgtgtctttggaattgtcctccggctcaaatacttttgcgccgtctgccgcgtctgcgtccgacaattcagaaaatccgtcctgttcggctatcttcgccggttcctcgtttcgtttctgaaattcagacggtaatgtaccgtctaatggtctgatatactccaccttgtcagcagcgttaaggacttcgcctgttaatggctgctgccacgcttttattttcggctcccaatgaaaaccgtttgcctttaattcggcgcggatattatcgtccggcttttcattaaaaaatacttgcagataattagcgtctgtattgattgcagcgtatccgccgttaaaatcccagcccgtaaattgtgtataatccgtttcctgttcggtctgctcaatatcctttgcaagctctttataatactcgtcaatgcctaatataatttcattcgccgttttttgtattgtgtcaagggaagcgtttaactccggtaattccttatctttgctccaacccgcaacatatccgaaagaataatcggaagtgtcaatcccatatcgctgacaaacggtataggcgacgctttcagcttcaacctccattgtacgattgttcttttgttcttcgggcgtcaattccgttgatttttctttgagaatattgtgtagtttagcgtgtgcaatttcgtgtatcagcgtttttaactgctgaacctcgctcataccgttttttacggctattcgctgttcttcaaaattacaatatccctttgctcccgtatctatatcctcatacccaataggcataggcgatattttttcaagtgcggcataaaactttttgaaatccgcaacattgcccgtaagctcgtcaactcccaaactcggcagcggttcgccctccgtctgcgacaagtcaaatacggtagcaactcggaaagtggggatagttacttctttttcctctgtaagcggtttaccgtcccagcctataatcggcttgtttgttgccggatttattttctcaatctgcttttttgttttgtatgaggacggcgcgattattttaataccgcgttcacctcgttttactgtgcgtttgtgattatcgcgccatgcgccaaatcccgccaccatagaagcgtcgggcttttgcattaaaatcaaaagcgaatttctaaaactgtaattatggaattttgacatacacgcaagatattccgcatatttatcgccgttaaatatgtctttcactccgtcctccagctttttcaaaatctcgctcaatttttcatagggcgtttcgccggataattctatcgcctgtacagaagcccttgacggctccgatttttcaggcgcttttgttgcttgtgcttttgccattagctcaacctctctttcagttataatattttccaaaggctgcggcttcgtattgccgaaccctcttatttctgttttcatatttgcgttatttctgtaaaacataataagcgtatcaagcgctttattaaaaatagattttgcggcagtcggaacggagggcgtaaaatctattacgcccgttttaccgcttccaacccagccactcacaaactcgttgaaatttgaccttatacctatacgccgatattccgtaacctttttataaaagaaatcgttgcattgtgtttgtattcccaaaatcaacgtgcctgtctgcggattatacataaaacggcggttttggattttctgaatatcaaatgtttccgtattagtatcaatccgcataattccgtttgttatgtcaatacgtttcatcagataccaaacctcataggctcaaatcgtttttttgccttaacggtacggattgcgtcttttcggattttgacttattttccgcaagctgctgacgaattgacggctttttttcttctgtttttacagcgtctttctgttcagcttcaatatcgggtatagagcttatacggtattcgtcaggaatatcatcacggctgccgttgtatatctctttaaaatcactttgattacacacaacataaccgtaatccgtaaatacaccgttttcattcagcgcagtatcatctccatactccttataatcaatgtaattttccaatgctttcagtgtgttcatatcataacagcccaattcattgataaggtaatatcccaaatcatactcgtctgtaatatctggatatatttcgtagcaatcaagattttcagttagatttatcaaatcctgtacactgtctgaatgttcgcccattttaacgatagccttaaaatgctgtacttccgcgtccgacatttcatctaatttgtctgcgagataatttaattcgtcaaggctctcatattcgctcaacatatcatatatcccgtcaatataacaatcatagtctgtaataaaccattcctcatacggcgaaccgaatacatcttttccgcctatacctatacgcctaaatacatcttgcatttcatcaggagtaacagggaacttcacccattcgcctactaaatatccctcgttatattttccaagattggtaacataagcggccaagtgaaaatctggtgtgccttctgtatctgccatatatcaacctcactttccgtcaaaatccagcctgaaatgtacatacttatcgttgctgtcgattaaaaccacgtccgcgtcataggtcttatcctttttctcggaatacaagccttttacctttgttctgccttttgcgagcaaatcagacgccattttctttgtaatctcttttcgcttgcttgtgaaaaacctgtcatttttccacataacgaatttacagcttttattagcgcaataaaagttatttttgctttcgtgtacgtccgaaccgcagcggggacatataccgataacctcacgcggcgcgcggaatatcgctctgtcctcgtctgtgatgaatgaatatgtggttacaagctcccttgtcaaatcctcaattcctttcataaactgctccggcggataattgccctttgcaatctcggcaaggttattttcccaatcggacgttagaataggtgatgtgagcttttcgggaagaacgctgacaagacttataccgttatgagttgcaacaatagacttgcccttacgctctgcaaaacctgtctgtaccagcttttctataattgccgctcttgtcgccggcgttcccaagcccttgcgttccgcttcgtccgttgtttcggcggctcctgccgtttccattgatgataatagagtgtcctccgtaaacgctttcggcggtgaggtataaccctctttgacttctgatgaaacggtaacggtttcgccttttgtaatacaaaatacatcttcggcgcggtctgtgtccgaatgaatatatcttttaaaaagctgttcgatatttttccagccctcaaataaaatgattttaccctttgccgtaaactgtacgccgccgcactccaaaactgcggtaatcgtttcatactcatacggggaattaaccgcacataacagcttgcacataataaggtgaagtatattactttcgccgtttggtatttccgccaagctgatattttcaatttctgccgtcggaataatagcgtggtggtctgataccttttcattattgaataagcagaatgtatcaggcttaaaatccgtacagtttgagaacggcgcgaattttgacgctatatgaacgattttaataacagtattgtgcatatcgtccgttaaatatcggctgtcggttctcggatatgtaatcagcttcttttcataaagcgattgagcatagtcaagcgtctgtttcgccgtatatccgaatattcggtttgcttcgcgctgtaatgttgtgaggtcaaacagtttcggcgcgcctgttttctttttctctttaacagcggaaatacaaacggcctgcctttcgtggcaagccgcttgtaaattctgcgcttcgtctttgtcggaaatcttatcgcttacagccttaatattgccgccgtcaatttcaacggtataatatttttctttcctgaacattgaaattttgctgtcccgttctgctatcatagcaagggtaggcgtctgaacgcgtcctatattcaaatgctttctatacagtgatgtaaacagtcttgttgcgtttataccgataatccaatcagcttttgcgcggcataacgcggaattataaagattatcatactcgcgtccgtctttgaggttattaaatccctcgcggattgcgctttcttccattgaggaaatccataaacggaagtacggctttttgcagccacacatattatatacaaatctgaaaatcaattcgccctcgcgtcctgcgtcgcacccgtttataatctcggttatgtcgtttcggttcattaaaccgctgacaaccttatactgattttccttgcccttgtttatggcaaactgccatttttcaggtaggataggtaaatcctcatatttccataccgcgtatttttcatcatacgccgctgcgtccgccaagcctgcaagatgtccgatacaccaagtaatgatatatccgtttccctcaaaatatccgcttttcttagcggttatgttcaaagcctttgcgtagctctgggctgccgacggcttttccgcaattactaatttcatttatttaatcattcctcctttatttttacatacaaaaacagcacccaacaatgagtgctgtttttgtggttgtatattatcctttataaaacagttataatatcctctgaaataccgtatttttttgcaactgcttttactaacgctctttctgaatggtattccgtattatccactaatgtttggtcgtcatataattcctcatcatcttcatcaaataacattatatgctcaactcgatatatgccaattaagttttctggcatttctatggataattcaacacgtcctatttctcctattacatcaggtagtccgctatcatctaccgcccaaacttcaccatcactaactacaatcattccattacctgtatattcatcaaccttactcatatacaatctcctttctacttgttagtaagtataaaatttcttgaataaatattatatcataaacaaagtaatattgcaatatattttattcatcttctgtatatgtatcgtcctcgttttcggtttcctcgtcctcgccgtcggtaaattcaaaatcttccaaatcgggggcgttttccatattcttttttggaagataaaccttgaaatagtacgcgccaagaccgcctatacctataatcgcaatcagaataagcattatacttgaattgcctgactttgatttatcggttttcggcgcggttttcgtcttaccgtccggctccgccgacggcgacgcctgcgcctgcggtgtagggcttgcttttactgctgcgggtactgccgcgctgttttcctttgcaagcgcttcaaggtcggatatatcaaccttattcaagaaatacacattatcgtttacattctgcttgtcgataacgataaaaaatacgctgccgtcctttgcggttacgcttataaactgcaatttatcactgtcggaaatgttgtctacaacgtgccccgcgcccgctgttgatatggtacgcgccggcttcggcgtttccgttgccgccggcgctgctgctgtactgtcatagtttgcgtgtgcggttattccgcacattccgccaaagcataataaagctgctgataatatcgcaataattttattcttcattcgtgccgtcctcctgctgctcgttttcctcaatagcctttaattcctcctcgtactcttcgggaagaagaacatcaccctttgcatacgcgcttaaaagtacggtaagctggggagtgctaagtttaacagccttaacgagatttacaatctgcaaattctcggcttcgactttctgcgcttcaagattgcgtaatttttgctgatactcgcttatctttgcttttgtccttataatatccttttcgattttttcaagtgttgccataattaaaatacctccataaaattaaattttttgttttgcgataaattcatcaatctttttatcgacttcggaaaatgtattcccatatttgaacttttgacttgcaaggtttttgtcctttgataatatttcaagctcattccataggtcagggtggtattgcttcaaatatgcaaactcgccgtaagtcgcgttaggacagaaccaacaaccgccccttttgtgatacttatatattggggacagcaaatcatacttgctgcataaatcataagccatttgttcagtatagccatattcggcaagtaatgatattttatttgtaccgtcaagccttgtaagcctcgccggttcgtctgcggctattccgacatattgtacaaatccgccatttacatttttcaaataatcctgaattgcttttatttttatacggctgttaattgtacacattccacctatcggaaaaccgctttttcttccatttcttaacggatttttagattttgtgattatctgatgaaaacaatctaaataatcttttgtcgcgtgtaatatttcaaccgtataaccccattcttcaaaaacgggaatagctctgtttttgataaagtctatatgttcgggtaattcgcctgaaataccgcgtttcttatcaaacattacctcgctgaaaatgacggttgacggcggcaagttatgaatatgactaagtattattgccgccgtactgtccttgccaccgctccaactgtaaagataacgcatatcaaccgcccccaagtctgccaaaggcgtaaaaatgcgaactccaataggaactatcaatactcgcgtactgaatagggttgccgcaatgtatcatcataccgttaccgacaaatattccgacgtgggttacaggctcgcccgcgttatatgtgcctgtaaaaaatataatgtcgccgggttttgcgtccgctcttgacacaaccgcgcattgattaaaaataccctgcgctgttgtacgggatagaggatatacgcctgacgcctgatatacccagcatacaaaaccgctgcaatcaaaactcgttgacggtgaagaaccgccccatacatacggataacctaagtatttttcggcttccgttataagacgtcggaatgtagcgtcgtttaatgcttcgccgggtatggtataactcggcggcgctgccggattagaataaatatcgtccgcaaataaataatcgcggttgcccttgctttcaagatatataccgtataattcccgctggtcgtccgtaaggttcgtatttgtaagcatagtaatattcttgtttacaagcgtaacattgagtattttatattccttgtcgttgccctcgtcgtccgtccttgtttccgtctgagatgtaagcgttaatatatactgctgttcaaacaaatcatcaagcggctgttttacatcatcaaaagtgaaatccatatacaacgccgtgaggtaggaaatgagctcatacggattatggcctatctgcgccaaatcgtaattgtattcgtcataacctccgtaatcgcgttcaatattgtttatctcactttgtaaaccgctttcaaggtctttgtaatagttttccgccgcgtatatatcttcgtcctccgcaaagtatgacgataccataattgagttaaagcccgttgtacccataaccgcgcaagatgaaattgtagttgctatccaagcaattattaaagcaatagcaagaatgacgccgaatacctttttatgacgctttataaattcaacaacgtacaccgtaacgtcctttgtggtctttgcggctcgttttgcctttttagcgttctgttcggcgcgcttcgcctgctggtattttttcttaatctgctttttctgaaaaaatttcctcaaagctgattttttcttgaaatcgggattatccgcaagtgttttttgaacaaaggcctttgcttccgctttctctgctctgaattgcagacgcgccgcttttttatacggcgcgtttttgcggttttgtataatcatacgccctgtacggtttccaaaccgtaaaatgctttcggctttctgttctgtcttatgcgcggcttcaattcctgtattttcgtgttctgtttcgctcacttttgaatgtgccttgtttaatacggtcatacctgccatatccgccgcattttttacaggggaacggtggtatatatcggattgaggcttaatctctttttcaaatttcagacgggttttagctttctttttcttttcatcataaacacgctgctttttaaccttgcgcttatgaggtaatttgttttgtgctttttccgccttgcctttgagcttatcggctttcgcctgcgccttttccgctcgcttaaactgaaaatcgcccttttcgggaatatctaaaacagtatcggcgttttccgccgactctgttttggattgcttttcctgatataagcggtttttgcttccggctgtctgtttttcggttttatcctctgacggacggaatgaaaattccgtcttgctttcccgcgtttcaaaaacaaaatcctctttttccgttactctgtcaaaaaccgtatcgcctgcgtcaaccgcttctttgatgttgtactctgctgttttttcggtcttgacgcgctttttctgataggctcggtttttatccggctgcttcggattgccgtctgcggaatccttttcggaatccgcgccgagctgaaaatccgaattgccgtttacacggtcaaacgcttcatcaggattatgtgtttgctcggtaaagtcataatttccgttatcttttaaggcttcggcactatccggctgcgtttcttccgccgtactatctgcggaatgttcagtaatatcaacatcaaatttcttttgattaaatttgcgctgataccgtttatttcttgccgccgtagttacggcattagaaaaaccgccacttttgggcggctcgtttgtcggcggggaatatggtatatccggctgactatcaaggttaatattctctaagtcctcttgctgttctgtattattttcggtaggctttaatatttcctgactgtctgacggattttgtacggtagaagtatcaagcggcttttcggtatctaaaaatttctgctgatacctattatgttctgaagaagtaaagggcttcgcgctgccttttgcgctctgccgtccgagaacggtatcggcttcaaccttttttgaaaaatccgtgtccttattccgcgccttaaattcattgtctttcattcattacctccgctgttaaagttcgagattatcgcgcttttttgtctgcgtcggcttcggcacgcttttctctgccgccttaatggaatttaactccttgcggattgacggctttttatctgcgcttcggctgatattttccgtctttgccgcttcctgagctttttgcattttctctgtaacatatccgggtagaagatgttcgtgtaccataaaggatttttcatattctttcggaatgggcggggaaatttccgtgaataaatgtgaataggcttttattctgccttgtatatatttttccgcttccgccttatccttaaatgagcgttcttgttctgcaatacagttattatgaccaactggactatttgtgccaatagaccatttcacttcccagcgtcttgttttttctgaacgccagcttgtgtaatcatacatacggtatgtcattttatataccatattactgatagatgtacaatcgtagttataacaatctctgtcgtttacccatttatttgaagaatgcgaaacctccggtacttgcaaatactcaatagccctgtcaaattgtcttgtaattgccgcttttttttcccaatcccgcgctgactgccgtactttttcaaaggcggctgtttcttttttgacgttattatcacgcatagcctgtattttttcaagcggttgtgaaatcaaattcaatatatcggtttcattaacgattatggtatgctcaactttaagtgtggcgccggctgataaatcgtcattttcataagtacggtaattatcgtaatctttgtacatatatacctcctgacattttttattctaattcctttaatcggatagggcttacaatctcatagccgcgtcttgcggcaagctcggcaatatcggcaatcagctttttgcgttccgcgcgctctatattcctgattgcttcatacgccgtaaaatccttgcacccgctgccgttaagaaaatccttgttttctctgcttatatctgctcacctccaaactcacaatatttcttacatcttcccgtttcaatatctgaaatgaatttaagtatagggaacacctgcggaggacatacggcattacctaaggcttttagcctgtcggctctgccgtccgtcctgtccgttatacgcggaacgccgacaggttcccgttcccacaacttaaatccgtccattgcttcgggaaccccattaaccattccacccaatcgggattgagcgccgccgtctccgactgcggctgttcctctaatatcacctgcgccgcaaggttcgccccgtccttgcttttcctcattacctccggcggaaattttgaccttatcccgtccgacgctaccggcgtcatatagaacaccgccgccgacagcggaaggctccagattgcgccgtttttgttcttcttccgaaatatcccgttgtctgaaagatacacattcatatttacagccgccgtctgctttttgttgttgtcggaggcaagcggagtgggaaacatcaacgccgacgataaaagttcttgtgcgctgatgccacgcgccgacaccgcaagctggtaatacgaatgtttgaacagtgtagcccgctttttccaagtcaaaaatcgttttgtcgagccccatattgatgaacccagcaacattttcgccaagcacccagcggggcttgagctctgtaatgacgcggcacatttcaggccacaagtagcgggtatcttcaaaccctttttgtttccccgcgcttgaaaacggctgacagggaaatccgccgctaatgagggtaacgctgtttcgtcctgttttttcaaaaaatacctcctttgttagagttgtaatatcacgaaatcggggcacgcgaggccaccgcttttcaagtatggaagtctggaaatccgcccattcacattggcagacggttttaaaccccgctgcttctgcggcgaggtctattccgcctatacctgtaaacaggcttaaatgcgttaaatcattcatctttctgtatttcctccggcttcgtcgtcatatacgaatacagcttcaagtctttcgggaaacggtctacaaacggaatgattacatttccgtaaaataaaagtccctcgccctcgcccgactgcgttacatacgataattggtgaggggatatattaagctgcttcgctaaaatctgtctgtcgccgcctgcctgattgagcatatagataaaatcggaattttcaaaaatattctcaatctctcttgacgataacaggtctttgacattctgcgttatgcctgtcggaataccgccccatttacgaaagcgtttccaaatctcaaccgaatatgccgccgtctgttcctcctttaacagtaaatgaaattcgtctacataataccgcgtcgccttatgctccgcgcggttaattgttactctgttccatacctgatcctgaacaatcagcatacccagctttttaagctgcttgccgagctctttaatgtcatagcagacaatacggttatttacatttacatttgtacggtgattaaacacgtttaatgaaccgtttacatacaaatcaagcgccgacgcgatacgctgcgcttccggctccggcatagctttaagctcgttatataaatcttccaaaatcggcattttagacggttcgggattagcgaggtacggacggtatatatttataaccgctctgtcaatcacgcttttttcaatcggttcaagtccgttcttgccgccgacaataagctcacacaatgaaagtataaaatctgattttaattgtacgggattttcgtcctcgctgtaattgaggttaatgtccattggattgatataatcgtgcgagttcggggaaatccgtataatctgaccgttaagccttgacacaagcggcgcgtactccgcttccggatcgcatataattatatcgtcctgcgttacaaggaaagcgttagcaatctctcttttcgcgctgaatgatttaccactgccgggtgtgcctaaaattaagccattcggatttttgagcttctttcggtcaacaagtatcatattatttgataatgcgtttaaaccgtaatataacgcttcatcgccggcttgaaaaagctcctgcgtagtaaagggtacaaaaatagcggttgacgaggtagtcaatccgcgttgtatctctatttgatttaatccgataggcacgcttgacattagcgcctgttcctgctggaagtcaagacgctttaatgcacagttatatttttgagcgataccctgcgccgcgaaaaacatattatcaagtttttgtttgttatccgccgtattcatcacaagaacagtaacaaggaacattctttcatttctgctctgcaactgctctaataaattctttgcttcaccgccgaatgtcgcaaggtctgacggtataatatccatatcataaccgcttctgaccgcctttttctgttcctcaatcttcatcttgtcaaggtcggttattttccgcttgaccgtctttatagcttccgactggtcgatagacttaatatgaatatttacgcctattcccatatcgaggtcgaggaaatccgcaagcatacggtctgttaattcaggcgcgagtatctgtaaaaatgatacagttccaattctgccgcccattccaaacgtgcggctgtcgcggaaatcaaacgaggtaggcgcaataaaatcctttgaggaaagccccgtcttatgtaccaaatcccaatgaaagccgaatttgtctttttcgccctcattgaaagtacagtgtaaaagctctaaacgctctaatccgttaagcggtcttgcctgtacgccaagagccttgaagttgccgagtatatctgtttcgatacgctctaacttctgcttagccgcctttaagttatccgcttcaattccgaatgtgataaatttgcgctttataataccgttgtttccgcgcgacaactgatttttgagcatacccatatactcaatgcgtatgtcattaaaattgtctgcctgttcgggaatatgtacggctttttcatactccgccatatcgacagtctgattgaggaaagaaaactgtacagaaattgactggtcgaaatagttaagaaaatcgcagtagttttcaaatatctcgtttttatcctcattccttgcaagctgataatttatatcgaaaaactgaattgtttttgtaaaataattatccttgactttacatatcccgtccgggtacatttccttatatggaatagtctgctgtgctgacgctgcgcgcctgccctgcatttgcgcttttctgatagctgccgcaatagcctttttctgtcgtgctgaaagcggcttattcgctgatattatgtgctttttcttttgttttggtcttgtgtttgtattctgcttcggcaattattttgacctccttatcaagtttaatttggttcataattgccgaatacatattatttgttttatacggtctgactctcggcgtcaaaaatcttgaccgtatataatttcttaaaatcttttctgccggctgtccgtccttttcgtacatagcgaggaagaagaacggcaaggccgcgattacaagcgtcataaccgcgccggttgtgccaagcgcgccgcgcgtaagaaagtatgtcggaacagcgacagcggccgcaagtccaaagcatataagctgacgcttcgtaaggttaaaagctacctttgtttttacggtagttaaatcttttggtacgggaacataaggaataaaaattccccctttcatttttttatttttaatgtgcgttaaatattgactttgacagattacctgtcttgaacagggaaaagcatagtacaaccgtatatgccgcaatcgtaaatatggtagtatgcagattattggttacaacaaaaccgtttaccaacgccgcataaatgcctacgcataccataatgaaaaatccctgaaagcctaatgccacaagtccgcgcaaatagttatttcccatttgcccccattcgcgattagtcattgtcgcaaacgggatagctccaaccgagcaatataaataaatctctatcatacgtccgaatattacgacggtaatacaaacggatagaattttcatacataaactaacaagcgaggtttccaaaactaataggaacagttcgcccattcccatagcttcaagagtagttcgtatgtcggcaagcgcggaagatatatcaatgttcgtgttcgcaccgattacccccgcgctgttcgttacaatatgctgcgcaacgtcaaataccgccatagtaatgtcaaaggtgtgggtaacaatataaattgctaccccagcctttaagaaatatttgaagaacataaacgtgtctatatcgtgcatattgttcttttccgtaatcatagttattagctcatagcataagacaaaggctataataagccccgcaatcggcagaataaccgtctgagaaatattctgtatcaaagaaaatatgcttgcgttccagccctgcggcgtctgtccgacgtccgccgcaatcgtggcgactttctcgtttacgtcattaaacattgttgataaactaccctcaataagcgaaatcagaaaatcgcaaatcgcttgtgtaattttatcaattattgagttcatcagctaaacagccctgagagcaagggaacaagtgtagttccaatcagcacgacgccgccgcccgccataagctgtttaattccctgcgactttgcgccgggattatcgttgccgtatccctccaagagattgacaacaccccaaaccgcgaggcctgcgcctaacgcgattacaagagtttttaaaacattgaccgcttctgtgaaaaattgcataaataaaatcctcctaaattttaatctgtctttttttcttcgtccggcacatctacattgtaaaggtcgaattgttcattttcctttacaaccgccggtctgcggttcaaaaatcgttcaatgtcaaactcgtttttcttgtctgcgtctgataaatacttatagcgcgggtgcgccgttatatcgtacttttcagacaaaaacggacggacgccccttaattgcaaaatgcacttgccgccgtccattaccgataattcgtcctgcgtcatcagctcctttcctaatttttgataattaagtccgtaagatttttgattacttcgcgtttcggaagtattgtacatatcaatcgtttctttgccgagcgtttcggaaatctctttaagagtagttttctctttacctccgagaaatagggtagtatcgcaattacctataatcgtgtcggcgttatccttgtaaatagcttttagctgactttgcgcctgcaagattattgacgccgatatttctcggcttcttattgtggcaatcagcttttcaaattttggtatttgtccgatattcgccatttcatcaagcagaaatctaacgtgtacgggaagtctgccgccgtaaacgtcgtccgccttatcacaaagcagattgaataactgcgtgtacatcatagcgactatgaaattaaaagtatcgtccgtatcggaaatgataacgaacaacgccgttttcctgtcgccgattttgtcgagctccaattcgtcatattccattaagtccctgagttccttaaatagcgataggtaatcctttgatgttatctccggattttcccccgccctaaaccgggcatgaacctttcagctcacccggcttgccatcaggaacagaatttatttcatctcaataactctcaacgtggacaaggcttcttaacttattgagtttttctttctgcttttggtcaaggcctaggatttccatatactttctgataatatcagggtttgtagcatgaatcaggtgatgtacatcttcacataccaacaccagattttgataattgtccttgccgcctaaataccgtggcactttgtgatggcaatgaatatcgccaatagaaagcactttgccagatacggcgcattttcccatttgggccgaatacagtgaaagcctgttatcgttgtattcgatagtacggtacagaaccgggttcctcattaagtaatgaagaaccgtcatgtcgattctgtccagattcttatggatttcggctctgccctcgggcatataggaattgattttgcggttcatggactttgggggcttgtgccgtatgtagccaatcgggacaactgcgtgtccggctacatatcggagctgtttgcttttcccataccgttccctgataactttcggaacttcacacggaatcttcctttttctgacctgttttgcagttttaacccgttctttcagtcttgcccgcaggctcttgtggacagataaggcgaatggcgtaaggtcatcgcagacctttgtggctaattgatagtagtcatggattcccattacataaacgttgtagcggcaaatcgcctgatattcagtacgtttgccttgtgacgggaactcaatgtcgtaaatcagccgttttaagtttggttttattttcgcaatagatttctctctgatatggctctctactacatatttggcgcgtccgttgctccgtttcccacgggggataacctttaacttgaaaccaagaaactctgaatactgctctttcaggttaatcaccttcgatttttcaggactgatttcaagagaaagcctttcatggagccagcttttggttgcgtggaataacttcaccgcattttgatagctgttcgtgaatatcttaaaatcatcagcgtatcggacgcaggtgacttctttcagccttgtcctccgcagtgcggcaaatttatggctcttgctcacgcttccgttgtaattgaccgattccttgtaagggaactccgttggtatttcttcccattggctggcaagccaccaatccaattcgtttagaactacattggatagcaggggagagataatacctccctgcggcgtacccacctccgggaatcctatcccggccacctccgcttttagcatagctgatataatactaagcagcttcttgtcttggattcccattgtccagagctgtttcagcagttttccgtggttcacgttgtcaaagaaccccttaacatctatgtctacgacatagtggagattgcttctctgcatatttttgtgaacctgggcgattgcgtgctgttggtttcggttagggcggaatccataactgtggtcgtggaatttcgcctcacatatcggctccatgacctgcaatacgcactgttgtatcagcctgtccataatcgtcggtattccgagcgggcgcttcttcattgggtcatttcctttcggaatttctacccgccggacgctttgtgggacataccagtttaatttgcgctgtatggcgcatataagctgttcatcagagagtgctgataattctgtgattgtttttccatctgtgccgggcgtcgtactcccgtggttcttcttgatgttgcggtatgccagccgtatgttttcgggtaatgcaatgatttcaaccagatgtttgaaaactttgcctttattgctgtcggcatacagcttatcttgaattgcctggaagtcataatactcggcgtgccttaacttatctttcttctttgcctttcctgttgccatagtcggttacttatccccactttcgtttggattttcgcctttcttagtcctactcgaacctatgcgtgtttattgaatatgattttgtttctgttcctgactacagcccgtccctccaccgcttactttgttcacggcttcacaggtagcatggctgctctttcctcccggattaagaacggttataccgcacctcccataaaaggcggcacgattttcccgcccattgcttcatcatgcgtatccactccacatccggggctttccacgttccgatattcctatctttgcataatacccttaaccctgccctttaggcctgtatgcctgatggtgcctgtaacaccatagggaatttcatatcgacaaatcttactttaccccacatacgccgttttcacggctatggcatttctgccatatcccgttatagacctgtacattcgggcttttgtcagcggtagtcagccgcattctggacataggtactttatagacctccggcctaacacccccggccacctctggctcggctttgctttatcccccaaaggggacagtcgcgggtgcagacagccgacttcagcgtgctgtgtcagtcgcgggaaatacgtcccgtttcttccaacgcagtatcaagggaagcgtttcagggcgttaccccgccattccacttctcggaatatcagttagaaaggctatagcctttccgtcacttttacctctttgcaggaaaatcccacgcagagtttatatgcgacaacgtgtcgctgcactgtcgattttgctgaccctatggcaagatataaagagataacagagcaaacaacaaaatcgaatcctgaaacaatgggcagatttcatacaaattggcttaatatgatgtatcctagattaaggttagcagcaaatttgcttagagatgacggtgttatttttattagtattgatgataatgaggtagacaatttaaagaaaatttgtaatgagatttttggtgaagaaaattttattggatgcattgcaaattcaaataatccaaaaggtagatctgatgataaatatatagctacagcgcacgaatatgttatagtttatgcaaaacatgtagatacattaaagtggtatggatttgagccgtcagaagaaataataaaaagatataataaagtagataaaaatggaaagaaatatagagaaattgatttaagaaaaacgggtgaaaacgatcttagagaagacagacccaaccttttttattatttttattataatgagataacaggagaattttatccgtcaagattagaagaaaagaacgatggatttattcaaataaaacctcagagggaagacggaaaagaaggaaattggcgatggggattagatacagcagagaaacagttagatttacttgttcctaaatttatgccagcccgtaaagtatggggggtaatgacaaaagattatttagaaggtagatcattagttaagccaactagttcttggacatttaaagatgtgaatagtgaacggggcagtgaagaatttataaatttaggatttgataaaagaacttttcccaaacctaaaccaataggaacaatcttgcgttgtatcaagttatgtacaaacaataatgatagcgatgacataattctggattttttcagtggtagcgctacaactgctcacgctgttatgcagttaaatgcagaggacggaggaaacagaagatttatatgtgtgcaattgccggaactttgtgatgaaaaatcagaagcgtataaagcaggatataaaaacatctgtgaaataggcaaagaacgtattcgacgtgccggaaagaaaattattgaagaaaaaggcgatcagattggaatagacgacgaagaaaagaagccgcttgatataggttttaaggtattcaaacttgatacctcaaatcttagaatatgggataatacgcctattacaggtgataatcagatagagatgtttacagagcgtatgaactctatgatagacagtatcaaagacgacagaactgatatggatgttgtctatgaggttatgctgaaaatgggagttccgcttgatgtccctgttcaatacataggagttaacgaaaaagtagtttataaagtagtttataaagtagttcatattgtaggcgacttccttttaatgattgcactatttgataatataacagcagaagatattgaagcaatagctgaatatgctccggcaaaaattatttgtgccgaacacggatttgcagacgattccgcattgtcaaacgcacattatattttgaaggatagacaaattgaattgaaactgatatgatgtacatgggttccgtaggggcggattccatatccgcccgaacaaccaacccacaaaatatattttgcccggtatgtgcggattcaatatccgctcgcataatcaaaaacacatttatacaaacaattaatatgtatgaatatatacattgtccgatttatgttgtaatgccaaaccatttccattgtataattgcaatacaaagggatggggaaaatgcggcggatatagaatcacgggcggatatggaaacacgggcggatatggaatccgcccctacggtgtcgctgccggatgtaatacaatcttttaaacgacattcaacaatagaatatataaaattggttaaacaaaatattttgccgccgtttgataaacagatttggcagcgtggatattatgaacatatcatacgcaatgaacatgaatatcaaaaaatatatgaatacatagaaaataatccaattaaatgggaagaggacaaatattatgaataataaattagacggactttcaatggatttagaaaactcaaatatggagaaattaaagactgtgttcccggaatgtttttcagagggaaagcttgatatagacaagctgttgtcactgtgcggtgaatacatagaagatgattttgaaaaatataaatttgagtggaagggcaaagcggaatgtttacatcttgcacagaagcgttctacgggaacactaagaccttgccgtgaagaaagcgtaaattttgatgataccaataatgtttatatagaaggcgataaccttgaggtgttaaagctgttgcaaacagcttattacaataaggtgaagatgatatatattgacccgccgtataacaccggcaatgattttgtgtaaggtgaatccacatcgcacgcttgcgtgcacaacccaaaaacaaatttataaaacataaaaactcaaataaaaaataaaaatcaatgaacaacggcaggtaagcggagcgaacgcgtgaggtgaatcccaccgcacgcttgcgtgcacaacccaaaaacaaccttataaattccagtttataattattttataaaattttaataaaaattcaggaacaaaatagtattaaactgagtcatattataaagtgttaagaacttaaaggcaaaatataaagtccagataaaatataaaacataattaataataaaaatatacaatttgacggaccataaattacctttgtttcttttacataacatttgccgatttttcttgacttgtgacggcatatgtggtaaaacataatagaattttattttataatggaggaaaaaacatgagacatttaaaagacatagcgttagcagtggctttatgcatgattatatcaattgtgccaatagtatcttttgcggacgttatagacggtacaaattctgatatcgttacggcagcggatacaacagacccggaggcaacagcaacagcagaaccttcagcaactcctgattcagcagatccaacaagttcgcctgaagcttctgaggctcctgattcatcagaaagcccggttcctaccgctactgctacagcttcgaattcaagctcaactccggcgccgacttcaacggctaagccgaatggaaagtatagcataaacgttaataagacagaaaagtcaacaatagttccatcgccttcagcagcggcttccggctcaaaagtaataattaaaggaaacgctgacagaggatataaatatacagacgcttattatgtagattctaaagagaataagacttctttaataagtaatgacagcaactcattctctaagacgattactatgccggcgtctgatattacggtttattcaacagtagaggaaatgtcagcgagcgagctttacgaggacgcagttgatcagtatgacactgttactgccgacataaatagttatactaagacatatattaataattcttctgattataattccagtgatatatcagatatgaaaaaacttattacatcagctaaggcatatttgtctgatttaaaatcaaattataatgtgcttaaagaagaaattgatgacaaaaatcccacaaagagcactatgagtgatgttatttattcacaggaagaccttgatgatgtctcagctgagcttaaagaattatctgattctatgggcggtgaggatgtcgactattttgacatgacagttactgttggaaaaggcggaaagctcactttatctggacttgtttcaggaacagtaaatggttttagctcaaagactacagatacatttgacgaaatatataacgacggctcaagttctattacatttaagataaatactcagaatggatattcactttctagttttaaaataaatggaaaaacagtaacagtttcaggaaacaccgttacaattaagcagtcagctctatcaaattatatttcaggcggtacaatgtccgttgtagctaattttggatattcaaacggcagcggtagtggcggaacaggcggaaatacttataatcctgttataaaagatcccgctacacctaccccggctccaggaaataattctgtgtttaccgacttaggttcagtaagctgggcagaacagtcaatcatggctctttataatatgggtattgtaaacggaatgggcgatggattgtttgaaccaagcgcgcctgttacccgtgaacagtttgcaaagatgattgttggtgttatgggataccaggttgatcagaacgcaaccacagaattcagcgacgctaacggagactggtatacaccttatattgcggcggctgttgaacatggaataattacaggccgtgatgacggcacatttggcgttggacagaatattacgcgtgaagatattgccgttataatattcagaactcaaggttcacctgcagctgagatgcacgagttcccggattcagaccaaataagcgactatgctgaaggcgctgtgtcttatctgtacagcacaggtatagccaggggtgatgataatggatacttcaatccgaagaattcggctacaagggctgaagcatcaaagatgctctttggactgtatggaataatcaattccaaataaattttttaaaaagcatggcgccgccttatttttaggcggcgctattttatgttttatatatttataattactataatataaataataaaaatatatacataattgccaaaatggtcgttttttaattagtattttttcttgtttattgaaattcaggaacttttatgctatactaaaagtctaatgagaaatggatttactgagtataattaaatgataatgttaacaagccgttaaagttatagattatatttattttttattgcggtttcaattaacattttgaatgtgggtcaaagacatatatttgtattcaggagtacgattgtttggttgaaaatttgttataaaggaatgtgaatttgttttgaaaagattttgtttaaatttgtttcttctcattggaatattaataatttgcggtacatataccatatccgtatacgcatatgttgatgacagccagcttgagcttgcaacagatgcttttggcgaagtgggtgcaacaattgaatataagtatccggaggacactttaactgttgaaaaagacggtcaggttgctgttatgaagttaaggagccgtcttatatatagagacggtgaatattttccgcttgaacgagaggttgttgtatataacgacagggcttatgtttcaccggatgccgttgaaaaagcatttggtcttcagccggaaagaacaattgatccttcaaaacctatggtgtgtttaacttttgatgacggaccttattctccggtaaccgattctatattggatattttggagacatataattcaaaggctacgttttttgtggtaggaaatatgatatggcagtaccctcagaccttgaaaagagctcaggagcttggtatgggactgggaaaccatacatattatcatcctcatcttccaaaatgttcgtgggatcaggtggttaatgaaataaatatgactaatctcgatgctaaaattgttttaggagacgatttgaaaatggttcgccctcctcatggtgaaacaaatgatatggtgaggtcggccataggtcagccgataataaaatggtctttggacactttggattggtcaaacctgaattcagggacaatttattggacggttatgaataatgttaccgacggtgacataatattgatgcatgacctgcttgactgcacaaaagaagctgtttcgtggatggttcctgatttgttggaaagaggatatcagattgttactgttgaagaaatgataagggctaaaggatggactttggaccctggtgttgaatattattcagttaaaccttagtttataaaaaatataaaaatacatataggaagaatattatgaataatgaagattacgtaagtcaaaatgataaaatttatggacgaaacccggttattgaagctcttgaatccggtcgtacaatagacaggctgtatatacaggaaaagttaaaccatcccgtaattggaaaaatcagaaatatagcgaaagagcaaggtgtccgttatcagtttaccgctaagcaaaagctggataaaatgactgacggcgctaatcaccaaggggtggtggcagtgactgcttttcacgattatgtgagcgttgaagaaattcttaaacgtgcggaagaacgtggagaatccccttttatagttatatgcgaggggctgagcgaccctcataatttgggtagcataataagaactgctaacgctgcaggcgcccacggagttataatacccaagaacagaagcgttgctcttaactcaactgtggcgaaagtgagcgcaggagcagtagaatatacttatgtggcaaaagtgtcaaatatttctcagacattggataagctgaaaaagaaaggcttgtggattgttgggactgacatttctgcggctcagaatcattatgaatgcgaccttaaaggcccgcttggaatagtcataggcagcgagggaagcggtatgagcagaatagtaagagagtcgtgcgattttttggttaagattcctatgataggagagattgaatcgttaaacgcgtctgtggctgccggaattttaatgtatgaagcattaagacagcgcagaaattagtagatttgttttgaggagaaatatttatgagaatacttgccataggagatatagttggaaaacccggaagagagtatgtttatcagaatttgggaagaatccgaagcaaatataatatagattttgttattgcaaacggagagaattcagctgcaacaaacggtataacgcctattatagctgatgagctggttaatgccggggccgatgtgataaccatggggaatcataccttcggtactaaatcagcagcacaggcgcttgaagaaaatcccaggctgattcgtcctctgaactatccgccggaatttgaagggagcggatatataatacaggatttggggtacgcaaaagttgcggttatcaatcttatcggcagagtaaatatgtctcctgcaaactgtcctttcagagctgtagagaatctcttaaagcggattgaaagtgatattatagttgttgatatgcatgcagagacaacaagtgagcgtttggctatgggcaattttttggacggtaaagttcaagttgtttttggcactcatacacatgttcagacggcagatgaacatattttgcccggcgggaccggatatatttcagatttagggatgaccggtataatggactctattttaggggttaagaaagaaattattttaaattattactataatgcaggaaagcattatcgttttgaaaaagaagaaaacggagacgtatggtttaacggttgtgtttttgagatagataataagacaaaaagtgtcgtagatattgaaagacttaggttcagcagaatttgaggtgtttgaatgaacagtgaatttaaagttttggaaaaggatgaacggagctatcttgtggcggagccttttgaaaagctgggtgttataaatggattttcacgcaggcttggtggggttagcagcggaaaaatcagcggtttaaattttggattcagagtaggcgacgattctgatgcggttttagaaaactatagactgcttgctgaagacttaggttttgatatacgccttggagtttgcgcaagacagatgcacacggataatatacgtattgttactgaaaatgactgtggaaagggaatttttcagcaggagagcgatattcgtgacacagacggtctgataacaaaccaaagaggtattgctttaataatattttcagccgattgcgtccctttgcttttttatgacccgattaaacaagttgttgcggcttcacatgccggttggcggggaactgttaaacaaatcggcggtaagactgtgcgtttaatgaaggaaaaatttggctcagaccctaaagatataattgccgctatcggaccgagtataggcaagtgctgttttgaggtggaccgtgataccgcttcattgtttgacgaaaaatattgtgtttcaaagccgaatagtaagtttcatgttgatttgtggtccgttaatagagataatttggtttcagaagggttagaacctataaatatttatatatcggatgagtgcacaatatgcaattcggataaatattactcatatcgtgtgcataaagaaaaaaccggacggcaggtggcggttattgctctgccttaatttttagatataggctataggcttcattttttgaaattcctaatatctcagaggcagtgcgggagagttcttttcctttcatgccgtcatttatcagtttaagtataaccgtttcagcatcgggcaaatccgctcggtgtttttcttttatttcctcagggtcagcgccttttattattagaacaaactcacctttgggaggattgttttcaaaatgttcaactgcgccttctaaagtagttcttatatattcctcatatttttttgttatttccctcgcggcggttatttgacgttcccctccgaatgtttcaagcatatcggcaagggtcgctttgagtttatgcggcgcttcatagaatatcatagttctcgtttcgttctttaaactgaggaggtgatctctgcggctttttttgtttaccgacaaaaatccttcaaaagtaaaccgtcctgttggaagtccggaagccacaagtgcagtggaaaaggcgcatggacccggaagagcttctactttgatttcattttgtacgcaaagcataacgatatcctctcccgggtctgagattccgggcattccggcgtctgtgaccacagctatattacatccgtctaaaagtttttcaattaaatgggcgcctttttcttttttgttatgttcataatagctggttattggcttttttattcccaaatgattcaataacttcatactgacccttgtgtcttcagctgcaatcaaatctacggattcaagtgttttaatagttctcagtgttatatcgtcaagatttccgattggggtcggacataaatataatttacctttcataactttctccttcgcttttatctttttattcggcggttctttcatatattaaattaatttcatcggtatattttgcgcctgtttcttcatatatatataaagggggctccaggacaagttttggccttccgcagtaggttccttctaaaagtatcattgtggcagtttttttataagaaggatgtacaaatctgagtcgtttaggttcaattttatagtttcgcataagtgtaacaaggtctatcaatcgttcaggacgatgtatcatagcaagctttccgccgggcattagcagttcagatgagctttttataatatcctcagcattacacagtatctcgtgcctggcaatcgccgcagaattgtgtttacttataagccctccgccatattctttgtatggaggattgcagactatattattgaaagaactttttccaaatatatcgctggcaaactttaagtctccgcagaccatattaatttttttagataaattatttaggattacagagcgtgatgccatatctgatacatctttttgaatttccaggccgattatttcttctgcggcagatttgtgagataatagtattgaaattataccgttaccggcacacatatccattgttctggaaccggattttatcccttttgaggcgaaatgtgccagcaatactgcgtccacgccaaaacaaaactgatttggattctgtatcagttttaaattatttaaatgaaggtcgtcaattctttcgtttttgtttaataaagtgttattcattgtattttaattccttttttgagttcatagaatattcatatttgcgcgtttatgttcataaaatgttaacatgtgcaaactgtataataaaaattgattttcattgtgcaaaataaacaaaagagtagtttgtttcagaaatataacaaaataaaatcaacgcaaattcggtgtttacgaaagctttatcttaaaatatttcttaatattacaactctgttacatttgtgttacaatgcaaaaaatgagttttttcgctataatttcctgatataatgccataaaaatagtataacagaaaagtggattgagcacaataaccaaaattggcaatcgtcaggaaaaaagaagagtaaataaaagaaaaaagctaaaattattagaatataagagaaaacatttgattttgtgccggtgctggatttaaacttgacttagacgatttgagacaattttgaaggtttgacggattttctaagtcaatatataatagccagcgtgacagagataaggaatattgttttattccaaaaatttatttgaggtgattcgatgtttacaagactgatgagaaagttacacttatcagccaaaaattgtgcagcagctgctttatgttcaacttttattgtggcaacatgctgtagttttgcatatgcaactccgagtaccgttacgatttgtgacggagacaatactccgattacggtaaaaacaagtgataccagcgttggtaaagttttagcaaagcaaggtatatcacttaatgagggcgacgaaacaaatgttgctttaaatgatacggtttcaaataattcagtaattcagattaacagagctataccggttagagttactataaacggtgttactaacgagtatagcacaacaaaaaagcttgtttcagatgttcttgctgatgttggcgttgaggcttccgatgatgaggtcacaccaagaatgacagatgttattgaagccggtgacgaaatcattgtaaaccaggaagagagccagatagtaacagtatctgaaagaatctcgtatcaaacagaagaagttgaaaatgtgaatttagctccgggtcagagagttgttacaagagaaggctctgacggagaaagagaaatcacatataagatttattatcaggacggcgctgagatatcaagagaaagaatcggtgaaattgtattagcagagccggtaaatgagatagttgaatattcaccgcaggaagaatttgaagttggaaaaatacctgcttctagacctacaaattattcaagagtagaaacatttacagcgacagcatatgacgcgtcttatgaagacaacggtccttgggccggcgttacatcaacaggtatgcctatgggatatggtgtaatcgcagttgacccgacggttattccttacggaacaaagatgtatattgagtctgctgatggaaaatatatttatggttacgccattgcaggagactgcggcggagctataaaaggcaagagagtagatttattctactggtctaaggctcagtgtaatgagtttggaagacgcgcagtaaatatttatttcttagattaataaaacatgaccgcctaagcttaggcggtctttttattttgattacaaaacctgaatattacttgacctttaatactaaaagtgttatcattatataaatttattgatggaggtatgacttatgtctaattattcaaaccaggataaaatacttgaaatactgcacaacgactgcagactgcccttagaagagatttcggtaatgaccggaatcgccgcacaagaagtcgccgccatcatcgacgatttagaaaaagacggtactattttaggttatggcgctaaaattaattgggataaagcggcaggcccggattctgttaccgcttatatagagcttcgcgttactccgcagagaaaccagggttttgatagaatagctgagagaatataccaatatcctgaggttaaatccgtcaaccttatgagcggaagttatgattttggaattactgttgaaggttctaatataaaagaaatttcgctttttgtgtcgcagcatttggctcctatggaatctgtagttggaaccgccactcattttgtcttaaaacgctataaatttgacggtatagtatgctcgcagccggagaaggatgaaagggaggtaatatccctatgagttttaatcctgaaaaaatgataaataaaacggtaagcagtatgccgccgtccggtataagacgtttttttgacgttgcggccgagatggaggactgcatatctttaggagttggagagcctgactttgtcactccgtggcatattagggacgagggaatttattctctggaaaagggacatacgcattatacttcaaattcgggattaaaagaacttagggttgaaatctgcaactatatgaaacgcagattttctttgaattataatcctgatgaccaggttgtggttactgtcggcggaagtgaggctatcgacctttttatacgttctatagttgagccgggcgatgaaattttggtatgtgagcctagctttgtgtgttacaaacctatagtatcattagccggaggaataccggtggttatagagacaaaggcagagaatgattttagattgacgcctgaggagctaaaatcggctataacagacagaaccagggccgttgtgcttccgtttccaaacaacccaaccggagctgttatgactaaggaagaccttgaaggaatagctgacgttttaagaggaacagatataatggtcttatcagatgaaatatatgctgaacttacatatggtgataaaagacatgtatctattgctgaaattgacggtatgtatgaaagaactgttgttgtcagcggtttttcaaaagcgtatgctatgacaggttggcggcttggatacgcggtaggtcatccggccttgataaaagctatgacaaaggttcatcagtatgcgataatgtctgcgcctacaaccgctcagtatgccgcaatagaggcgttaaaaaacggtgacagtgacatagaaacgatgagggatgaatataattaccgcagacaggttatagtcgcaggttttaacaagctagggcttagctgttttgagccgaagggcgcgttttattgtttcccatgcattaagagcacaggtatggattcaaatactttctgcgaaaacttattatacagcaagagactcgctgtagtgccgggcactgcatttggcgagagcggagaaggctttattaggtgttcatatgcttattcaataaaaaatataaatgaggctttaagcagaacagaagcatttttgaaagaaattaaaagatgattttccatactaaaattatggattattcgaaatgtactgtgataaaaataaatataaataacaaaactgattccttttaattgaggaatcagtttttgttttattgtgtattttataaaatgctaatttagatttttgtttttatctcgctttcatgggaaagaaatcaaatctcggctcaagaaattttaatctgtgttctgtttcgccgttagcttttgctaaatctgtaagggtgtcaaaaacatgctcccagttccatatgtctttgccaaatcctaaatattcacagagcagttcagtaccttttggagcgacagggtgcattagcaccatagcggtttttaccatatgcaaggtatctatcagcacttggtttctcttttccgtatcagcttccgcgtctttaatgttttttgcccaaaacttgtttgcgtctcttatatatgtgtccattaggttcataactgtgtggaactcaaacttatacatagcgtgttcatattttaatatggtctcttttgcagcgtgcagcacttcttcggaaacctgacccataggcataattggttctccgtatttttgaatggtataaaagcatgagcgcgctactctgttaaaaacattagataacattttgccttcacgctcaaccggatccgcgtctttttcgccggccgcaggattaagaggctttggctggaagctaacgctttttaagcttagtcctaaacctaaaaaatgcgctctcagctgttccgcagtataatactccagcaaatcctcagccattggaggcttaatatctccgctgctgcttgcttttttgttaagaaacaaaatatggttgttggcaacaagcgtggggagcgtatactgtccgtcagacgggaatgctgtcagattttccttgccttgaagcgctatgaacattgccatttcagctattccgtaaaaatatatattatcttgaccaatgaactggaacacttcagaatccgtgcttttccaatatttttcccattcatcttcgggttttccctgctgttttaaatatgtctttgtaaacgaaatcggcgcccataatgattcgggccatacccaaattgtcagcccatcttcgccatccagtacaggagctggaacgccccattcgatgttgcctgtaaggcggaacggaaccaaagttttgccggcgcggaaccggatattattgtcgcttaacagttcttttgctttgtcgcggtcattcaaatttttaaattcgatagaaaatgaggtcttgttgtcctccaaattcagaatatgctccggcatttgtgacttgattgcagtgtattcgtctataaagtcttttttaatgtaaatcatcggaggaagcataaattcttttattgtgttgtatacaagcggccgtgaattgcctttttcaggaaggctgtcaacatattcgttcatcagttcattaaactttgttatgtcaatgtaccaattcacaacgtcacgcatttcaggagtttcgcctgttaatgtgcttttggggttaatcaggtcggccggcatatattggtgccccagcgaacactcgtctgcatatgctttgtcgctctggcatttatcaacaggacattttcctatgacctgtctgccgtttaaaaattgtcctgctttagcatcatagaattgagaggttaccatcttttcaagatgtccgttttcgtaccattgatgcattaattcactgcttacgtcagcatgtacatctttggactctccaagtcctgaagcggcaaagagatttaagcttatatcatatttgccaagaacttctttctgactttcatggtttattctgacaaaatcctcaatgcttccgtcgaatttccctgtttcgcaaagttttctgtaactttcaacaataggtgagccgtaacagtcagtacctgaaacaaatataacgttctcttctccaatacggtcgcgcagaaaacgcgcaaaacagtctgcctgaacaaatacgccgcctacatgtccaaaatgaagttttttgttgccgtaaggcatacctcctgtcacaactgcccttttgggaaatgatggtctaggtaggtcaaatacacttatttttttaggtctgtactgctcattattttgattgtttttacccatgttttttctccttctatataaaaacagaatcttttgtagtttatattttaacctgcaatagccaaattaatccttcttgtcatttcgtcttcgccgattatttgacatatctcccaaaggtcgggcgagttagtgcgtcctgttatagctacacgtataactccgctgacgtcgctgacgctgcccttatacatatcgggattttttttgaaatcttttggtttcacggcataacccattgattcggtaatatctctgattttttgaaaccattcggaattgtcgtcttttatattaaacgaggttaaatattgttttagaattttatatcggtcttccttagataccctttcaggaaattcatcttcaactttaaacgtttcagggaagtagaatgagaagaaatcgcgtgcctgtttccagcttgtcaggtcttttctcggcctgtttccgtttctgccaacgtctatgattttttcagaataatttttgtctcgggtaaacagcttataaaattcagggtcatattctttgagccaatcagaaaattcgtcataaatcttatttgccggcgttctaagaagaacctctcggctgacatcctcgaatttcataatatcaaacagcgctcccgaattgctcattttgtctaaactaaatttaaagtcatcaatcggggcgtcgggattttctaatctccactcttcaaaattggaatttaaaacagtcatgagatattcccaaacggctctcggcgcatatccttcacttcggtaatattcgagaccaagctcagggtcttttctctttgaaagttttctttttgtgtcaccgtccattttcatcagaaccgctgtgtggcagtatataggtctgtcaaagcctaaggcgtcaaataactgaacgtgtatcggcagagttgaaagccattcctcgcctcttaccacatgggttgttctcattaaatgatcgtctataacatgagcgaaatgataagttggtataccatcggatttgagcagaacaaaatcctgatagttttcagaaacgttcagcattcctcgaatcccgtcatatacttcaacgtggttattttcgtctccgtttgacttaaatctcagaacatatttatcgccgttttcaatccgtttcttaatatcatctatagaaaggtcacggcactttgcccatttaccgtaatatccgaaattgagcttgtccgaaatctgttgctcgcgcatttttgaaaggtcgtcctccgaacagaaacaagggtacgccatacccttcttaaccagctctttggcgtagcattgataaacttcttttcttaaacgctggcggtatggtccataagctccattatcaccgtcgacagaggcgccctcgtcaaagtgaataccaaaaaagtccatagctgatataaccagctcaactgcgccttcaacctcgcgtttggcgtctgtatcctcaattctgagaaagaacgtgccgccgttttgatgagcgagtctctctcctattattgcgttgtatagattacctaaatgcacaaatcctgtggggcttgggcctatacgcgtgaccggcgcgccttccggaaggctgcgtttgggatatttttcttcataatattcaggtgttttatcaataccgccgaaaagaagttcggcaagctgctcatttttattcattacaaaatctcctaaaccaattaataatataataccaagtattttactattttttcctaaataagtcaagtattcgctggttttattatatggttgatttcagaagtttcatacttaaaaaatctgtgcgagcagtactgacataaccattccgcacaaatccgcacttagcgcggcaaataacgtgtagcgtatattttttattccaacgcttccaaagtatacagctattgtataaaaagtggtttcagtagagcccatcattattgacgctattttgccctgcatagagtcaggtcccaggtgttcaaatatatcagttaccgtagccagcgccgcactgccggaaatcggtcttaaaaaactaagcggaactacttccggcggcatatgtatcaggttggtaacaggagagattgcgttggtgattagttcaagacatccgctttcacggaacatagctattgccaccataagtcctataagtgacggaactatgttaaatgtggattcaagccccattttggctccggatacaaagcaatcatagatatcaaccttttttacaaatccaaaaatcagaaaaataaatataaaaaatgggactgagtacatagatactatttccatagtttatgccccctgtctttttgatgcgtctgaaatagtttggcgacagtgattccaacagccagcgcacataattcacatatccaaataggcagaatgacctcgcctgggtttgccgagccatagctttgacgaagtgatattagggtagttggtatcagctgcaaagaggctgtgtttaataccacaaacatacacatttcatcagtggcggattttttgcatttgttaagcttatccagttctcctacagctttgattcctaagggagttgccgcgttgcccattccgagcaggtttgctaccacattcataaccacgcttccgaacgcgcttgattttgggtcaagttttggaaatataaattttaatattggatttaaggctttggctataatttttattaagccgccttcttcacctattttagatatacctgtccatagacacattatacctaaaagtgaaatgcaaagagtgacagcgtctccggctccgctgacagccgccgccgcggtctgctcaacccgtccggtaaataccgatactataagtgatattattatcattccgccccatatgtagttcatcataagcattacctctcttgtatagtgcgatagaattattgttttgtaatataagttttactaaattgtaaacagcattcttcatgattctccataaatattggccgaatgtatgtataatactgtatggtaatatttgtaaataaatgttttgaccatagtatttaagggaaacacgaaaattttgtcacttaggcaactcgtatatattgtataatatattggctcagtgcactatatattccggttttgatttgattataaacctctcttttcgacaaaatacgattatattgtccacttttcaaaatcgttaaaattattataaaaaacgcttgcataaagcaagggcttgtagtagaatatacgtggtgggggaaagtgtactaaagtgtattgatatgccgtgaaagtggtacgaaatgacttaagtgtggagcacattgccctaaaaccaaaaaaagttggttgaaaggaggcggcaaaatgttaataggtgaatatatgcaaactgtggacgctaagttcagggttaacattccatctaagtttagaaccgatttgggtcagacttttgtcgtcgctaaaggaatcaactgtatttcgatatatccgaaagatgaatggatacggtttttggaaagtttgaaagatatgaaaaaacttaggtttttctctgccggttcaagcgagtgtgaacttgatacgcagggaaggatagttgttccggtcagtcttcgtgaatatattggtcttcagaaagaaatagcggttataggtgcgttcaagcatgttgagatatggaatagggataagtggtcggagtattttgacgacgacgcttataaggccgaaaatatagagtcaattatggagcaggaagattttatatagaaatttgaacgcagaggaagcttctatgaaatttaatcatatttcagttttgttgaatgaaagcgttgaagcgctgaacgtaaagcctgaaggagtgtatcttgacggcacgcttggcggcggcggacattcgtctcttatatgtgaaaaacttggcgaatccggaactcttatcggtattgaccgagatactgccgcacttaatgcagccggtaaaaaacttgaaaaatataagtgcaggaaattaactgttcacgataatttttttaatgtaaaaaatattttagaaagtcttaaaatccctaatattgatggagcaattctagatttgggcgtgtcatctccgcagcttgatgaggcagaacgcggattcagctataattccgatgcacggcttgatatgagaatgaacagggacgacaaactgacggcatatgatgttgttaacaattatacttttgatgaactgaaacaattgctgttcaggtttggagaggaaaagaatgcctcaaaaatagccgctaatatagtgaaagaaagagaaagaaagacaatagaaacaacgcgggagctaagtgaaattataaagaggtcatttcctccgaaaaaaaggtatggggacaagcatcctgccaagagaagttttcaggctattagaatagaggtcaatcatgaacttgatggtctgaaagaagcaatttgtgattttatagaatgtttgaagccgggcggacgtttggctgtgataacctttcattcgctggaggatagaattgtaaagactgcttttgcagaattggccagaggatgtacctgcccgaaagaatttccggtttgtgtttgcggaaactcgccgaagataaagataataaacagaaaaccaatagttgccggaaaagatgaacttgaaaaaaataacagagcccatagtgcaaaattacgaatagcagaaaaaatataatcgaatgttaaaaagtttaattgaaagggatggtaaagtgcctgagaaacaaaagacagcatatagaagacaagcacctttgtcgcaaagcaggaattaccgggcggaaacaagaggcacttcatcatatggcggtgcttatggtgctccgcgttatcaggagaacatgaattataggtatcccggaataaacagcactgaaatcagaaacactcagtatgcaggtacagaaagactaagaacaggcagttatgagagcagaaaatcttatagagcccaaagcggtgtatatcaggaaaagagaccgagttcgaatcggagaggtaattcaactgttaatattcaggataaatcatatatgagggggtattatccacctgtgtatacggctccgtcagaaaggcctatggcaaacggaatgcggacatcatcagtttccgtttatgaaaggccgctgggatataccggcggaaccacggtgactgttccgggcagagaggttcagagaaaaattctgacccgtgaggagcggttagaaaataaaagaaaattaaaggctcgtgtattatctattttaggcatagcagtgatatttttaatgtgtgtgctgatgctttacagacagagtgcaatatttggtaaaaatcaggaaatagaaacgttgaattcagaatatagtaaaattcttgtcacaaacgaaggaatacagtcaagtatagataaatcaattgaactgggaaaccttgaatcagtcgctaaaaatcaactgggaatggttaatccggattcgtctcagatattttatatagatatgggaataaaggatgaagtagttaaatcttcttcttcaaaataaaatgaaatacaaaatgggtataaaagttattaaaatatgttctattttataattttatataataaactttccacaaagaacggcggcctaaatttggtcgccttgttgtaattaatggaggaataaatatggcagagcataagggtaaaaaaaagggcgggaaagttaccaggcttatgactgtattaatagtattttcagtgatgtttatagcactgatatttcgcgtcggctggcttcagacggttagggggaaggacttgtcaagacaggctttagaccagcagacaagtgataatacggtcagcgccaaacgcggaaatatatatgacaggaactataaagtgcttgcaaccaacactacggttgagactataagtataactcctgaaacgctgcgtacatctatcagtaaaaaaaatatgactattgatgaggttgctcagagatttgccgatattttggaacttgaaaaagacgcggtaaaggataaaatatcaaaaaagattcaaaatgagactttaaagaaaaaagtggataagacggttgccgacacccttagagagtatgtaaatgcttcgggactcagcggtgtagctttcacagaggacgttaaacgatactatccgtataataattttgcagcgcaggttattggtttctgcggtacggacaatcagggccttgaaggtgttgagagtatttacgatgaagaactcagcggtgtgccgggaagggtagtgtcggctcaaaaatcaaccggtcttgaggataataacggatatgagaattatatagctgctcaggatggaaatagtgttgttttgactattgacgaaacaatacagagctatgttcagaaaaatttagaagccgcagccgcagataataaagttaacgagggagcggcggctattgtaatggatgttaacacaggcgaaatacttgctatgtgtacagagccggattataatcttaatgctccgtttgaaataacagaagcaatcgaacaaaaatatccgggtataaaagaagaacttgaaaatttagacgggcaggaatataatgcgaagctgggagaagtaatgcagacggttaggcgtaacaaagcggtagtcgattcttatgaaccgggttccacttttaagtctgttgtcgcttcgatagctttagacactggttcatgtacactgaatgactcgttcacctgcggcggttcatttgtggttgcggacagagcaataaaatgcgccaatactaacggtcatggattgcaaaactttactcaggcagtacaaaactcgtgtaaccctgcttttatacaaattggtcaaaagacaggaaaagaaaagtttttgacaggtgttgaggcattcggattctttaagaaaaccggaatagagattcccggtgaagcaacgggtcttggatttacaaaagacaatatgacagatgtcgatttggcaacatcgtcattcggacagtctataacagtaacgcctcttcaaatggtagctgcagtcagtgctgtcgctaacggcggaacattaatgaaacctcatatagtaaaacaaatagttaattccgatatgggaatagttgagaacaccgagcctgaaatggtaagacaggtgatttcaaaagaaacaagtaaagaaatgtgcagtatacttgaatcagttgtatcagtcggcggaggtaaaaatgcgtatctagcaggatatagaatagcaggaaagaccggtacgtcagagaaatacccccgcggaaacagtaagtatgtagcgtcatttatagggtttgctccggcggatgaccctcaggttgtttgtcttgtaattttggatgagccaaatggcgattcatattatggcggtactattgcggcaccggtagttcgcgatattctgggcgaaacattgcagtatttgggggttgagccgaaatataacagttctgaggaagaatatgttgatgttgaaattcccgatgttacaggaatgagtaagtctgacgcagggatagcaattgatgagagcggccttgaggttaagttcagcggcgagagtgaccttatagttgaccaaataccaaaagcgcacactagagtgactcagggaagcacagttgttttgtataccgagggcaataaggcaactcgttctgttgcggtgccgaatgttgtaggaaagacgccggcggaagcaaattcaactttagtcagcgagggtttgaacgcaaaaatcaaaggagtttcaaaatcgggtaaaaatgcaacgtgtatcggtcaatcaccggttgaaggaactatggtagaacccggaacagtggtttcgcttaactttagatatgatgaatctgagactacaaatgattaaaatttataattttaaggtttatttttggcatgaattataaaaaagtgatttaatcattttggaggttaaaataaaattttatataatttgtttaggcaaaaaagcgtttatagcaaagggtgctgaggtataaaatctcaataagataataatgcagagtttgccggctaaatatgcaaatatatacacaaatcaaacaaaagtgtaacaaaataatttatttataaaataagagtaatttatggcaaacaacggcagggcggtcaaagaccgccgggtaaggtgagcagctgcaaataagcagatatattaaaataaatctaaaaaaacatagcaaggtaattgccagcaaaataaaaatagagataaaataagagtaatttatggcaaacaacggcaggacggtcaaagaccgccgcgcaaggtgcgcagccgcaaataagcagatatattaaaataaatcaaaaaaacataacaaggtaattgccaacaaaataaaaataacgcaaaaaaagtgatttatagcaaacaacggcagggcggtcgaagaccgccacgtaaggtgcgcagctgcaaataagcagatatattaaaataaatcaaaaaaacataacaaggtaattgccaacaaaataaaaatagcgctaaaataagagtaatttatagcaaacaacggtagggcggtcaaagaccgccacgtaaggtgcgcagccgcaaacaagcaaagaaatttacataaatttctactaaatcataataactaattgactttttatttatattagctatataatataaataactataatcaacattataacagtaaaataatcacaaaaagtgtgcgccataaaatatattttatataaattataagtaatcatatttaatcaaaaagattatgtaatgggataaagcgaaaaatacataattctaaaggttctaataaatatttataaattaaaaatctaagcttataacttttacaaataaattgagttttaaaagtatatagtagaataagaaaagttttattgatattacacaggaggaataataatgacactttcagaattgttgaaggatgtaaatattaaaaaaatagatggcggcggaagcatgaaaataagcggtatagcctgtgattccagaaaagtaaaacctggaaacgtttttgtttgcataacaggttatgagactgatggacataaatatgctaagtctgctgttgaaaacggtgcggtggctgtggtagccgaacatgaccttcctacagttgacgtcccctgtgttatcgttgacaacacaagaaaggctatgtctgaaatggcggcaactttttatgattatccttataaaaagtttaagcttataggaataaccggaacaaacggaaaaactacgactacttatttgattaaatcaattcttgaacatcttggaaagaaagttgggcttatcggcacaaatcaaaatatgataggcgatatgataatggaaacctcaagaacaacgccagactctttggagttgatgcagctgtttgatatgattgcctctcataatgtggattatgttgtgatggaagtttcttctcatgcgctggctcttgacagagtgacggcgtgtacgtttgatgtaggggcgtttaccaatataacccaggaccatttagattttcataagactatggaggaatatttggcggcaaaaagcatattgtttaatatttgcaataccggcgtagtcaataaagatgacgcccgcagcgaatatcttattgaaaatgcaaggtgccggaatatgataacatacggtataaatcaggattgtgatttaaaagcgtctaatataattctgaatgaagacggtgtaaaatttgatataaattacggtggtatggaagaacacgtcgacttgccgatacccggtgaattttcggtatataacgcgcttacagcgataggctgctgcatggctgagaacatacctcttgatttggctgttgacggtcttcatagtgctaaaggcgttaagggaagaatagaaatagtaagaacgccgggtacaaattatacagttataattgattatgcgcacactccggacggacttttgaatgttataaacgccatacgtggatttgcaaaaggacgaatagtcacactatttgggtgcggcggtgacagggacgcctcaaaaagaccaataatgggcaagatagcaggagaactctcggatttttgtatagttacaagtgataacccgagaactgaggatcctgaaaagataataaagcaggtagttgaaggagtaaaacagacagactgtgattacgaggttataacaaatagattctccgcaattgaatatgcacttgaccacgcgaaaaaaaatgatataatattattggccggtaaaggtcatgagacttaccaggttttaggaaaagatactataaagtttgatgaaagggaaatagttcaaaaacttttagggtgttacgataaataataacaagctgttttaacggcaatattgtaacaaaatattatgaatttgattgtgattgtgtggaagtcagtggattactaaggagatagttttatgaaatggtgtatgaatatcaacaaacttgctgaaatcaccggaggaatagcttacaattgcagcggagatgagatagttaaaaacgtagtcagagatgacagagaagtatccgacggaactgtttttgttgctcttaaaggagaaaataataacggtcatagatttgttcagagagccgtaaataacggtgctgcatgctgtgtggttgacaaagaggaaggaagcttcggaaatcttcctgttgttgctgtagacgacacattcaaagcgctgagagatatagcggcgttttatagagaacaatttaatattccggtagtcggaatcacaggaagcgttggaaagacttcaacaaaaggtatgatagcctctgtattgggcaacgaatatgttacgctgaagacggagggtaattataataatgaggtcggagttccgcttactatttttagacttacggataacgacgaagcggcagttatagaaatgggtatgagcgcttttggtgaaatttcaaggctttctaaaatagttaagccggatactgcggtaatcaccaatattggtatttcacatatggaacatttgggcagtcaagagggaatatgcaaggctaaatttgagattcttgatggtttgtctatagacggaaccattatcttgaatggagacgatgaatttctctgggagaaaaatggagagctggattatgaaaccttatattatggtatagaaaataaatcctgtgacgttgtagcgacggatataaaattatactcgtgcggcagtgagtttaacgtaaaaatagatggtgttgactataaatttgagactaatgcaccaggtatacatcatatatataatgcgctggccgcgatacttgtaggatataggtataaccttaaagtggaaagcatgataaagggagttcacgattttgtgccggagggattaagacaagttaagacaaattatcctaagtttacagtaataaatgattgttataacgcatgccctgattctatgggctccgggcttgacgttttggttttaacggctgaagaaaacggcggaaacagcagaaaagttgcttgtttggctgatatgctggagcttggagagacttcggcgcaggaacattataaagtgggtctgatgtgcgccgagaaggggattgactgtttgataacaataggcgatatggccggaaacatagccaaaggcgcaatagacggcggtattaactcaagcgatgtatatgaattcggagataacgaatcggctatatcgcgtcttggaggaataataaaaaataatgatgttatatggataaaaggctcaagaggtatgcatcttgagaaagttgcggaagcgcttgataagatgggaaattcatagtattgagagctaaaactgttttgattggagagggtaattatgaattacttgatttggggagttatagcattagtattgtcagtattatttggaatatttataataccaatgctgaggagattaaaattcggtcaggaaatacgtgaggaaggcccggcgtggcatgcaagcaaatcagggacgccgacaatgggcggaataatatttattttgagtattattgtaaccctcgttgcaatgtttgtttggacagcgtccgacgggatttctatgggaaatacagtggatttagttttggtaattttactttcactggcatttggagctataggatttattgatgattacataaaagtggtaaaaaagagaaatttaggccttaccgccgcccagaaatttagtcttcagttcgttgctgctctgattttcgctactgttgtggcgattgggggaagtaccggaacggtgattgaccttccgtttacttcggtggattttgatctgagctggttttacataccatttgtgatttttgtaatgcttgcaaccgttaacagtgtgaatttaacagatgggcttgatggtttagcgacttctataacaattgttatttcaatattttatatgctgatttctacaagtatgggcaatcatgctatgtcgttgctggcagtagttttgtgtggttctttggtaggatttttgctttttaactggaaaccggcaaaagtttttatgggtgatacaggttcattgtttttgggcggcgctgtgtgcggtcttgctataatgctgaaacagcctataacgcttttaattgttggatttgtgtatgttatggaaacgttgtcagtaattatgcaggtaacgtcatataaactgaccggaaagcgtatatttaaaatgtcaccaatacatcatcattttgaaatgtgcgggtggagtgaagtaacaattgtgtgtgtattctcagcagtgacggttttgctttgcgcgctgatgtattattttggttaattttatttatgtgcagataggaggagtatcgacttgtcagatgaaagaaatccgagaaaaaaagccggaaacaataatataggccggcgtgcttcaagtaaatatagtaaaacgccgagaaactccgaaaatagaaacaacggacattattataaaagcatcagtcataatgaacctgtgcaaaacagagcgcagagcaaacattatgagagcagttacataaaaaaaacacagagcaggatacaggagccggttagaacgcaagttcctcgccgggaaaccgcgtcaaaaaatcaaggagtaaaatatactgctaaaaactttctcagggtaggcggaataaaaataagacgcggcgcgctcgattatcagtttttattgacaacgattatcttggttgcgtttggtatgattatgctgtatagtgccagcagttcaagggcctatgctgctaccggcgacagtatgtattttatgaaaagtcagtttggcggacttctagtaggtatagtggctatgattggctgtatgatggtggattatcatgttattgccaggttgtctccggtattgtatgcaatatgtattattcttttgatattggtattaatccccggagtgggaacaacctcaaacggagctacccgttggctgtttggttttcagccgtcagaaatagtaaaatttgcaacattactggttgtagctgtatatttggaaaaataccaggataaattgggtaacttcttccgaggatttttgccttgccttttgattttaggagtagtcggagcgctgctcatgatggagccgcatttcagcgctactatattgataacccttacaacattgcttatgatgtatgtgggcggagcgaaaataagacactttattattttggctattcctgcgtttattggcggagtggcaatgatatttgccgagccttacagactgcagagactgctgtctttcggtgatccgtttgccgataagcaaggagccggctggcagattgttcagtctctttatgccattggttcaggcggtgtgttcggcgttggatttggacagagcagacagaaatacatgtctctgccggaaccgcataatgactttattttctcagtattgtcagaagaattaggttgggtaggagctatagtggttatagttttatttctgttccttatatacagagggatacgtatagctcagaaggctccggacactttggggaaacttattgttattggatgtataggtctgataggatttcaggcgatgataaatatcggcgttgttacagcgtcgcttcccgtaacgggaatgccgcttcctttctttagttacggaggaacagcgctggctataactatgggtgaaatcggcttggtgcttaacgtctccaggcaggagaaggtgttataatgagaattttatttgctggcggcggcaccgcaggtcatattaatcctgctgtcgctatcgccaattatattgctgataaggaaagctcccaaatagccttcgttggagttgaggaagggcttgaggcggagcttattccacgtttgggatatgatttgtcacttataaagatacatggttttgaaagaaagcttaactttcagaatttcaaaaatttatttgaacttcctaaaagtattcatgattcaaaaaaaattataaagaagtttaatcctgacatagttatcggcaccggaggatatgtcgcagggcctgtgttatttgcggcggcaaaacttggtataccgacgcttatacacgagtcaaacgcatatccaggagtaactacaaaaattttgtctaaatatgtcgacacagttgctcttggttcaaaagccgccgagccatacataaaatcagctaaacatataatttactcgggtaatcctgttcgtccgtctatattatctacaagcgagtttgaggcccgccgcgtcttaaagcttgacgagcgtccgtttatagtcttttttggcggcagtatgggagctaaagattttaataagacagtggttgattggataagcggtgttataaaagataataagtatcaaatcatgatgggtaccggaaaatattttcaatatgatgatgttattgaaagatttaagaacaatggtatcgacctgaagaaataccgaagcgttagagtaagcgaatatatttatgatatgaatgttgtaatgtcggccgctgatttagttgtctgccgggccggggcgagcacactgagcgaattaactgcattgggaaaaccttcaatacttgtgccgtctccatatgttactgccaatcatcaggaacataatgccagggcaatagaaaaagaaggcggagcaagagttatattggaaaatgaatttactgctgaagttcttaataaaaatatagaaagtcttgtaagcagtaaagaaaagcttaaaaatatgagaagagccgctaaaagtgttggcactacagcggcaacagaagaaatttatcgtgaagcgaaacgtttgctgaagaataattagtatattcaataaccgcttttcacaaaccgtccttgactgcatactatattgtgaaagaatattaatgtagccagatggaggagattttggtgaccgacggttatttatctataaacggaagaaggcgtctttttggagagacctcagttcagggttcaaagaactcagctctgccatgtctgaccgcctgttgtatgtgtgagaaagggtgctgtaatttatgcagatgtccttacctttcagatgttgaaaatactttggagataatggagacgctagggtgccgatgtaattatgattctgaacgcgaattagcaaatatttcggcggagagtattttcggaagcacaatagagcctgaaatgatgaacaggatgcgttcttcaatattgtttctgggagttcttctgtctcgaatcggagaggcggacgttggttatcccggaggctgtgaattgggagcaagaccaattgatttgcatttaaaggcttttagaaagctgggagtacagatagaggaaagtcagggagttatacactgcagaataaaatctaaacttaaaccgtgttctgtatcgctgttatgccccagtgttggagcaaccgaaaatataatgctgcttatggcaaagtcggatggtgagacagttataagaaatgcggcaagagaacccgaaattgtggaccttcaagattttctgaatcttatgggagcggacataaaaggcgccggcagtgacgttattgttataaatggtgtaaaaaaacttcatggcgctgattttgaaataatgccggatagaattgttgcagttacatatatggccgctgttgcaggctgcggaggagagatactgttaaagggaatcaacttggagcattcttcaatgtgcaattcaattttaaaggatataggtgcagatataagaaaaaccggcgatggagccataatatctatgagcggccgtcccagggcggttaacaccattaaaactttatactatccgggatttccaactgatgcgcagccgccgtttatggctgttatgacggttgcggacggtactacggtgttcttagaatcaatttttgaaaatcgtttcagacatgcgtctgagctggcaaagctgggtgctgatattgatgtaaacatgtgtcaggcaaccgttaggggacgggagtttctaagcggtgcggatgtcaggtcatatgatttgagaggcgccgcggctatggtaataggcggattaatggcggaaggcacgacgagagtcggaggactgccgcatattgaaagaggatatcaggatatagtcagtgatttggaatctttgggtgctgacattcgtattgtatactaaactggagagccgttataggagaatatcatgcaaaagaaaagaaacattaaaaagagcagaatagacattgaaaaagcaagggcaagacggaaactaacagctatatctgtgctgtcagtagttgttttagcagttcttgccctttgttttttgcttatggcaccaatgtttaatataaaaaatatagtttgcgagggtaatgacaaaataagttatgataccattgttgatgcctcacaaattaaaacgggcggaaatatttttttgacaaatctgagttctccgaaaaaaaatgttgaatctttagagtatgtggaggattgtcaggtaagccgtgtttttcccgatactgttaaatttacaattactgaaagacagctggcggcttatttcagcatcggagattttcttactgttacagacacaaacgggcgggttgttgacaccgttactaacaatgatgatgtgtatcaaataacatcgtctaaaataaaagaggagatagttgaacccaccggcagtccggaacctgaagaagaggatacaaaaactgaggacgattccatttggggctacgatgatgacggagacccaatatacaaggtgaacggcggtcattacgagtttgacaatgacggcaatagatattttgttgatgattcacccaccagttctccggcggcagagaattcagaggagccaactgaattggaatcaggaaataattttgatgaattgaaccggacttcaaatggtgaaattatttacaacgctccgataatatatggagttggaataacaaaatatcaagttggacataggattcaaagtaatgatgaggacaagctggacaatgttatagaagctgtaaagtctttatcaaaaacgggacttttggaaagaaccaccaaaatagatgtaaataacataaatgatgtgaagttttgggtcgaagacagactggaagtatggtttggtacattcgataactttgattataaagtgaaattcgtaacttctgttattgacagtaacctatcaaagtatgaagaatcgatactggatttcagggattcaaaactgtatgtacgcagtattgaaacaggagaacctaaagtgctggaagttagtccggagccggatagtgatgaagaggattcaaaatcttcggcaaaaccgaaagcgtctcctattccgacagatgatgaggatgatgaaggtttagcggatgatgaagagcaggatgaagaaaatcccacatcaactccgaaaagtgataattctaaaaacgaatcaaaacatactcctactccaaagactcagagaaattgatagtcagtacagatttgagttagacagcattggtatggtattggtaaaaggtataaaagacaagggcgatattaaaaataatccaccgttagaagaagcgtttaatttaggtaagtgtttaatttagcaaaatccaatttgagagaccaatccatttcgctttttcgggataggagcatatacttttaagctgtttttaataccggcaagcaggacaaagcggttataatttgcaaaaaaaataggacttcattttgtttggagcggattccgaatgttagaccaagaatctaacaattggggttagctcacttaattgaagtcctatttttgttcgctttaacaatgaagtgaaaacagtgcctaagatttgaaaattacaaattctttaaaaatattttatacagtcttttgtatataagactatattcatttataagtctgttataaaatgcgttctctattatataaagcaagctatttgtcctaaatttttaaaatcttttttatagtttgtttatatcttagagaaagtaaaataggttatatataatattagttttggtgtgtgagagttatcttatttttccagccgccatatatgcgggtcttttctaaagattaagcatgtgataagtccgataaatcccagccataaaaacaaaaaagcggctccggcgccttttccttgcccaaataatgtaataaatatgcttgcggctgattgtgacgccatgaacggttcaaacactttgtcaaccaagaatcctcccataaagtaaccgattggtatagtgaaaaactgtaatgtgtttcttgcagaatatactctgccttgcatattaagagggatatggtttctgaaaagaacatccatgtttgcgttcataaacgggatggctatccatcctaaaaatgctccgatacaccaaacgggaacgctttttccaaatgcaaggaaaaagttttctgtgctcattgcaagcagaagagaattgcaaattatacgaacccggcttttgggtgatggaatcagtgatacgagtatgcttcctccaaccattgcgagacctgataccgcattgactattccgagtgcagactcactgccggagcttttggatagaaccatagccggaagcgctgcttcaaaaactgaagcggtaaaatttattgcagccaaaaatagtatgaggtctaaaattccacggttgtgtctcagataccgtattccgcttttggcggattcgagcacggattctgctttagcgttctcagttgatataacttttggtatttttacaaagaacagcagtgataagaaagctattccgaatgtaaataaatcaaacgcaataatcgtttgaatattgctcagcgccagaagtgcggtagatatgacgggagtcataacgtttaccaatgaatttgagaatgctctcataccgctcgccttttgataatgttttttaggtgtgagcagactgatagtaacatctgccgacggttgctgtattgagttcataagaccgtttagtgcattcaaacaatataaatgccatatttgcagtttgccaaacagcagcagaatcaggacagatacagtgcaaacagcagcaaaactgtcgcagacaagcatagttgcttttttattccatttgtcgcttaacgctcctgcaaatatgcttataatgacataaggcgcatatgaacatattgaaagcattgaggtttttaaagcggacccttgctgctgatatgaccatattattaacgcaaaatttgtcattgaactgccgagggttgaaaatgattgtgtgagccacagtataataaacgaatgcagctcatatattaatttttttattttattcatattgactttgctccttttaattttgaaattatctcataaaatgcaaagtcttttagggacattctgttttattgctctatgcggttcgtccctatttgaccttgcatagagcttcagcaatacaaagcttcatttttcctcctaagtatttatttaaaatataaaattttattctaagccgttcattacaaaatccacaagatcctgtgttgaatttggttttgctattgacttcattgcttcctgcataagtttcatccggtcatcgttaacaaacatttgataaaccgcttcatctattggatttgtgctgcttatccgcatggccgctccggcgtttaatagaaactctacgtttctgtcctcctgacccggaatcgggttattaataagcattggtatctgttttgcaagcgcttcgctggtggtaagccctccgggttttgttataatacagtcgcaggcgtccataaacacatcaacgttgttgatatacccataactgtatatttttttccgtgtttccatactgtctatttttgttttaagctttttattgtttccgctgacagatacaatttcaaaatccatatcaagcttatccaattcttcaatttctttatatacagctccaaaccccatacttccgctcataacaagtattgtatgtttactgtggagatttagaatctctttagccttacttttctcaatttttcttgagaatttagtaccgattggtattcccagcggtaaaaacttgttttctggaaagcccttttttattccctggatagtaagcctttcattagcgataatatagtaatcaagcaagctgtcttcccagtaaggatgtatagtgaagtctgttattactccaatagttttagcgttaagatgttctattgatgaaatataagtaaccagcagcgcagcgaatatgtgtgtgcaaataataaaatcaggtttttctttttgaataagttttatcagacttcttgacaaaactgaatttgttattctattcagtccgtgtatgccggcaccggactgtactccgcgtttttcgcacattctatatacgccgccgtagattttaggtatagctttggtggacataagataaatcttatttacagaatctgataaaatcgggtttataaatttgtatacatccagatatttgcattcgacgccgcactcgttgaaacgtttgctgatcaccatggctgtttggttgtgtccttgtcctgctgttatagataatactaaacctttcattggacttcctcctaattttgccggtttgtgtgttttcagtatttatcagggcttatatatttacagctgttccaggtttaagaaaaaatataatccgctcctttattttctttccaaatattgattcaatgccctttgtgtaataatccatttggattttgtatttttcagcttgtttaggcgcataaatggcagaacagttgtcagtcttataatccaataaaactatctcgttgtcttcgataaagaagcagtcggcgacgccttgaacaatgatttgagcgtttttggaatcagaacttactttatctccatatatttctgaagcgcttacaggaaacaagagtttaaattctcttttaagacttccttttaaatatgcgttccgcattcggcagccgatttcagaactgtaaaatttaatgattgaatctttatctattaaagaaatttgactgttggttaaaacattattggcataaagtgatgttatttgttcagttatttgctcttcagactgagtaaactccgggtttatgtgctgcattatgtagtgagtgatagttcctatttcggcggcgtctccgctggaggcagagtggaatgttctgtcggcgatactgcttaaaatcggagtatattcaccatcctgctcggttagactgtcctgcatgcttcttttaatttcactaactgaaagttttaaggggatacgggtcaattcctcattagggtataaataattaaggttgttatacaattcgtcagcgagctctttgcttatgggctcgtctgttggttttgaaatcgatatgttttcattgattgttttttcacagtctattgattctttttgtgataagtttatattttcatccgtataacttatatatttgaattgaatattctgagcttcatcaatttttagctcggatatgtcggattccattacctctctaagttcttctgcgttcttttgcggcaagtatcccaagactatccaatccctgaaaattttgctgttttcaaaatatggactgatgatttctccgcgtgtgttcaaaattggacgtttccagccttttgactggccgggagattcattggtgcaggaaattataagtttttcctttgccctggtcatggctacatataaaagacggatttcttccgcttttgattctttcgcttttttatatttgattaaatctaatgaaagacatgagtgttttatacgtttatctacatcaatatattccattcctataccgtatttttcatcgtaaagaacagaatcaccgccgggtctgccgtaagtagttccggctaaaattacaacaggatattcaagcccctttgacttgtgaactgtggtgattgataccgctgacgatgcgccgttggtgcttttggcttgtcccatacctgaagagctgtcgttaattttgttaagataatctacaaaactgaaaagacctttaaaagcgcgtctctcataatctcccgctctttgaagcaatattttcagattggcctgcctgatatttccgccgctcaatgatccggctaccgctagataatctaggtcatagcatattttatatatgagttcatccgtacccatatattttgaaaaaccgcgcattttatttaaaacatcaaaaaattttttggcttttgtattgtcgttttgcgcggcagttttaacacaataataaaagttgccgtgccggtttaaagttcttatttcggcaagttcatcggctgtaaagccaaagatagggcttctcatgacagcaattaagggtatgtcttgcagtggattgtctattatctctaaaaaacttaaaacagtttttatctcaatagtgtctaggtaaccttcgctgctgtcagaaataaccggtatattatattctcttaatacctgttcgaatataggagctgtattctttgtagagcggagaagaataacaatatcgccatattcaaccggtctttgttctcctgttttcgagtcgtatacatacagtttatcaaacgtcaccaattttgatattctttctgcaactgttcttgcttcaagctcatgtttgttttgaaacgcagtttcgcgcgtgtcagaacccgaagatttgtccagcacgtcagtcattatcagctctgttttataatctgagggatttttaacttccggataatctgcgccgctttgcagccgttcatcttctgtatagtctaattctgctgtagatttagacattacgtttttaaatagatagtttacgctgtctataacattcttgcggcttctgaaattgtctgacagacgtataagatgtccgttgttattttcaccggagtattcggtcagcttattaagaaacaattttggagacgcgtttctaaatccatatatgctttgttttagatctccaaccataaatatgtttctttttcctcctgatataagctgaaataacttgtcttgaatattatttgtgtcttgatattcgtcaacaaatattgctttgtatttattgctcaaagttttacaaaattctgtcggggagccgtcgctcttcattatcagcttaataagctgatgttctaaatcactgaagtcaagtgaggaacgcaaaagtttcagacgcgtatgtctgcgttccagcataagtatgatattttttaacgtttttatccgaggatacagaagacttatagagctgcttaaactatctatgctatcatatgaaaacagtctgttacttttaaattgtttttttgcttcttcccttatatccgctatatttttgaggatttcggcaagatacgcgtcttctttgtcttttttgctgattctgggtttggttaaaaattttatgttttgcctattctctatatattcttcaatattgccgcacttcattatattacgaaacatctctgcttctttttcaaaaaatactgcgtgtgtatgttcttcaggcagttccttttctgatatttcaataattgtattgtaatagtcaagaatttgtcttgttgaattctttatgcagcttagaaatatattttcccactctgtgccggatacagtacctgatttataaacttcaaaatacattttgacagagttgttcagccattttgatggttctgccaggcttcttgaaaacttgtatatattggtgattgcacgtctgagattatcatcattttttattccgccatgacctaaagtgagctccttaaaagatggcaatatgtcaaagcgttcatagtatctttccaaacaatcttctaaggcatctttaagcaaaagttcattttctgcttcgccgattagagagaaaccggccgggatatttgttagatgaatgttattgctgattattttttgggcaaacgaatggatggtggaaacatcggctgcggcaattttggtggtttgagacctgagatgctgattatcaggaatttcttttagctttttttctatagcggctgctattttgtttttcatttccctggctgcggcgttggtgaaagtcaaaacaagaatttcatcaacggaaacaggttcggtagggtctagtatttttctgattatgcgctcaactaaaacagctgtttttccgcttcctgcggctgcagcaacaagaatattctgtttgttttcatatgtaatagcctctttctgagctgcggtccaattcatataatccctccgggtctagtaccccatggtgccttcaagcgattcatcgttttcaatccatttatcaacagggataacttcatattctgtcggtgttcggcgtactattacctcttctataccggcgtttataaccagccttttgcacattgcacagcagtttgcgtcacctacaagctctcctgttttggcgtctctgcctgccaaatatagagtgccgccaatcatatcacggcgtgaggcgcttataatgcagttggcttccgcatgtacgcttcggcacatttcgtatctttcgccccggggaatgttaagcttgtcccgcatgcagaacccgaggtcagagcagttgttccgtcctcttggtgcgcctgtatatcctgtcgatataatctcatcatttctgacaattatagctccgaaattgcgccttagacaagttccgcgttcgataactgtttctgctatatccaaatagtagttcgctttgtcgactctttgcatattatagccctcccaaaaacaaatttatctatattataagttattttttaaaattattcaataggtttatattgactttgttgcataatgtcaatataatataataaagacttcattttattgaagaaactaaagatagaggtaaatatatgaaaatatataagtctaactcggttgaggatactgcgtcagctgccggtgaattggcggctgagcttaaaccgggcgatgttattgctttggttggagatttgggggcaggaaaaaccgctttcgttaagggaatagcaaaatactttcattctaaaaatgatgtattgagtccaacgtatactttggttaacgaatacggcggtgatattccaatatatcattttgacgtataccgtctcgccaaccccgcgcttgatgaatgctactggattgatgagtatttgtttggcaatggtataacaattattgagtgggctgacaatattaaaaatatcttgcccgaagggactatacgggttgaaataaaggcgtatcctgaaaagggtgaagattacagggagataaagatatgttagtgttagggatagacacatgttgtatgccggcgacgtccgcagtgtatgacggagaaaaattggttggagaagctatagttaactgcggtaaaacccactcgcaaaaaataatgcctcaaatagaagctttgctcaattcgctggaactaaaacctgcagatatagattgttttgctgttgcggcaggtcccggttcttttacaggtgtcagaataggaacggcaacgataaaagcgatggcgcatgctgcgggaaaaccgtgcgcagcggtttcaacgcttgaagcgctggccaataacgttccatactttgacgggataatttgcccgattttggatgccaggagaaatcaggtatatactgctgaatttttaggagacggtactctaacgcgtgtttgcgaagataaagccgttagtttagaatctcttttggacgagctgaaaaatttgaaaaaaaaggttttgtttttaggagacggggttttggtttacagagaagaaattttagaatatttaggagataatgcaaaatttgcaaagggaaacaacaatctcaatatggccggctctgtagcggaattagggtatgaggcggcgctttcgggagatacaataagttatgcgaaactcgcgccgaattatataaggctttcgcaagctgagcgtgaacgtttggagagaaaaaccgaaacaaaagaaatttaaaggagaacataagacgtgaaatttaaaagaattttttcagctattttaattttgttaatgagtgcagcaatttgtctttcacctgtattgatttattctgaaaacggaactttttcatcggattcatccactgtcaggacaaataaagaggataattcggacgaagaagataattcagatacaaattctgatgttaaatctgataagaagacaaatgatgacgatgatagggagagcggtaccataaggggaagcaaacctacatcaactccggccgcaaaatcttctaaatctgcttcttcaaaagctacagcaactccggaaccaaaggccgaaccaactaaaaatccgagagtcggcgacggcggaaaaccgattttggctgagcaggaggccgctatattagtaaactgtctgaatggagaagttatgtttgaacaaaattcagacaaacagatttatcctgccagcactactaagataatgaccgctttgctaactttagaagcaatagaccgcggcgagataaatttaaattctgcctttcttataaccccggatatgcttgaagacttacctgccgacggttccagtatgcagcttaaagagggcgaagccatgacggttcaatatctgctcgagggacttatggtggagtccggaaacgacgcagctcaagctttggctgtaattgtttgcggagatgttccaacttttgttgagagaatgaataacaaggctgaggaacttggtcttagcggaactcattatatgaatgttcatgggcttcatgacgaggagcattatacgactgctgcggatttatgtacgttatcaagagaagctatgaaaaataaaacttttaggagtattgttgctatgtcgcaggcaaatattccggcgacagataaagttggggcaagaacgctgataaacacgaacggattgttgtcaactttaaaatatcccaattatttttaccagtatgcgacaggtataaagaccgggcacacgagccaggctgggtattgtttggtgtcttcggcgcagaaaggcgatcttgaggttatcggtgtcgttatgaattgcaagacagaggacgacagacattacgattcaaaaaatatgctggcttatgctattgataattataaggctgtgacagccataacaaaaggagatatggtcggcgagataaaggtgcgtttcggaagcggcacagaccatacaacattatcaaccaacagcaatattatagttacggtgccagaggacacaaattccgaggatttgaagatagagacttctctgcctgaatatatggcggctcctgtaaacgagggggacaagataggaacagttaacgttgttcttaacggagaagttgttgggagcggagacttaatagctgatttttctgtaaagcgtcatccgcttggatttcttatgcagttttttagttatatatggagtttttggttcgtaaaaatattaatagtcattttggctgctgctttagttatatttataatttatatgataattaatataagaagaaatataaagctggctgaaatgcgcagaagaagttcgcgttcaaaacgtcctccaagaagataaagaattaaataacaattaaatagatagaattttaagtaaaatatgaacaaaaaagatgaattgttaacataaaatatcttgcctagtcagttatttcgtggtataatatctcaaatatattttgtatataatgataacggaatatttttatgtttcgaattctatgaaaacccagcgcttggctgttttatcggaggattatttcatgactgaacctataatgacttatatctggacttttatattggctgttatgcctatttcagagataagaggctcaataatttatggcttgtcacaagtcgatcacaactttttgaatattttatttatatacgttttatctgttattgctaattttttacctgttccgtttattctattagcgttccgccctattataaagtggttgaaaaagaccaaattgttgggcaagttcgctacatggcttgaagcaagaacacatagaaaggccggggatatatccagaaaaagctcaaaggcggcggctgttgcgatatatatatttgtttcaataccttttcccacaacgggagcgtggacaggttcaatgattgccgggcttcttgatatgagagcaaaatatgcattgccggcagtgcttttgggaataatgaccagcggagctataatgactttgcttgttaccggcgctcttaatttaggttcgttcggcgaatggcttacacattaaaaccgtttagtaaatttttatcgtaattatgatactatgaaaggaattttttgatgagtgatataaattctcagaaacaaaaaaaacagtcggctaaaggcaggaaatccatgcttattattggtattatactcttaaacatatcaatatttatggcggcatttgtgttttcatttaatatgataatcaatccaatagaaaagcgtgatatccaggtgcagacgctgactgacgagaatacaaaacttaaaagtgattctcagcttttgcaggaccagctggatgttgtacagtcagaacttgattcatataagaaaaagtatggaggttcctcaaattcaagcaaaagtaatgcctccggttcttcaagcagcagtaaaaacaactctgaaagcggagaaaaatcttcggacagaagcagttctaactcgtcaaacgaagacgatgatgaagacaacagttcctcaagaagcagaaatgtttctgggagcggatcaagcgagagagacttaaatatggataatgattagtcttaacgacttaaaatatagctgaaatacttgtttgaaaggggaatggaaatgaaaccgaaatacaaaagaataatgataaagttaagcggagaagcgatggctggagacgaaggctttggtcttgatcataataagattgacgctatagctaaagagataaaaaaatgttatgatatgggaacagagataggcatagtcatcggcggcggtaacttttggagaggccgcgacggcgagggtatggatcgttcaagagccgatcatatgggtatgcttgctactgttataaattgtctcgctatgcttgacgcgcttgaacagctgggcgttgaagccagggttcaaacggcgattgagatgagacagatagccgagccttacataagacttagagctggaagacatttggaaaagggaagagttgttatatttggctgcggaacaggtaatccgtttttctcaactgatacggcggcggctcttcgtgccgcagaaataggcgctgaggttatacttttagctaaaaagatagatggtgtttatgacagcgatcctaatataaacccggatgcaaagaaatttgataaattgtcatttatggacgttcttaataagggattaggagttatggacactacagcggcaacgctttgtatggataataatatacctttgctggtatttggacttgatgaacctgaaaatattgttaaggttttgtgcggcgagaatattggaactatagtatcttaaattataatataaaaagaaagggatgttagatatgaaggaatccgagaacaaaatgaagaaagcggttgacgctttagagagaaatttatctcaaattcgtgcagggcgtgcgaatcctgcaatattggatagggtaactgttgaatattatggtgctcccacacctttggcacaagtcggcactgtttcagttccggaagcaagaatgattgttattcagccttgggacgcaagtattttgggtgatattgaaaaagcgattaacgcgtcggatataggaattcatcctaataatgacggaaaggttattcgtttgaactttcctcctcttgatggtgaaagaagaaaagagttggttaaggaagtttcaaagcgcggcgaggaagctaaagttgctgtccgcggtgtgagacgtgattctatagagcgttttaagaaacagaagaaggccggagaaattaccgaagacggtcttcttgaccttgaggatgatattcaaaagctcactgacagatatattaagcttattgatacaatagttaaagaaaaagaagatgagattttagaagtatagacagttcggaaggggtatgactgtgttttttaaaatagggaggagaacagcccattccgggaagcttgatttaagccgtgtgccgaaacatattggtattattatggatggaaacggcagatgggcaaaaagaagaggtttgccaagaagggccggacataaagccggagctgataatcttgagagaatatgtgattattgcaactcaataggagttaaggctttaacagtatatgcgttttcaactgagaattggaatcgtcctaaagatgaagttgacgcgctgatggaactgctttataattatcttttgactgttgaagagaagtttaagaatagaaatatgaagcttcaaataagcggtgatattgctcctctttctcagaaaattaaagacgcgattgttcatgcggaagaagtcacttcaagcggtgatggacttatacttaatattgctttaaattatggcggcagagcggagatagttaatgctgccaggcttgccgctgctgcggtttctgaaagacaaattaccgttgaagatataacagaggagtattttggagggcttatgtatacttcgaatctgcctgaagtggatttgataatacggcccagcggcgaaaaaaggctgtcaaattttcttttatggcaggcggcatatgctgagttttggtacagtgatatatgctggcctgattttacaagtaaggatatggagcaggcgattatagattatcagaaccgtgacagacgttttgggcggatttgataaaaataaattgtaattatgagctttgttttaatttggattatttaagaaatttttgccggaaacgcattatttggagttggatagtttatttacggctttaggaggcgtggaatttgaaaccgagtttaaagatgagggttttaacagcggcggttggagtgccggttattgttttgattttattggctccgacttgggttatgctatgcacggttatattgtgttcgcttattggaatttatgaattctacgacgcagtgaatatgaaaaaagaagtgccgctgctttgtctgtttggttttttagggaccgttatactccctttgtgtgcgtttttgcttccgaaacaaatattaacatgcgcctatggatatcttgttattttatttttggcaatgctcggcagcaatcgtaaaataatgattacagacgtggcaatgctgattataagccttatctatattccttttatgctgtctcatctcctttttataagacgtttagattttggaaatatattggtttggcttgtgtttttaggtgcgtttatgactgattcgtgtgcattttttgccggaaagctctttggaaagcataagctttgcccaaatatcagccccaaaaagacaattgagggagctgtcggcggagttataggctgcggccttggatttttgctgtttgcttttattattaatacttttatttcagcatatataggcggagcagaaatgagttatatgcttatgtttattttgggtgtaatagcgtcttttgtagctcaaatcggcgaccttacagcgtcgcttattaagaggcagtttggaataaaagattttggaaaaatgttcccgggccatggaggaatgcttgacagatgcgacagtataataatggttgctccggttgtttttatttttgcagctcagataagtttgtttatataaaagtgtatgtttaataattttataactttaatttgaaagcggtaaagggatagggggatgtttgctgcctgtcccattatcgtttttcatttttgttggtattataatataaatatggtgatataatgaataaaagggaaaatttggatttaagagtttcaatattaggctcaacgggttctataggaacccaggcacttgaagtaatagatgatttaaaaggtataaaaaatattcacgttattggtatttccgggaataagaatataaggcttttggaggagcaggccagaaaatatcatccaaagctggttgctgttccgaatgaggatgacgcgaaacaattgaaaatatctcttgctgatacatctgtagaagttgtgtcaggttctgaagggctgtcaatggttgctgcagactcggatgtcgatatggttttgtcagctattgttggatttgcggggcttgttccgacaatgcaggctattaaatgcggcaaggacatagctcttgccaataaagagacgcttgtaaccgcaggtaatctttttatggaagcaatagccaaaaataatgtgcgtctgcttccggttgacagtgagcattctgcaatatttcaaagtatgcttgccggaaatcacagagaggtaaaaaaaatattgctcaccgcttcgggcggaccattttttggaaagacgagaactgaattagtgaatgtaacgaaaagtgacgcgctaaaacatcctaactgggatatgggagctaaaatcacaattgacagcgccacgcttatgaataaaggcctagaggttatagaggcaaaatggctgtttggcgtggatattgatgatattgaagtcgttgttcacagagagagcataatacattctatggtagaattttgtgataacagtataatagggcaaatgactctaccttctatgaagcatccaattcagtatgcgtttacgtatcctgaaagacttccgtctgctgatatgcaggttaattttaaggaattgggtaaaatgactttttatgagcctgaccgtaaaactttcaggtgtcttgatttagcagaaaaggcaggaaaaattggaggaaccatgccaactataattaacgcggcaaatgaagcggcagttaatggttttcttaatgggaaggtgaaatttttagagattgcagagattgcagagagcgctatgagcgagtttagttcgattcagaatccttccctaaacgatattattgagactgacagagaggtgcgtgagactatatgtcaacgtttttaacaattttagcggctattattatttttggagtaattattcttattcatgagcttggacattttataacagcccgtattttcggtgtgacagtaaacgagtttgctataggtatgggaccggttatttataagaaacaggggaaaaataccttatattctatacgtgcagtgccgatgggcggattttgcgccatggaagcagaggatgaggaaagcgacagtccgggggcctttactaataaaaagccgtggaagaggataatcgttcttgctgccggagcggctatgaatattattatgggatttattattgtaacaattatagttataagttcagcggcttcaacaggcggaataacctcaacgactattgacactgttgaatcccaaagcgacgccgcaaggtttttgcagccaggggataaaatagttggcattaacggaacaacagttcatataaagagagatatttcttttgaattgggtcagtacagcggtgagggagaatgcgaattaaaatataaacgtgacggaaaagtttatactgaaaaatttactcctatgcagaccaccttagaggatggaactccatattattatgtgggatttaccgttaagcagaattccataaatcctctgtctgttcttcatgaaggcttttatcaaacaatttggatggtaaaacttgtatttgtatcgcttggtatgctgctgaccggaggtgccagcgtaaccgatttatccggacctgtcggcgtggtgtctgctatgagcactgttgcaaaaacgggattggctgactttattttctttgccggtttccttgcagtaaatatcggtgttatgaatctccttccgctgccggcgcttgacggcggaagaattctgtttgtgcttattgaaatgatattcaggaagccgatacccagggataaggaaggatatgttcattttattggatttttgcttttaataggactaatgttatttgcaacttggaacgatattgtgagactgctgtccggatttttcgggtagcagcagataataatttaaatctcttacagcaacaagctgtgagagattttttaattaggagactaatagactatatgctttttatatttttaaaaaattatttatgacattaattctgccgccaattttgatgtatgataataatgcagaacagcagaacgtcacgcaaaataataaatttatattcttattgattattataagaaatcaaataccttataggtttctgctgtaacgtaaaaacaatatatttttaaaaaaacggataacctaaggagttatcggaccagatttggtgccaaacttgccgtacaagagcatgtgaatgcagtaaataatctgctaccataaaaataaacattaactgctactttacgttaattttttatgctgttataatacaaatataagagaaatgaaaaattaaaaggagtggcaattatgaaaactaatttgaaaagaagattgtgtttaattatttctctggtatttttactgagtgcagtaagtttttcagctgcagcgaatcaaaccactgtgtctttaattcacagtgagggctggcttgaaacagcatatgtgacttggaatgaatattcgggtgctgatggttacaatgtttactgcaaacaagccggaggggaatattttaagctggatgatgaattggttagaacatatccgggatatttcagggcggacgctttgggactgcctgagggtgaatatattctaaaagtggttccggtaaaaaacggcgctgagataactgatgcatcagccgaaacaggagcgctgtccgtgatgaaacatgcacgcgagggttttgctttttctaaaaattctccatacggaacatcaagcggcgcgtataatgatgacggcacacttagagaagacgcagatgttatctatgttacaaacgggaataaagataccgttacaataaacggcgatgaatcgttgggagttggtctttataatattttggcttatagggagtcaaagaagataaagacaactttgtgcataagacttatcggccgtgttgatgaaccggcgttaaccgacaatcatacagtgaggtttattaacacgggtaatataactttggaaggcgttggcgacgacgcgctaatatatggctggattatcacactaaaaagaagcagcaattttgagatgagaaatttcggaatgatgtacggcggtgaaggaaccacaggttcggctgttgttcttgatactgataataaaaacttttgggcgcacaactgtgactttttctacggtgcgccgggcaaggacgctgaccaaattaaaggcgacggagctatagatattaagtccaggtcagattatgtgactgttgcgtataaccatatgtgggatttgggcaagacttgtgtctcgggcggtccgtgggaaaacagcaatatgtatactgatgaagccaagatttatgctacatatcatcataactggtttgaccatacagactcaaggcatccgagatgcgtagttggcagcaaccatgtatataacaattattatgatggcaatgcactttatggaatcggtgcggcaatgaaaacatcggtattttcagaaaataattattatagaaattgtcaaagacctatgataatagcgtctcagggcagcgactgttacaactctgaaacaggaacatataatgataagggaactctttcaggacaaatgggcggtatgataaaatcctacggggacgtaattgttggagcaaaaaggttttatacatatcagaatactcctgacgagggagaatttgacgcatatatagcaaacagccgtgatgaggttgtgccggaaacggtaacagccaaaaaaggcgatgaagtaggaaaagggacatataataattttgataccgaccccagcattatgtatgagtacagtgtagataccgcggaagaagctgttgaaaaggtaaaaaaatatgcgggcagagtaaacggcggagactttaagtggacctttgataatgcggctgaggatacgaaccacgaaataattcctgaacttttggaggctataaagtcatataagtcaaaactcgttgctgttgcaggaggcgctgttccagtagaaccgccttatgtaacgcctacatctgagcccaccaaagacccggatgcaacctcggcgccaacggcaaaacctccgggagatataacaaaaataccaacgggcgtaaccagttatgcaaaggattggttcggcggagaaagtatgtctgccggagatatatcaaatgatggttatgtcggctgctataagggaaccggaaacagttataagacaaataagtttacggcaggagatgtatcaataacaagaggatatcaaactaaacaggtagattcacgttcattttattgtattcctgaaagtgaatgtttggtaacggtgtatttttattcaaacggctccaattatttagggttgtatactaccgatttaagcacaccggcagctacttttacacctgaggcaggaggggactgttcgttcgcctatcattttacagaagtgggatcgccattgtatatagccggacctgtcggagatataaatttggctggtatttctgtcacagaagcgggcagtaatccgacggaaagcccagcacctacatcggttccgtttgaatatcaaataaacagcgccgaatatattaacgggaatcttgaagttgagataaaatataataaaacagacaattcggaaaatgcaagtctaatcgctgctgaatacaataaatccggaatactaattggtattaagacggctgacgttttaggcagtggaaaatatgttataaatggattgcaggagacagcagaaaataaagttgtactttatatttggaatagtgctgataaaattacaccgctttcagacagttacgaagttaaataatagaaaataaattaaaagtaataaatttcttcccaattaaaaaactgcataggagatttatgacaaaaaataaaaattattagctgttctatgatccggtattataataccggatcagatttttttaaaatattagatgtaacatggtttgtaaatttcattttaatagtgaagataaaattaactaactttatttattaagtcttatgactttttttgttttatttaatgatttaaaatattaaaaaatatataaaaacaaaataataaacagctatgttattttgggttgtaaaaaaagtatttactataactttagtgttatggaaaataaatctgaaaaacttaaatttttcggataatataaattatataaatttttacttgacaaaatttttaagctatggtatattatatcggtaaccgcgcagaaggggttttattaagttgcggaagccaccccaatggcgagtcttgggtaataggaggtattacgattatgtacgcagttatagaaacaggcggaaagcagtataaggttgaacagggcgatacagtttttattgaaaagcttgatgttgaagccggagaaactgttacgtttgataaggtcttgattgtcggcggtgacgacgttaaagtcggcgctccttacgttagcggagcaagcgttacagctactgttgctaagaacggcaagtcaaagaaaattattgtttataagtacaagcctaaaaagcattatcacaagaagcagggacataggcaaccgtatacaaaggttgagatttcagcaatcaatgcgtaagtattgattttcataatttttgatagcaaggagtgattaagaatggctcataagaagggaatgggtagtaccaaaaacggaagagattccgagtccaaacgcctaggcgttaaaaagggcgatggtcagcctgttattgccggaaatatcctcgttagacagagaggaactaagatttaccccggagtgaacgttaaaaagggtagtgatgatactttgttcgcactcgttgacggaagagttaagtttgaacgtaagggcaagacaaagaaacaggtttctgtttacgaaattgttcagtaatttaaacagctatagtggggtggactttgtccgcccctttgtttttatatattaagtttaaaataattgtataggattattgttttaaacttaatatatagttagagctatatccagcgctcttagagcggaacaggaggaaaaatatgttttcagacagtgcgaaaatatttattaaagcgggtgacggcggaaacggagcggttacctttcatagggagaaatacgtggcggccggcggaccggacggcggcgacggaggaaaaggcggaaatgtcatttttgttgctgataagaacgttaatacgctggttgatttcagatacaaaagaaaatttgccgctgagaacggcggaaacggcagagacgcgaacaggaatggcaaaaacggcgagcatcttaggattaacgtccctgttggaactatagtcagagatgaaaaaacgggacttgttatatgtgatttgaaacaggacggcgaggagtttgttattgcaaaaggtggtataggaggctggggaaacgcccattttgcgaccgctaccagacaagtgccgagattttcaaaaccaggcgcgcctggcgatgagagaatggtaactttggaattaaaattaatcgctgatgttgggctgctgggatttcctaatgtgggaaaatctacattcctatccattgtcagtgacgcgagacctaaaatagctaattaccattttactactctgcagcctaatttgggtgtagtgaatatgggtgacggttcatttgttgtagctgatatacccggaattattgagggcgcacatgaaggagttgggcttggtcatgagtttttaaggcatgttgagagaacaaagctgcttctgcacgttgttgatgtttcaggaattgaaggcagaaacccgattgaagattttgatacaataaataatgaacttaaactgtatagtgaaaagttggctcaaaaacgtcagatagttttagctaataaatccgatataccggggtttgaagaaaattatgaggcgtttaagaaagagatggaggacagagggtatacggtctttaagatatcggcggctactaaagcagggataagcgaagttctgaaatacacctatgaaattctttctaaaattcctgatgaggagtttgaagaagaatacgaaatgtttgatttggagtcagacagaaaagctgacgatacgattacagtcagtgtggaagacggagtttatcatgttgagggcagacgggcacagtttattgtaggttctaccaatatggaagattatgaatccctgcagtatttccagcgtgcacttataaaaagcggtgtaatagacaagctaaaagaagccggaatccaggacggagaccctgttgaaatatatggatgtgaatttgactatgttgaataattttttaaattggcttagtatctcggggtttaataatttgcatatactggagtctgtaaaaatatatttgatgatgctgccttttattgtattggcgcagtgtttaatagctaaaaattcacataaattaggtaatgattataatctgcaccgtgtcattacggtgcagattttctgctttctatgcgtcggcattttaacaacaacaggtgttcctgatataaaatatattattgctcataaatattcactggacttagatattattaattatagcaaagcggcaatggaaaggttgtctcctattaccagcaaacttatttatctttttaatccggctgaaatacatattaatccgtatcgtatgtattttaatgaccaaatgagttatattctgaacgtcattttatttgttccctttggattcttattctctgttctgagtattgataaatcaaaaatcggatggaaaaggattgcagtaataggttttttgttttcattttcaattgaatttattcaattatttaataggagaaccacagatttagatgatttaatcaccaatacattcggagcggttttgggatttataatttatatgatattatataaaagaaaaagattgaattttattacgaatatgcggtgcagcggaagttttataactctttatgaatgtgaaatatatattgtattaatatatgttttatggttgttgaacccagtgtaaattcgtgtgaaattataaataaaaaagaaattatatggaaaatattgacatgaaatgtatttcatgttataatagcactaattcaatttgaatggtgctatttttttgttgtatttatataaatgtgaatttaaagaacaaattttggaggataatttatgaaaaaaagaatttgtttggcagtgtctgcagcgctgatttcatcttgttgtattggatatagtgttttttctttagaaaaaccaaatatattcgttaatggaaatcaaatagaaaccgacgcttttattcaggacggcgttacctatgttcctttgagggcggttagtgaaagtttgggcgcagatgttgcctggaatgaagaaacacaggaaattaatattagtcagtctcagtcaggcgcggatatttattcatatgctattaataaaatttcgcccagtactgttgctatagtggggaactataccggaaacactaccgcaacttatcaggataaatatgcggagggtatagctcatggtaccggagttgtaattacgtcggggggagaaatactgacaaacgctcatgttgttgaggatatgtcgtcaataattgtgattttgtcaaacggcgaaggttatgaagggaaagttaagtatatcgacagtgaccttgatttagctgttgttaagattgaaaaattgggtcttacggtagctcagtttgctgatgaaagttcgatttatccaggaaatcaagtagttgctgtcggaactccggtatcaatgtcactgcggaactcggtttcagccgggattatcagcggtgtaaaccgaagcacttcgagcgattataagcttattcagaccgacgctgcaattaatcccggcaacagcggaggtccgctggttaatttaaacggagaggttttgggtatatgttcttccgggtatgttggaacaggaattgaagggctcagctttgcgatacctatatcggacgtaaaatatgcaataaatcaatttcaaacatacggcaaagtaaaaagaccaagctttggaggggagttccaggagagcgcagctgcgaaatatggactgccaagtaatgaaggcctcacgttctcgggaatagttccgggcggagccgcagcaaatgccggaatacagaatggcgatatattaatctctgtcgacggcgtttatgtaaattctaaaatagactggaacgaactatcaaaaaactatttgcccggaagcggtgccggcgtgcaggtaaagcgaggggatagttttatagatacatatataacttttgatgaaaaataaaaatataagaattaaaagcggaggaaaataagatgaaaaatatttttaaaaaattattggctatggggattgcgctgatgatggtgtcagcatgtgtttatctgccggcatttgcggcttccggagacaatgaagaaaacaatgaaaatatagttgtaggcgatattttagacgagataggcaatgaaaattcagataacaatgaagtaactgaaaagaaaattacaattgcgtttaaaattggagacagtattttaaaaatcaatgatcaggatgttgctgtaacaacaccatatgagcagaatggcacaacgcttgtgccgcttagggttataaccgaggcgtttggagccactgtagaatggaacgacgctgatatgggcgttacacttacatatgaggatgttgtaataaatatatggatagacaggacggatgctttggttaatggtcaaaagactacattgcttttggctcctcagctgacaaacgatactacaatggtacctcttagatttattactgaaaattttggcgccgatgtttcatacgatgacgctacagaagctattttagtggagaaaactatagttgaggaaggagctgtaacagattattcttctatactgcataatacggacaaagagtatataggagacagctattacggatggtctatgaaagcgtcaaaaagtttaagcgtagcagaccgtgcgtttgatggaagaaatactgtttttgcttatggagataaagcggctataggaatatttataacaagattaaacggtataacaaaagatgaagtgtttacattatttaaagagactgcaggtaacaaaactattacaaaacagtcggaaagcaaagattctcaaggtaatgattgtcttataatagaaacaaaatcatctactataaaagaatatcagaagcatattatatctgacggactgctttatacagttttagttgaagtcagtctggacggtggagacatggattctatttctcttgctgagacattttccataaacgtaaaggattttaaaaacgctgtggatttgtcagacgttgtaaatggcaagagaacttatgagaataaaaacttaaagttcaaattagatatgcccgccgactggtatgagtcatcaaataaagatatagaaaatgttataacttttacaaacagagaaagttacagtgataactcatacagctatgttggagtatctattcaatccgtagataatatttcttctattgatagctgggctagacatgactatgagggaaataaagaattatataatttggattacgcagaattcagtgacagcgtgaaaactaaatcatttttaggaaacgatgcaaagtattacacatacagtgttaagaatagtgatggcaaagtggttgaaactatggaagacattttctttgttcagggtgattatgcttataattttgcattcaaggttgttggaaacggcgacgctgatatagaggcgataaagaagtctgttactgttaaagatattgacaagtctaaagttggaagtttgttggttaaacaagaggatgatattacatatacaacagtaaatgggtcagctaacgtagaatactccgcaccgatgacatggaatataaaccgtgatgctgggagcaactcttcaatggtaaataatggcgtagatacgtctgttattgtttttgcaattgatggaaactatcgtattgaggatgctttgaattcaatgcttaaagattattcaaaaaagagtaaaaactataagttaataaagccggcctcttatactgctgtaggaagcaagaaaggataccgtgcggttttctcttatgaagataatcaaggtttggcttatataatggatatttttatttgcaatgacggtaataattgcgttcaatgtatgcttgatactccgatagagtattatggagcaaagaatataaagatttttgaaacagttattgattcggttaatgtaaaataatttcaagtttgaaaagggtttgcaagtaaacacctctttcaaaaatacttcacaaaaaacggtactctttttatggctaaaagtctgaagagagcgccgttttttcacgataatagaatattttgtgatttgctgtcataattttgtgttttgcatccccttttgtttaatactattataattagttatattttacaaattttaaaaatactcttgacaagcggggtaaaataagttaaaatatcagagttgtaaagttaatttgctttacaagaggttttatagactgagagcggactgaggtattatggagaaaaatgttaaagtcgcattattgtttgacttttatagaaatatgctcacttcaagacaggctgagagcatagatttatattataacgaggatttatcgctggctgaaataagcgaacatatggggataacccgccagggcgtcagagataatattaaacgggcggagaacaccttgtttgatactgaggatagacttgggcttgcatccagatttcttaaaataaaatctgatttgttgaaaattgatgatataatccgtgatattgaagcttctcctaatgtgaaatctctgtcagatgatataaaacataagattaatgatatattgattataatacatgatataaataatattgagacggaatagttttttgtgaattcggtggttttagagaatttattgaggtgtatatatggcatttgaaagtttatctgaaaaacttcagaacacatttaagaagctcaggggaaaaggaaaagtatctgagaaagatttaaaggcagcaatgcgtgaagttaagctggcgcttcttgaggctgacgtaaactttaaggttgtaaaagactttgtcagggatgtttctgagcgtgccggcggagcggaagtaatggaatcattaactccggctcagcaggtaataaaaatagtaaatgaagaattaataaaattaatgggcggtgaagctgagaagctgaatattgcttcaaaacctcccacaattatcatgatggcaggtctgcagggagccggaaagactactactgcggcgaaactcggcggactgctgaagaagcagggaaagcggcctttgctgtgtgcgtgtgacgtttatcgcccggcggcagtaaagcagctccaggttgtgggcggtcagctggaacttccggtttatgctgaagagggcgttaccgacgctgttggcatagctaagcgcggtcttgaacatgcggttcagcattctaacgacgtattcattattgatactgccggacgtcttcatatagatgaacagcttatggatgaattgaaagagattgtcagagaagtaagccctactgaaattcttttggtagttgacgctatgaccggacaggacgcggtaaacgttgctgataagtttaacagtgagcttgaaatttcaggcgttgttttgactaagcttgacggtgataccaggggcggtgcagcattatctgtaagagctgtaacgcagaagcctatcaagttttgcggtatgggagagaaactcacagaccttgaacagttttatccggatagaatggcttcaagaattttgggcatgggagatatgctcagccttattgaaaaggctgaacaggctttagatttaaagaaagccgaagaactagaaaagaagctgatgacccaaaagtttactttctcggattttcttgaccaaatggaacaaatgaaaagtatgggtcctattcaaaacgttttgggtatgattcccggagtgaatgcaaaagctcttaaaaacgcaagtgttgatgagaaaaaaatggctcatatagaggcaattataacatctatgacgactgaggagagagagcttaaagataagcttactccgtcgagaaaagagagaattgcaaaaggaagcggtacttctatagttgaggtaaacgcattgcttaaacaatttgagcagatgcagaaaatggttaaacagctttccggcggcaatatgaataaaaagtttaaaagaaaagggctcggcggaatgatgggcggcccgggaatgggcagcaaaggcggatttccgttttaagcttcagagctttacagcagtataaatcaatagaaaaataataaaatttatatacattaagaattaatttggaggatttaaaaaatggcagtaaagattcgtttaaagagaatgggagcaaagaaggcacctttttaccgtgtagttgtagcagactcaagatttcctagagacggaaggtttattgagcaggtaggaacatataatcctatggtagaaccggccgctgttgagtttgacgcagaaaaggtacagaagtggattggaaacggcgctcagccaactgatacagttaagagacttttaaagaacaagggtattatcgactaattttaaatagtttcccttgcgggaggatgaaaaaatgaaagaactgttggaatttatagctaagtcaatggttactgaccctgagtctgttcaggttgaggttgtcgagaaagaaaaccttacagttctgaagctccatgtcgctgaaagcgatatgggtaaagttataggaaagcagggaagaattgctaaggctataagaactgttataaagagtgcgggcagccgcgagaataaaaaagttgttgtggacattttatagtctaaaggttatctcgttttgagatagccttttaacgtattggatattttgcgtctgacaagaggtggcaaatatgaacacattcgaaagaatatatgagatagtaaaacaaattcccggcggcaaggttgcaacttacggtcagatagcgtctttggcaggaaatccccgtcttgcaagagttgtgggttatgctctgcatgtcaatcctgaacctgatgaaataccgtgtttcagagtggtgaacagaaacggatgcacgtctaaggcatttgcctttggaggcgaggatcatcagagaatgatgctggaacttgacggagtaatatttacagatgatggaagagtggatttagataaatgtctgtgggatggaaatgtgaatacagttaaaattgaaaaatcaagcgatattacagaggagtaaaatgatgaaagatgatttgctggagataggaaaaattgttaatacgcatggtattaggggagaggtaaaaatacagccttggtgtgatgaacccgagttatttgacgagctggagtatttatttatagaaggggaaaaatataatattgtgcgtaaccgttttcataaaacatgccaaatcgttcagctggaaaatgtgaacagcattgatgatgctgaaagatttaaaaatcaaatagtatatataaacagagatgctttggaactgcctgaggggagatactatattgccgatattgaagggctcactgtaaaggaacagaacggcagaattttgggcgttgtcgacgaaataattaagacaggaagtaatgatgtgtattccttaaaagatacattcaacaaaaagccggtgcttattccggttattgaaggagtggttcttgagacaaatatagacggaggatatatagtagtcaagctgcctaaaggtttgattgatgactaggaatttatttcttgtataagttttgaaaaggaagcggggatttttcagttatgaagtttgatatattaacgctttttccggaaatgtttgaagccgtattggataaaagtataataggccgggctaaggaaaaaggtttgcttgaattaaattatatacagataagggattttgcatttaataaacacaggagcgtggacgattatccttatggcggcggacagggcatggtaatgcaggctgagcctatttttaaggcgtatgaaagcgtgactgaagatttaaattataaaccttatactgtttatatgtctccgcagggaagaactttcagacaatccacagcaaaacgtatggcaaaaaagtatgaccatgttgttatactttgcggacattatgaaggggtggaccagagacttattgatgagataatagatgaagaaatttctattggggattttgttctgaccgggggagaaattgcggcgatggccgtggtagacgccgttgcgcgtctgatacccggagttttaaaatctgaggaggctttttcggacgaatctcactatagcggattgctggagtatccgcagtatacaagacctgaagtttggcataatgagaaggttcctgatatattactaagcgggcatcacaaaaatattgagaattggaaaagaaagatgtctatagaaaatacttttaaaaagcgcaagagcatgcttaacaaagctcgtttgacagaagaagaacaagaattcgtaaaaaaattaaaattagaaaataaatagcaattttaataatttaaacgccttatttgaggaatacttaaatgaggtgtttttttctgtactgttaaaactgaaagccattttttgtaataatgataaaatttttataaaacagttgttttttgtcttataatgtggtaaaattatatttaattataattgtaataagtatgtttgaaaacagtatataaatgacccagaaaggtggttgagttatcaatgaagtgtgaaaagtgtggcgctgacattccggcgggagcgaaaacctgtcccaagtgcaatgccgctgccccccaaaacaccgttccgcagaataaaagtgttaacacaactgataaaaataagagtgcgtctgccggaaagaaaaatacaaattccaattccaatcagaagttaacttcgtcaggcaagattaatacttcaggacaagctccttccggtacagaggataatgagtttgacagacagtattctctgatgtttgaaagtaatcagtcaaatgttggagacgctgattatgaaattgatgaatctttgaaaaagaaaagggaagcaagatatgacgacagttttgctaatatgacagacgacgagaaaatcaaggcgttagaagcggcaagattggcaagaaaagaaagacgcgaaaaaaagcaggcaaaaagaagcggcggtattttttcctcattctccggtcaggataaagaaaataagactgttaaagaaacagttgaaaccggtgagcgttctgattcttctgctccattcggtcaaagaagccataaagctaccggcgccgcagagagaaagattgaaagagtacagagttcttctgatatttcaactgtaagcggatctgccgataagtctgctgcagtagaaaagcgcccgaaaaggagcagcaagcgttcaaaaaactttaaggtatcgcctaaaacaggtttgatagccggcgttattgttgcggttcttgttatagcggttgttatagcttcagtaaatatggcgtctaaagttactgcgggtgttccggcaacgccaacggtgtatgctaaggataactctctttattcctattatggaggcaaatcagtagaggtcagtcagaatttcatcgccagcgaatatacggaaccaactgaaccaacagcaactccaaatagaaacagagatgatgacgaggaagaaactcccacgccggcaccaaagtttgaacccataaaagaaaaagagcttataaattatactgctgacggaactttgtcttttttccttgataatgctgatttaaacaataatacaggttcattgcagtatactcagaacggcaaaaaaaattctacagttaagattgcggataacgtatattatgatattgagattgctgaagacggaagcggagttttatatttgacggatactgatgaatttggtgccggaggaactcttaatttctggtctaatatctctaaaaaggctgtaaagctttctgataatgtgaatattggaaatttccgattcggacagaacggaaacagtgccttatatataacagaatataacggcgagtattttgtaggcgatttataccttgcagaaataacaaaaggtgaggttgctgaggctaaaaaaatagagtctgatgtatacaaggtatttggaacaaatccaaccggaaagtccgtggtatatgctaaaaactataacactgaaaatgagtgctttgaaatatatcttaaaaatgataacttaggtgaacctgttatggtcacagacggttccagaatagaacctatcttcctgaaaaattcagagggtatgtatataggcggaacgtatgaagagtattatcagagcttatattatgcgagtcttgaaaatggcgagaaagaaaaaattgccggcgggcttacagagataataaagatgagcaaggatgaacaggctgtagttttcagaaaggcaaacgctgagggaacggcttttgattatttttatgcaaaccaagccgggacagaaggtcagctgatagctgaaaatgtgactgtgcttgatgatgaggaccataagaaggtatcacagtttgaaataaatgacgactttactaaggccgcgtttattcagggatatgatcttgctaatgagagcggagcattgttttttgtttcaataacgaacggagtggttggttcagataaaaaaatcagcgacactgcttattcatgcaatataacacctgacggacagacaatcagatatgctgataattatgatataaaatggaatttggtaacactgaacgcatatacaggcgaacaatcgaaggttttggcgcaggaggttggcgcaggagcattttcttttgataaaacaggttcatatattgtatatgctaaaaattacagtttagaaaccagaacaggagacgtttattgtgttgacaataaaggaaaaactgttgaggttgttaaaggcgtaagttcatatggcctcaaaaataatggtgagatagtgtattataataaacaagacaacggttcaaactttgagttgttctttaccagagaagacggtaagaagtcaaagtctattgacaaggatgttaccaaggtggtattatattaaattattatgaaaaaaatcggaataatgggcggaacattcaatccgccccatttgggtcattttgttattgcagaacaggcggccgaacagctggatttatgcagagtattgtttatacctaccggcagaatagtttataaaaatactgataaatcggccggaggctgggacagatataatatgctggataaggttgtttcaaaaaatccgatgtttgatttgtctgatatagagataacgcaggacgagacgacatatacggctaatactctcgcaaaacttcggaaaatttatccgaataatgagtatgagatatattttattataggtgctgattctcttgattatatcgaaaagtggtataagcctgagaagatttttgaacagtgtacggtagctgttgccggccggacaggatttactgacgaaaacatgaatgaaaagattaatattttgagaaacatgtattcagctgatattataagaatagatgtgccgtttatagatgtatcttcaagtatgctccgggaaagagtgaaagaagggaaatctatcagatattttacggatgacagtattatagaatatattttaaataaagggctttatcaagcgtgtaagaattaattctacggaggtgtgccggtttgttagaaatcgacgggataaaaagtgaattaaaaaaaatcctcagtgagagacgttatatccattctttgggtgtggcggaagaagctgaaaaattggctcggagatatggcgctgaccaatcaaaggcgtatttggcaggactggttcatgattgtgccaaagagtttccgccggaagagatggagggaattcttaaaactgaatacggtgtgccggttgattctatgtcgcgtcttatgcccaaaattctgcatggaccattgggagcatgcgaggcgcagagaaagtttgaaatttatgatccggaaattttagacgctattaagtatcatacaactggcaagggaaatatgagcacccttgccaagataatttatatagctgattacatagagccaaacagagactttgaaggtgtcgaaaaactgcggcgcttagcttatgaaaatatagacgaggccataatagccggtatagatgaaactattttagatttaatcaaaagaggtcttataattcatcctgacactgttcatgcaagaaacgatttaataatcaagcgcagccagagataagagtgcgtgtatagacaaaggagaagtcggtattatgagaagaaaatcaccgtttcgccgcatgatggctgttgtgttggtgattgtatttgcgtttgtgggttttaatttcggtaaaatgttctttggcgataacgctgagtcaagacttacagaggttacaaacattattgtggcgggcgtcgatgtggacggttacagaacggacctcattttatttgttcaagtgaataatattgataaaaaagtgagtgttctgcaaataccgcgtgatactaaagttaataataagagaaatgataaaaagataaattccgcttacttttcggggatagagactttgaaaaaagaagttgaaagcgttaccggactgcatgcggacttctttgcaaccattacttttgacgcctttaaagagattgttgacgctttgggcggcgttactgtagaagttcctatagacatgaattatcttgacccaattcaggggcttagcatcgagcttaaagcaggaaaacaaaagctagacggcgagcatgctatgatgtttatgagattcagaaagaatgacgacggaacaggatatcctatgggagatcttgatagaaataaagcgcagaaagagttttattctgcggtcatgaaaaaagctttgagcccgattggaatattaaaagcaccgtttttatacagtgctgttatgaaaaacaccactacagacttaaacaatgccgaggttagggaacttatgtttgatatgtttactattggaaagaataatgttaatatatatcagcttcccggagattctaaatatataagtaacatctcatattttgttgtgagcgaaagagaagctaaagcaatgataagtgaaaattttagataataaatttaagtttgtattaagaaaggataaaaaatatggcaagtactaatgagacagtgaataaaattgtaaaaatacttgacggtaaaaaaggaagagatattgaagtattaaatatatctgaacttacaacaatgacagattattttataattgttaccggaggttctgatacccaggtaaaggctttgtgcgacaatgttgaagaggagcttgaaaaggaaggtcttacacctgttaataaagaaggatataagacggcacagtggattcttttggcgtatgatgaagttgtagttcatatttttcttggggagacaagagaattttacggattggaacgtgtttggaaagatggaataagggtcgacgtttcagacctgctggtgtaaaaacagaaatatttaaacgttaataacagtaatcaggaaggaatgaataggattgaggtacgattttaagaatattgaagagaaatggcagaaaaagtgggaagacaacggagcatttaaaataaatgaggatgataacggaaagccaaaatattatgcgcttgagatgtttccttatccgtcaggcaaccttcatatgggccatgttagaaattattcaataggagatgttgtggcaaggtataagaagatgcaggggtataatgttctgcatccgatgggatgggattcttttggtctgcctgctgaaaatgccgcaattaaaaacggacttgatcccgctgagtggacttggtcgaatatcgataatatgcgcggacagctgaaacggctgggattcagttatgattgggaccgcgaggttgctacggctaagcctgattattacaaatttactcaatggatgtttgaacagttatataagcataatttggcttacaaaaagaaatcatatgtaaactggtgtccttcatgcaaaacagtgctggctaatgagcaggttgttaacggcaagtgtgaacgctgtaaaagtgaagttgggaaaaaggatttggaacagtggttctttaaaataacagattatgctcagaggcttttggatgatattgataagctcggcggatggcctgataaggttaaatccatgcagactaactggatcggcagaagcgaaggagcggagataagatttaagatagacggaatggataaggaactcactgtatacaccacgagacccgatacaatttttggcgttagttatatggttattgctcctgaacatccggttgttggtgaactgataaaaggaagcgaaaccgaagcggaatgcagggagtttataaaaaaggttcagaatcaaagtgaaattgtccgctcggcgacagatacagaaaaagaaggcgtgttcaccggaacatatttgattcatccattcacaggtgaaaaaatacctctgtatttggctaactatgtgtttttggattatggaacaggtatagtaatgggagttccggcgcatgaccagcgtgattttgattttgctaagaaatataacttacctataaaaattgttattcagccaaaaggccaaaatatgaagtcggaagatatgaccgaagcgtttgcggctgagggtataatggaaaattcagatcagtttaatggaatggacagcaaagaggcgcttgcttctataattaaatatatagatgaaaagggtataggagagaaaaaagtaaactttaggctcagagattggctgatctcaagacagagatattggggagctccaattcctgtggtttattgtgaaaagtgcggcgaagtgttagtgcctgaagaacagctgccggtgattttgcctgagaacgtggagtttaccggtcagggaaagtcaccgctaagcgagtgtgatgagtttgtaaatacaacctgtcctaaatgcggaggccctgcaaaacgtgagacggatacaatggatacgtttgtatgctcttcctggtattatttgagatattgtgaccctcataatgataagatgccttttgataaagaaaagactgattattggatgaatgttgaccaatatataggaggagttgaacatgcgattcttcacttgctgtattcaagattttttacaaaggcgctgcatgattttggatatttgaactgtgaagaaccgtttgaaaatttactgacgcagggaatggtattaaaggacggaactaagatgtcaaaatcacttggcaatgtagtaagtcctgaagaaataatagagaagtacggagctgatacagcgagactgtttatattattcgcggctcctcccgagagggatttagactggaatgacactgctgttgaaggggcttatagattccttaacagagtttggagagctgttgaagatttaaaatgttatgttatcagtgatacctccgatatgtctgatttaaatgatgacgataaaaagttaaggcttgcggttcacactacaattaagaaagttactgctgattgtgagagattcagttttaatacagcaataagttctgttatggaaatggtgaacgcgctttatgtctataaggaaaaggtgaacaaggaagactataacaagtcggttataactgaagctttggaatcgttagttatattgctttgtccttttgttcctcatattacatcggagctttgggagcttatgggcaaagaaacagatataacaagcgaaaactggccgaaatatgatgataacgctttagttgtagatgagattgagattgttcttcaaattaacggaaagataagagataaactgaaaatcaatcctgatatgagccctgatgaaatgaaagagctagctttggaaagcgaaaaaatacaggagcttatagacggaaaagaaatagtgaagtgtatcgctgttcctaaaaagctgataaatattgttgttaaaggataaaaactggagttttgcaaaagcggcgggaagagcagactataaacatatttgggtgaatggttgttatgaacagagttagattaagaataaacagaagacgaagaaacaccattattataatagttattatagctgttttagctgcatttttggttccttattggactgaacccgggattccggtatttatgtaccattgtgtggcggatgaacccaggggcggagatgaaaatttatattgccgtccggctcagatagaagaacagtttaaataccttagcgacaatggttatacgactttgtttgctgacgagtatgaacaggcttacagcacttataagcctgttatacttacatttgacgatgggtatgaggataattatattgaattgtttccgcttttgaaaaagtaccatatgaaagcaacaatatttgttgtttcctcatatgtcggaactaaaggatacctttcggaaggacagctgaaagaaatggttggcagcggtcttgtaagcatacagagccatacggctcatcatgtggatttatccaatgaagataaaagtcatatggatcaggaattcagagagtcgtgcgcggctttagctaagataaccggtaaaaatgtcacaactatttcgtatccgggaggttactttaacgataaggtcctgaatgaagttcaaaggtattttacatacgcatatgcgatagacacaaatgaatattcaaaagataatcattatgaaatatcaagaggcggcgtgtatagaaatactactttggaatcgttttctatggcacttcgcacctattcacaaagacgccttatcagagagatgtttaaattaaagcataagatttttggataactataatgcagagactatagcggtctctgcattatttatattaaaatattccgcttgcagatacattggaattgtttatgtaaatgaaaaagtatgttaattatatacttttggtcttatcaaggcttaggaaataagtctgcgagtgattaaaaaacaaaagcactcaccgatttaggtgagcgcctttgcacttatcttaaataatatatcattttgatctgtttgtcaacaataaacgggttaaatattgacgcagtcaaaaatacagatcaaattttctccgaatactggtgtttcaaggtgttgtgttttcttgaacattaattgttatttaaagcttaagcggaagttttgcggttacagtttctgactgctgctgcatggtgatttacagattgcttataaatcagactacgcccaaagactgttgtaaaccgtctgcagaaatttgcataacttgtaaaacacagaactgtttattaattcaataaattagtgattgctgaggcagactttttgttattaaagcttatctatgatattgccatacataaatttgttttaacgttataaatatatggctgcacataaacagctttgcaaaggtatcagcagcgtataatgattcaattaaatattacttgaccaaaaaatcttttctttaatttctgggatttttaaagataaaaatttatttttgaggttattgggataaatttgctgctttcaaaaaatattggtctaatacaaattgaatatacctaaatctgacatcggcggtataatcggatttaggcgacgctgtttcaacacaaagacttaacaataaccaacatacaaacacttgatgttgaataggtcaatacatctccgctgtagctcaaaataatctggttctccttttattatgagcagcagaaaacttttcgtcacaagacgactattttcgccgctcaatgtattctatgaggaaaagccgtaaatgtgtattatttatttaataaattataagataaaaataattatataaatttataatatttaacaaaagtcctccgtttaattagaaacggaggactttgctgacgaaaaacgtcttaaaaagggggaattatatatttttattatattcttttgtaattataaaatcaactattaacttagtattttatatataaagatgatattactgtataatagataaaataatcagttgtttagaaaggatgttataaataacatatattttgcaaagcaaaatgtagaaaataaataagtaaaaactattgacctaaaacataaattatgttaaaatatttaagtcatgttaaatcggggctttagcggtgccttgtaaccctcaatccgctgtagaggggatgaaaacttgccatgagggatatctttgtttggtctgcctcgcataagtggtgttgacggtttggtcttacgcaattggaacctgtgaacctcgtcagggcgggaacgcagcagcgataagcagtcattctgatgtgccgtaagggtgccaaacttgagctaactgtgggagtaacgcttgtaaagctatttcgaatgcaagcacatggcttttttatttatctgtgctttttaaaagaggtgaaggacaggtgtccgaaaaataccaggctttatatagaaaatggagacctatgacgtttgacgacgtcgtaggacagaatcatattacggaaacgctgaaacatgagcttgcttctgaaaaaattgggcatgcctacttgttttgcggcactagaggcacgggaaaaacaacaacagcgaaaatattctccagagctgtaaactgtgaaaatcctaaagacggagaaccctgtaatgtatgtgatacatgcaagggtattatcgacggcagaattatggacgtttatgagatggacgctgccagcaataacggtgttgacgctatacgtaacctgcgtgaagaggtgatttatacaccggccggatgtaagtataaggtatatataatagatgaggtccatatgcttacgatacaggcgtttaatgctcttcttaaaactcttgaggagcctcctgaacacgcactgtttattttagcaacgactgaacctcagaaaataccgcagacaattttatccaggtgtcagagatacgattttaaaagaatcggcgttgatgatattgccgggagattaaaaaaagtagcggctgccgaggcgataaatgctacggaagacgcgcttgaacttattgcggaaatcggcgacggttcaatgagagacgcgctaagcgttttagacagatgttctgcttttggtgaagagctgcggcgtgaaaatgtttctgaaatagtaggaatagttgacgagagagttttgtttaatataactgaggatgttatttcaaataatgtcagcggagctattgcgaaactggacggacttttgaatatgggtaaggatgttctgacattctttgaggattatatagaacatcttcgttctgtactgctctgtaatgagtgtgaaaaaccggaaagggtgcttgaaaagtcaccggaggcgattgaaaaatacaaatctcaggctgaaagacttactgcaacgcagttgatttatggaataactgttcttaatgaatatcacggcagggcaaaatctatggctattcctaggattgcggcagaagttgctttgataaaattttgtaaacctaaatatagttctgaggttgatgcgcttaatgcgcggattgaaaagcttgagcaattaattggaagaggagctgcggcagttcagctacctgaaattaaatctgaagcagtacatcatgataaaaatcctgacgcaccgccatggaacgctcagtctgaaaataaagatatagattcatcacaaaaaaaggaagaacccaaacctgctacttcgactgaaattaataatatggcctgggatatgtggcctgaggcgttggaagcgataaagcaaagcagcaagagattgtatatgtatctgtataaggcggaagtcatattgaacggtgatacggtcgatattgaagtagggctgaaatcagcatatgattcagttgcaacggctaacggtatagattatctttctgagttgttttcgaaggtagcaggaacaaatttgcgcgccagagtgtttatgaaaggtgaacattcaaagaaggagcaaaccgggagtcaggcttcgataatggatatagtgaacaagaaagagcagtttggagatataataaaggtgaaaggagaacaataacgatggcaaaaggatttccaagaggaatgggcggcggaatgggcaatatgaaccagatgataaagcaggctcagaagatgcaggagcagatggcaaagatgcaggaagagatggaaacaaaaactttttctgctgaggtcggcggcggagccgtttctgcaacagttaacggaaagaaagaacttcaggagattattctcaaggaggaagctgtagaccctgatgatatagagatgctgcaggatttgatagttgcggctgtgaacgaggctatgagaaaggctgataaggacagcgagacgcaaatgaacagcctgaccggaggaataaatattcccggacttatgtaatattttataataatacttatacccccgacgttttatatttcgggggctttttattttaatctattaattttgtatatttattcacaaatcgaatgttgtcgaaatatattgtaatgtagaagatttttaaaatggcggttgaaaacttctgtttgttatgttagaatagtttgcaatggtaaatttatattcagaattaattctgagtttaaaggtttatcatttttggaggaatttgtatggaaatatattttgacaacagtgccaccaccagaccatatgacgaggtggcttcggctgtctttgatactatgagcaataactacggcaatccgtcatccttgcataagctgggcatagaggcagagcgtgccgtaaaaacagcaaaagaaagagttgccgcaggtataaaagcaaacccatctgaaattttattcacatcgggaggaactgaatctgataatatcgcattgttcggaacggcctctgcaaaccgcggaagacacataatctctacgcctttggaacatccggctattattaacactttaggcgaattgagagagaggggatataagatagattatacccctgttgattcaaatggaaaggtaattttaaaggattttgaaaggcttattcggcctgatacttttttggtgacagctatgattgtcaataatgagataggtactattgagcctatagctgaaatggcaaagattttgaaatctgtaaacccgagagctgtatttcatactgacgcagttcaaggatttgggaaagttccgattaacgtagacgcgttaggcgttgatttggtttcattaagcgcacataaagttcacggccctaagggaatgggcgcgctttatatccgccgcggaacaaaaataaaacctataatatacggcggaggtcagcagcagggtatgcgttcgggaactgaaaacgtacccggtatggtaggctttggtattgcagctaaaattgctgcaactgaccttggtaagaaaattgagaggatgtctgcacttaaagaaagattaaaaaatgggattttaaattctatagataacgttagaataaatacgcctgataataatgcgcctcatatattgaatgtatcatttgggggaacaaaggccgaggttgtgcttcattctcttgagatgcaggatatatttgtatccagcggaagcgcatgcagcagtcataaaaaagaaccaagctatgtgttaactgaaatcggcgttccaagaaagatgatagatggaagtattcgttttagtctttcagaattttcaactgaagaagatgttgatattactattgaggcactaaaaaagataattccgagattaagaaagctaaatttaaaataataattttatattaataaatatttttctactttaagataaaaatatagaatggagataaaaatgcagaagatagatttaattttattaaagtacggagagattgctctaaaaggtcttaaccgtcccttatttgagcagaagcttattgacaacatcgcgtctgcaacggctccgattggtaaattcagtatcaaaagggcgcagtctactatctatgttgagccgcttgaagacggtatagatatgatggaaaccataaagcgtctgcaaaaggttttcggcgtagtcaatatctgtccggcagttcgctgtgaaaaaaatatggacagcataaacaagactgctgtggaatgtatgaaatctattgactgcgccggaaagacgtttaaagtagaatcaaaacgcgaagacaagaagtttcctttgaattcgcctcaaatcagcagggaagtcggaggggaaatattaaaaaatgttaaaggcttgaaagttgacgtgcataatccggacatcactgttcaagtggaaatccgcggtgacgcatatgtttttgcggaaaaattcagcggcgcaggcggtatgccggtcggcagcagcgggagagctgccttgttgctcagcggaggaattgacagcccggtagccgggtatatgattgcaaagcgtggagtaactttagacgcggtgtacttccacagtccgccttatacgagcgagcgtgcaaaagataaggtggttgatttagcgaaaatagttgcccagtattcaaggggtataaagctgtatgttgtgccgtttacggatattcagcttgatataattgaaaagtgcccgaaaaattatcttacggttatcatgagaagaataatgatgagaatagctgaaaagattgctttgtcaaacggtgcgcaagcgcttataacgggagagagtatagggcaggttgcaagtcagactatggaagctctttactgcacaaattcagctgtaaatcttccggtattcaggccgtgtatcggtatggataaagatgaaatagtgaaaatttcaaagcagatagacgcttatgagacttcaatccagccgtatgaagattgctgtactatatttgtaccaaaacatcctaagacgaaaccaaaacttgatgagatagcagaggctgagaaaaatctcagcgatattgaatttatgataaatgaggctattgagggcgcagaaattttgtatattaattaaaccaattataatggtttagaataacttatagaaagaggagtttagatgacatttgagttattgtcagtgggaacagaattgctgctggggtcaatagtaaacactaacgcccaatatcttagcagaagactgagtgaattgggctttaatgtatactatactacggtggttggagataatccggacaggctgaaatcggcgcttgagatagctgccggaagagcagacgcggtgattactaccggaggtcttggccctacagttgacgacctcacgaaagaaaccatagcggaatactgcggtttgaaatgtgttatggatgaggaaagcaaggagcggataataaatcgttttcaaaaaggcaattcctatatgcctgaaaataatttcaagcaggcggagatgcctgagggatgtattattttaaaaaatgagaacggcacagctccaggtgcgatagttgagggagaagactgcatttttataatgctgccgggaccgcccagcgagatgaaacccatgtttgacaatagcgttataccatatcttgagaaatattctgacggtgtgatacgttctaaatctttgctggtatttgggtatggcgaatctgcggttgatgagatgctcggagatttaatgaacaattctaaaaatccaactgttgcgccgtacgccaaaacagggcaggtggaactgcgtattaccgcaaaggctgatactgttcaagaagcaaaagaaatgttaaagccaatggaggagaaaattatatctatactcggagacaaggtttacggcagaggtatagataattctatggagaatgttgtggttcagctgctgcgtgataataagcttaaagttacgtgtgcggagagctgcactggtggtatggttgcggaaaagataacaagtgttccgggagcttctgaatgttttgactgtggttatgtaacatattcaaatgagcagaagacagagcttttgggagtgagcgccgaaacacttaaaagcgcgggcgctgtatcagaggaaacggctttggaaatgtcaaaaggcgcgcttgaaaaatcaggagcggatattgctgtttcaataaccggaatagcagggccggaaggcggcaccgatgagaaaccggtagggctagtttatatttctgtgtgtactgaagattttcataaggcgtataaatttaatctcacaggtgaaaggggaatggtgcgcgagcgtgccgctctatatgcgctagatttgattcggcgctgcgccttggggataatagataaagaggctgaatatatttggtgataaattaataggagatggaaaacccatctcctattaattttaataaagtattttatttttacatttaatgcgctttagaatatttgtttatctgtattccgcggctgcgcgccttacgaggcgtacttcgcacgcccttccgatgcttgcaaaaccatattttttatattcttctaagactttttattacataaactcttttttctgtttaatttttattgattttgctttgttgacaataatatgttttaaatatagtgaaaatagaaatatgtgatgatagtgtcagcggctaaatgaacatcggcaggccggacacagtccgccgcgttaggtgaattttatctccgccttcttatgaaagcggaatataaaggtgaatttgtctgtacaaaaatttatgttaataaataatgttgtttgttagagtgtatcttattttgagtttatcattcggtctataacggtcaacgcttcatctcttgttatatagtcgttaggcctaaatgttccgtcttcgtatccgttcatgtatccgcagtttgtcatttttgacaccggtgtgtaaaaccagtcgttaaagtccaaatcattataatttacttcagacttatctgttacttcatatataaattttgaaaaaacagcggcaaactcggctcgggttatattattgtcaggaagaaatgtcttatcatcataacctttcataatttgtttttcgtaaactgaaattactgaatcataaaaccagtcgtctgttttgatatctttaaattcattttgatttacaggtttgcattcatcgacaagcagacgtgaaataatttcagccgtttcggctcttgttaaatatctatcctgcggaagcgtattgtcagtgtcacctttaatgtatttgccggggttctcctttaatcttggtgtaatttcaagagtgtttgcatttgcataataagcaaatttaaactcggcgttatccgccgctttcttgctcaaaacagcaaagattcttttttgggctgtaagttcgtctatcagtccggcaaattgtttcaagtcttccacagttgttgaaatcatttcatcccggacttttttaatgtcgccgtttgttttgccggtcagcgccatggtcgctccatattcagaattattatagtattcatcatattcttttactataggaacgattatcgcgtcaagctctttttgcgtcatgtccagagattttagataatcgtccattccatcccatatctttattgccaaatcaatatccgtaagaccggctactgaacataccataccggagtcatcaaaggaaacgccggctccgtacgcaccgtatttaccgcgcattgttggcagaatgtattttgttgtgagaacttttgcgagaacgttcattttaccggtgtaaagatttttgctgaaataacctgcctgcataaaatgatttgagtcttcaatattagttatcgcggccgcggaatagcagccaaccggcagatttatatgagagttttcagcttgttttgaatttttaaaatattcacagacagcagtcttaaaatcatcgtatccgtttccgccgacatattcaactgttggagcggtgtttaatattatattttgtaccatgtctttaagccttgtcaatatttgcggagcattatgtaaatcggtacctttcaaaaagtgataatacgtcactgaaccttgaccgatactgccgcgggttgatgaatatagtcttttttctgcggattgtgaggagtgcattaactcgtatgaaagataaaaagggtcgcggtatccattttttaaaatctcatcgggagctgttttgagatactcttcaaaatcgttttgattccaaatagagtcgttatccaaaaattctatcactttttcaagcagctcagtaatttcattgtctggcgaagacatggaaattattagctgtgggtcaaatttattttcatcattataactttccatcgatagtatatcaaaatacacatttgaaatatttaacttttgagcttgccttgtcaaaagtgagtttagcagctggatgtaatttaaatctgaatcttgaatagggaataacagactggctgttgaggaatcagttgatagtttttcagtataataaaacggaatattttcaacgttttcatatttgggttcatagtattcaggagcatttttaacttcatcaagcgaaagagaagggatgccggcgataacctcaggcgagtcgggttcatccacccaattattgaagttttccgtatcattttttatattttctatctcctcagaacttagtgacagcgtatcgtcatattcgggcgatttgtttccatttccggatataactatcttgctgtacggattttgaatgaaatatttatctaaaattactctaaagaactcaggattctcttttaaatatttttctgtctctgatatgcctgtataatagaacgggtcatttttatatataattccgtcaaataatgtgaggtccggcgcataaatataggggtcttttcggtttgatatgtattcgccaactgcgctgttcagttcgctgcagtcaaatcccttttcagaaaattgttttaatattgcattataagtgttgattatattatctttttcgtttataggtatttcagtaaccagcagagctgaatttgatataccgccgctgttgccgccggtgacaaaagtcttattgtttacttcattcattttttgcagtatcaggttaaaaattatttctcttgcatatagttcctcattaccttcagacatcattgcgccggaagacataaatccaatatcaacggtttgggtatcggaggtgatattatattcgcttatctgattttcaggcagttgttttgtgtcattaaaggctatatcaggttttttatttgaaaatccatcaaaaaaactgtctaagagtttcagggtagattttatatcctgcttgccggaaatataagtcatactgtttgacggaatataatagttgtgataaacccgcattaagtcgtcataacttaaagtttttataccttcagccgtaccgccgctgttgaatgacgggggtgtgtttccataaatttcagtatataatttatcggataaaaagtttattgagttttcggcgctttctaagttctttattttaagctcattgtatacaaccccgttatattgtacttttccgtcaatatattcaagccttattccctgctgtttgaaaatgttttcatcttgcagcagcataggatgaaaaatcccattcatgtaaacatcaataagattataatattccgttttatttgcagtttttatcgaataataagtgcagtcgtcaacggtgaaagcgtttatcatttctgcgagagagttgctgtttagataattcattatattcttggtcggatatttttcactgccgcagagcaaactgtgttccaaaacatgatttgcacccttattatcaatcggcggcgtcttaaagccaatagaaaattccagtttttcggagtcgttttcaagaaacacgacttcggcgcctgtttctgtatgcttatagtaataggcttttccgtttaagtcggaaatatcttttgtgtccagcagttcaaatcctgtttcatcatctaatgcgtaggcaggatttaatcctataaatattgaaaaacatagcagtattataaaagtttttgtcagtttcatattattttcactcctgtgcgtctattatttcttttgccatatttatgagttcgtctttagtgagttcagaatcagcggcgcaaatgctgtagtttaagccattatattcaaatgataggatttgtacgtcagatatttttatttcggcgcttccatagctaaatatatatttgcctgatttttcatcctttttatcctgctcagttaatcgataatctccgggaaccaatttgtttgtatatgcaaaatattttatatcgcttcctttatatgtttctgctgtgttagaatggttactttgatttcccgaagttgatttgtctatatcaagagaaatcatgtcttcattacgtttgtaatggcaatttagtgatttatagctttcaaaaattcttccgtcttcgctgtaatcctcgttctcaacaatataaccgctgtcaaaggtatatccgttcgaaaagttatttagaatttttgaagagataccaatatcatcttgaagtgtttctgctgttggaacgctgttatatgacggtatatttgaagattgagcgcctcttgaggtgattaacacatttgccgcccataccgagagacttaaaatcataaccgccgccgctgcaacagcggctatttttgatatttttaaatgttttactaatttaacagaattttcagcctctgttatcaaatcatcatctattaatccaattgttttgtatagctcctttttattcataatctaattccctgcctttccaggtaaatttttaattcgtttctaagtctcattaagatagactttactttgctttctgagaatttgtaatctttcgctatttttgaaattgagtctgaataccaataccgctttacaaatataactcgtttggttaaactttttgttttaagaaaatgactgataaattctgcaacttcacgagcttcatatttttcctccggcgtttctccgcctgataatatattttcaagttcagataattcagtttcaaattcacggttgcgcattgccgctgaataatagtcatatttgttgagcgctatatttcttgttatacgcccaagaaaagcgggcaggcagcgtggtttttgaggcggaatctgattccacgccgcataatatgtatcgttttcgcactcctccgagtcggtgatattttttaaaatgttgtatgctatagaatttatcagcctcccatacttggatgatgtttcagggatggcggattcatccctattaaaatataaatctattatttttttgtcgtccatggcaagagctcctttttatttttctgcctcaaatatatagtaagaaaatgataatgcttggttgcaaaattttgtaaattaatttttttcagatttatttaaaatttatattttaagtgttagcatatgaatattgtattttattatcgcctaaaagtctatcaaaaaacaactcaattttaaattttattctccctggcactttttgtcacttaatatttattataatgactataggtcaataatttaaataaataattaaaatctgaaaggagaaaaacatgccgaatttaactacgcctatacctccaaagcttacaggagctgcaggagatgatattaaggcaataaaaaaatgggggacggcgcttattgatgagctaagctatattttcaataatttggacgccggaaacgtgtcggaagcggcaagcgtaaaagctgaaaatattgatacttcaaacgctaaaatacaaaatgctcagattggaaatctaactgctgataaactcaggacgggtcagctcaacactaatttagttacggttgagagcgacttcgggaatctcagtatgagcggaagttctataataataagcgataataaagaggagcgttttaaggttgagtatgacccggatacaggtctgtttagttttgtaattaataactcagaaggaaatccgactgtttatataaacagttttggcaacgcggtattcagcggacgtgttgacagctcagagattttctcttcaactatagtaggcactgacagtgtttcatatctgcaaaaggatggcggagtttttgcggagatggatacaaagggtataaaaatacttcaggataaaaaccaaaagcggctgcaaaaattgggtatgtctgttggcgatgacggaaccgcttacatagtcttaggttccggagacggttcgggggaggttactataaacggcgttaaatactcaaacggcagttttgttatacaaaaaaactcgacatattcatcctttgggacagtgggaggcagcacagttttatcttttatggatgacggcgatttatggattcgaggcgatagagtattgataaacggaagagacgtattgaaagagattgatgaaattaaaaaacaaatataaataaaaaggagtaaaatttatgaaaaatgataggtacagcggaaaaataaaatcagaattttttggaaaggttcaggagtattttaaaatttatagggacaataaacaagaactggatcacagaatcattgataacaacaggtggtataagagccgttataattccgaccctgatgcggtgataccggagccgacaacaccttacttattcaatgttattgcaaataaacatgccgacgccatggataactatcctgaaccaaatattttggaaagaagcgaagaggatactcaggttgctgaaaagctgacaaaaattcttcctatgcagctggatttgtgtgattttaaaagaacttacagcagggcttggtggtataagctaaaaaacggagcttcctgttatggcatattttataatcccgattccggcaaaaacggcgatattgatataaagcgcatagaccttttaaatatgttttgggagcccggaataatagatattcaagacagcaagtttgtatttctgacagctcttatagaccgtgaagagctgaaagttaaatatcctcacatggcggataggtttaccggcggaaactctatggacatacttacatatgacgatgtgttaggaggacccgaccaaaatattttaagggacaagtgtttggttgtagactgctattataagaagacggacggagaaaaacaaactgtggagttattaaaattttatgatggaaatattttggaagcatctgaggatataggggaagacggtatttatgaccatggcatgtatccttttgtgttcgacgttttgtatcccgacgaagatagtccggtagggtttggatttgttgatatagtgaagaaccctcagttatatattgataagctggacgggcttatcagccgaaatgctttgatatccggaaaaaccaggtttatggttaaagataacggagggttgaatgagtatgaattgtctgatttaagccgtgatattattcacgttgccggttcggtaagcgacgaaaatatcagggaactgcaggctaagcctatgcatagctttattattcagcaccgtcagaataaaatagaggagctgaaagaaattgccggaaacagagattttcagcagggagatacgcatggcggagttacggcatattccgcaatagtggcgcttcagcaggccggtgaaaaactcgccagagatatgctggtaacaggatatgacgcgtttagagatattatttatttttgtattgagctgatgagacagttttatgatgacccgcgttcttacagaataaaccgcagcaatggaaaaggcgagtatgtaacattttcaaaggatgatttggaaaatggttatcatagggctgagtttgatatatctgtgagcgctgaaaagaataacccttacagcagaatagcccaaaatcaaacattaacggagctttggcagatggggatatttgacccgaagcaggcggacgcgtcaatactaatgctggaagccatgcacttggatggaaaggaaaagataattgaaggacttaaaaatttaaaggctgagtatgaagaaaacataaatacggagcttgaagttaatggtgaaaaaataaaatcaccgcagcacaagccggctgcggtgggtgtaaaaactgcgaatatacaaaatgcaacacaagtttcgtaatcacattattactttcccgaatgtatagataggttcagaatcattgaaaaatatgggagtatatctgggattgattgaagttagacacggacggccgtttattttatcaagttttttacaatatgcgtcaccattgtatagaaatattcctatatctccaaatcctatgtgaggcatatatttgatataaactatttcaccgtcacaaatatccggttccatgctgtcgcctgaaatacgtattccggcgtctgcttcaggaggagcgggcaattccattacttccatatcatcatcggttatataattgcccagcccggccgctgccggctgcatgtatacaggtataggccgcattctgttatgaaatttaataactcgtttatccaaatatttgttgtattcataatttaaacaattaagtactgcttcaaaattttcagggtcacgagagatttcacgcagttttgtgatagctagattgagttcagtattgtatttaaatttgttgtattcagtatttgcgtcgcaaaaaaaactgtatacgtcatcaatgttatattcccggcaaagttcaagaaatgttttgacgtccggttcggaaataccattttcccaggcgctgaatctagcttgttttataccgaatttttcatagacctgtttttgggaaagtccggaattgtatcgtgcctgtttgagttttttactcaagtttttatttgccatataatcacctcctgtcataatatatcacattttgtagaattaatcaaggaataaaatcgaaaaatttgttattttatccttgacaaataaaaaatttgttatataatggttgtgataacaaaaaaaatgttgggatttggtgtttatggtaataatgtgtaagtaaaaaatgttagtcttatattttaaatcaggtatttataaacatttatataggataaaaaattatttttttaaaagtaatgtgaaaataaatcacaaaatttaataagaaaggaatatgaatatgacgcatcccgacataaagtatatagaacgttatggttataccagaggggagctggaacgcggcaggccggtcggtatatgcctgttttgcggcagtgaggtttttcagggcgatgaggggttcatcaagagctttgacggtttgttttgtaatattgaatgctgccataactactatgaaattgattcacaggagtaaatgtgaataaaagaaaggagaatatattatgaaattttcaaatgcagaccaagtcaaaaagtggctgagattgctgccggttgcgagaaaagaaatgaatgctaaaataagtttttataatcagctaataaatgattttacaagagttgaatatactgagaatgaaatagtgagaaatggattatcgaaaaatacatataaaggtgaaattaacaatgttcatttttaccgttctcagattgaggagtgcaagaaaaaatatgataaactgctgaaggattgggaaagactttcaaaattgttagacagcgaagagataacattaataactgaaaaatatttgaaaggcaacagttgggactctatggaattcgttatgttttacagccgccgccaatgtttcagaatacttgaaagagcggctgaaaagttaataggcgagacggttggagaataatatggcagagtttgttaatgagaatcataataataaaaacgaccaatccaaagaatatataaataaagatttaaataatggggaaattacaaatgttataaaacagagcgaggaagttaacagagcgatggaagctttaaataagatacaggaactgctctgctgcggagacaaaagaattgaattatctgcggctaaggagatattaggtcagcttggtatgcccggtgaacttgggggagaaaatgaaataacaaagcttgaagttgaaataaaggttatataggatggggtatacaatatggattcaaaattaaagcttgaaatcacaaagacgcagcttaaatttatagagtcaaaagctgatgaagtgctgttcggcggcgcggccggaggcggcaagtcatacggacaattagttgacgctttattatttgccttgaaatatcccagaagtatacagctggtattgagaagaacatttcctgaacttgagcattctttaataatgaattctcttttgatataccctaccagcgtggcttcttataaggtgagttccagaaagtggatatttaaaaacggctcggtcatcgaattcggattttgtcagtctgagacggatgtgctgagatatcagggagctgaatatgacatagttaggtttgacgagctcactcactttactgagaaccaatatacatatcttttatcgcgcgtcaggggaacaaacgggtatccaaaacagataaaatccagcacaaatcccggcggaatagggcataattgggtcaagcgaagatttattgacggatatgagccaggggttgagcataaaactgaatttgatactaaacgattgtttattccgtcttttgttcaggataataaatttttgatgaatttggataaagactatataaaaaggcttgaacagcttcctgaaaacgaacgccgggcgcttttattcggagaatgggatatattcgacggtcaggtgtttaccgaatggaaaaacgacataagaggctataaatcaagaaaattcagtcatgttataaaaccgtttgaaattccgaaagagtggagaaggtttagggcgtttgattttggttattccaagccttttgcggtatcatggtatgctgtggattatgacggcagagcatataattaccgtgagttatacggctgtgccggaaagcctgatgttggaataagatggacggcgcagaaaatagccgataagatacttgaacttgaagaagatgagacaaaagccggatgtaagataaccggaattgcggatccggcaatatggaacgctacaggaagcgcagaggggagtattgctgagatgatggaaaaacgcggagtatattttgaaaaagggaaaaatgacagactggcaggaaagatgcaggtgcattacaggctggcttttgacgctgaaggttttccaatgctttacttttttgaaggcaaatgttcaaacatgataagaaccttgccggaactgaagtatgacagtataaaccctgaggatgttgatacaaaacaggaggatcatttatatgacgcgcttaaatatttcctgatgtcaaaccctattactccaaacaattttgatacttctgataatattgaagagtattctcctatatggactgaaaaaaacagttcttttgaaagatttatagtataaaagggttgtaatattttaggaataatggtattataactttgatattaatttttgtttggaaattgtaaacatggaggattaaaaccgtatatgaagagtttgggaatagatttcggagatagcagaactggctttgcagtatctgatgaattggggttcggcgccggcactttggataattttaagtccggaagcatttataaagttgccgaatatgccgctaaactttcgaatgagttaggagtttccgaaattgtagttgggtttccaaagaacatgaacggtacggttggggaacgcggagaaaagactaaaatgtttgttgaaaaactggaagagttggtagatgtgcccgttattctttgggacgaaaggcttactaccgtttcagctcataatttaatgaacgttacaaacgtcagaggaaagaaacgaaaagagtctgtcgacagtatttccgccgcctttatattacaatcgtatctggacagcaaacgttgagaaaggagcagtaaaaatgtcagatgaaaataaagatgtaatgcaggaagaaaatcaaaatattttagaattagtagatgaggatggaaacacggtgccttttgagcatttggatactgtgcaaattgacggcgaggattatatagtgtgtattccatataatgaagaagaggaagaagttacagaaatcgtattgtttaagatagataaggctgccgagagtgaggattgtttgtctcaggttgtagatgaaaatttggcggagagaatttatcaggaatttaagaagcgtaatgcggaccaatttgattttgaaaattaaataatatataaaagcggcctttttataaagccgctttttgttattcaaataaattcgatatttacaatcctgttttgctcgtcccatgtaactgcagctccgcaagcctccgatacagctctgagcggtaacattgtatagtcgcttaacagcatagcaggtgcgtcaagttcaatttcccaaccgtttttagtcattttattatcattgatttttagagatatttcggtgccgtttttctttgcggttactgtctcatttgtctcgtcccaaattacttcgactcccaaagtttcaaatatagcgcgcattggaaccattgttctgtcgtgaataataaaagcaggctggtctgaaattagttcctcaccatttataaatacaggaacttcagggtaattgactgtttgatttgagtcttttgaattataagttattttgaaatcttttgagtcaagtttttggtttaaagaatatttttcaaccgttaatgtatgcgttccttcagataagtttgacgaatcaagagtaaactcataaggaggatacattgtttcatagagagaaacgccgtctattaggtatttgacgtttaaatacaacgctttgggttcataggcgtaggcggataatttaagactgtctttaacttctatgtcgtgcatttcgggatactcgacaggagaaaatcccggatatccctggatgtatggaggggttgaaaccgccgaattaactattgagtaaagttccggcgaatcactcatgtcatatctgtaaaaatccaaatccacgttatggttaaagcttacgtttattttaatctgcggaaacactctcggaatctcataataaaattttctgagctgctgtgctgcccagtcaacatattcaaaaccgtttatgtagtcttcacgtccgggcatttcgccgtaacctacaccgccttcagttataacaaccggcttttttatgttatatgtttccataaaatcagttattgctttagctcctattacagcattgctgtagtcgccggctacgaaagagacgctgtttgaccatgttgtctgtgctttgcttccctgaaagtatggcattacatataaactcataccaatccagtctgtatactcatcgccgggataaaaatctatcagtcttaaatcgaccgaaccaacattattcggcgcccaaacaaccgcaatattatcctttgtgtgggcatagtcggctacatatctgaaaagctttataaagctttcaggatgagtaaaattatcgtttatattaaactctttgccaaataccaaaaggctgtcattaccgtctgaggctatgttatcgacagtatttttaatgtagttttcatagtctgcaggttcaataacttcgtcttttaatgcacagttccaattataaagcctgaattttccgcttctttcggcatattcagatatttcagctctttcgcatacgtcatttgttaaagtcgaatcaaaccaaaaatattcagtgtctatagtgttaggaatcgaaggataagacacgtcgtggggtgtaccatggtacaccccactgccgggttcaaactttgctccgtaaaaacatctgttttcggtttttgcctcatagtatattctgaaatccggcgtctcgcagagcttacccattctgctgaccgtttcatccattatactctcgcattgcaccggtgtgcaaaaaggtataataaacagtaaaaacagtgatataccgagagagcgtctaagaaagtttaaagtttttttcatattatatatcctaataactaagtttatcttatgcagtctgtacattttggctgttatcgcgtataccgcggagatactcatagaagtttgtataagcggtatttatgtatggcgataggaagatgtagccaatacctaatgtgacagcggccaacaaaatccagccgataaagcttaggctaagtacaaataacttccacttataacctttcatcatttctttgctggctctcagtgcttcaagagcggtcatatcatcattgtccgcaagcagataaaaagcttgtgagtatctatatgacgctatgatgccggggattaccaaaagcaatgaccataggaatgtgaatatcccgattaagagcataagcaggaaagaacgcattattgtattaaatccataagaaaatcctgtaaatatgtagctgaactccgagttaccggttcttacaaggttcaggagatacttgctcataccgtacgtcatacatcctgatacaaacagaaggacaatagtgccgattaatgagtaggatgttacaaatataaacgttccggctgatacatttgagcccatactaatcaaattcgcagtcatttgcgcaggaaagtttactacaatgctgacagccataactaccagagttgcaacaaacaatgcaattatagccttgccccacttaccgcgaagctgatttaaagataaatttttaaaatctttgcatgtcataattcttactcctttttatattataatatatttttttattcattttttacaggattttacaaagaaattataccatgatacaggatatttatcaagttacttttttattacgcgcggcgtgtttttcaattcaataattgatataaattgtatctaatatttcttgttcagtgcgcagtcttttttgcttatctatgtatatttaaaattatcatgaatatgattaagagatataattcagacaagcgtggaggagaagaaatgattgagagaagctacaaggcaagaaaaattccggaaaaacatcagtaccgggctgttgttatcgacggacataaaattataaaaacagcagtttttttagcggctgtcggagttattgtcggcgttataataacatcgttttcatatactaaaacagctgttccgacagcgtctcatgttacggaatcgcaatctgcggaggtggctcaggaaaatgtaaagcaggacagcgaagaaaaatctgaagaaaggtctgataaaaaaataaatataaaggagtcatttgattcagttttaaaaactgcctgttcatacatattagggtttgacccatacaatattaacggggctttagctgcagaaattcatggagccgatatggttaacagttatgaaatggttcagaagtcttctgaatttgacgaaagcaatattgtcccgacagaggaacctcagccaacaccgggagcagaatcgtcggccgacggtgagaatcaggcggacataaaagcgataaatgcaggtcagaacgcaaacagcaattccaatgagattaaaatagggaaccaaacttcatacggcgtagatataaataaaatgctgagcgaaccgcttgatattgatatgagcgtcgacggtccgaaagttctgatagtacatacacatgcgacagaggcatatgctcctgaaggagctcaaaagtataaccgcgaggagagcgacaggagcatggagaatactgagaatgtcgtagcggtaggcaatgaggttactgaaatatttaacagccgcggcattgaaaccttgcatgatacagcgctgcatgattatccgtcatttaacggcgcttatgcggacgcactttcgtctattgagtggtatttgtctgagtatccaagcatacaggttgtttttgacctgcatagagattcaatagtttatgatgatgatacaaaggcaaaagtggttacaaaaataaatggtaaaaatgcggctcagctaatgtttgttgtaggcactaacgaaaaagggctgtatcatccggactggcgcgagaatttgaaatttgcactgaaactgcaggataaaatagaccagaaataccctaacttaatgaggcatgtaaacttaaggcaggaaaggtttaacggacacacaacccacggaagccttatcattgagatggggtcaagcggaaacagtttagaggaggctaagtacggtatgagctgtgccgctgaatgtatagctgacttcttaaatgaacttaaataataaatttaacataaatgtcacaaactttaacgtattagtatgcaaattttgatactaatactcttgaaaaagattcacctttcagatataatgtactttaaaagaatttggacgcggagtaaattatttcttaaatgtattatgccgaaaggatgaatttaatgagaaaactattggctgtgtgggcggcgaagcttgcgtcggtggcaggcaggattgttggcaaaaaatcatcgtcaacgccgggtgtgtgcgctcttaaaatttgccccaatttgataagtattttagccaagaatgtcacaaaaggcgtgattgttacatgcggcacgaatggtaagactactacaaataacttgctgaatactgctttgataaaaagcggatataaaacagtttgcaataacttaggcgctaatatggtcggaggtatagcgacaacctttgctcaagcgtgtaatatatttggtaattttaaagctgactatgcagtgcttgaggtggatgaagcttctgcaaggcgagtgtttaaacacatcaaacctgattatatgcttataacaaatcttttccgtgaccagcttgacaggtatggagaaattgatataacagttgatttgcttaatgaagctattgatatggcaggagatgttaagctgatattgaatggcgacgacccgctgaccgctcagtttggcgaaggcagagacgctcgttattttggtatctcggaacaggtgcttccacagaccgatgaaactaaggaggggcggttttgcgcaaaatgcggacaggaacaggagtataattattttcattacagccagctgggcgactactattgtcctcactgcggaaataagagacctgagattaattatccggcaaccaatgtggacttgtcgtcgtctatgaagttttctgtaggtaataatcaaatagatgtgaattaccgtggattttataatatatataatattttggcagtatactcagctcttgatgttatgggtgttaagaccgagaattttaacagtatacttagtgattataagcctcagataggacgtatggagctgatagaactgggcggaaagccttgtatattaaatttggccaaaaatccggccgggtttaaccaagctattcagaccgtgcttttggataagagaaaaaaggatgttatcgtggctataaacgaccttgcaaatgatggaagggatgtatcatggctttgggatgttgactttgataaattgggagaagctaatttatgcagtctaataactacgggaataaggctttacgacatttctctcaggtttaaatatgctgatataaaggttgatatgattacctctgatatgaaatcggcgcttaaaaaatgcgtggacaatcctgattcagaagtatgttatgttctcgtaaactatacagcgttatatcctacccaaaatacaatgttgggtcttaaaaaagaattgggcagcagcgagcttgttccggtcagtgcaggaggtagcagcaatgggaaataattatgagataaacatcgttcatttgtatcctgatctgcttaatctctacggggacagaggaaatatagcctgtatggaaaaaaggctgaagtggcgtggaattgacgctaaagttcatatgtgtacaaatcaggacagcagcattgatcttaaagcagctgatattatatttgtaggcggcggttcagaccgtgaacaggagatagtttgcagcttgcttctcgaaaaaaaggaagaattaaaagcgtatgcggaaaatggcggcgttttggtagctgtttgcggtggttatcagttattgggcaaatactataaaacggccaatactaaaatagaaggattggaaattttggatatatataccgacgcgggagataccaggctgattagtaatgtggttttagagtgcgaaaagtttgaccagcctatagtagggtttgaaaaccatgcaggaagaacatatattggtgaaaaccacactccgttggggaaggttaaattcggaaatggaaataccggagacagcggttatgagggcgtaatatataaaaatgttattgccacttatcttcacggacctttgcttcctaaaaatcctcagctatgcgattatattttagaatgtgcattaaagcgaaaatatgacgattttgatggacttaagcccctggatgacgaacttgaaaacaaggcgaataaatatatagccgataaatatgtgcgttgatactgtataaatttgtcttgataggcaaaaaatatttttaactaatggtaatagaaaattaatattcacttaacatttatttggaatatttttgataaaataacatggttaatatggagcagtgtataatgttggatattaatacccgggaaaagtgggtttgaatgcctgaggtccggcctattacatacagggggaaaacgaatggatttttttaaaaagttgttttccaaaaaaaacaatgacaaagataatatagaacaggatttcttaaatcacgcttataacagtcttggagaagagcatcttaatccggaaagaattttagatgaaaacagcgtaagttataagactgattctgaaaatgagattgccgaaggtgagcctgtcggcacttttggcgttcatgaaagcgagtatgaaaatgatcgcacagaaaacgatgaaaacaaatttttgaaagaagcttcagagcatgagaatatcggttttgaacaggataattttgaagacagcggatatatatatggcgaaggtaaaggtttagatttaaaaacggattatgaagatattgaagacagcggagaaaattcagattttgatgaatatataaacgaagatgaagatataagcgaaattgaagagtttgaccctgaatcggcatatgataacctaggcggcgataccggggaaatggatactgaagctatcagcgctgcggctgatatggcacagaatctatctgcagacgaattgtctgacaggagagcggaatacggacgagattttataccctctgataattatatttcagaggaagcacaggaagaaactttttctgtatctgacgaagccgggaataacggttcagatattaatagtttgtctgatacgagggaacttgaacaaacaattccaataagcagtgagatagataaagaagagatttactccgcatatgctccgaagaatatgcgtcctaaggtaacgcagacatcgtattttgatttggataatttggatgatgaaccggaagaaaatttgtctgataaaggttttagagctttctgcaagagacgtaaaaaatggcttataggcgccggtgtagctgcggctgtagttttagttattgtcggaacggttttcttcttctggaatcgtatggaccctcttatgggatatacacaaacgtatgtagctaagggcaacgtgattaaaactatggcagcaggaggaaatgttgagcctaacgccagatatgatataacttccttagtcagcggaactatcaccgagactcctcttaacgcaggggagcaggttcgtgccggtgaactggtttataaaatagatgatacaaacgcacagctggcagttcaaatggccgaaaatgatgttaagcgtgctaaggtggacgattcagattcaggttcgtcacagcagcttagaatttatgctaacgcgtcaggaactataagcgatttgaatatttcagccggaagcagtataacaggcggtaagattgcaactatcacgcaggcaaacggaacagaatttgccttgataccgaatgttacaggaacagttcagtcagtaaatgtcaggaacggttcaactgttgagtcgggtcaagtggttgcgactttaaaaagtgacggcagcggctcttcaaaagaggggcgtgagctggatatagcgtcttgcgaacttgctttagagcaggcaaacaaggaacttgaaaaatataaaatagctgctcctatcgacggcacaatactggttaagaatgcgaaaataggagacaacgtgaacgctaatcagactgataagccgttaatggtaattgctgatatgagtaaaatgaagtttaatattgaagttgatgaacttgaaatctggaatattgaacttggtcaaacagttgttataacagcgaatgctttgccgggtcagactttcagcggtgagattacgaatattgccggcgaaggtgagaaaaagggcgacggcgttaccacttatgcagttgaaattacaatttcagacccaggaaaaatcaaatccggtatgaacgttgacgccaaaataataattaattcagcaataaatgttttgtctgttcctgaacgcaccttatatgagtctgacggaacaaacgcattggttattacaaactctaacagtgctgaagaagacgctgtgatgaatccggcggaatatccgaatataaatgttcctgaaggatataagcttgttaaggttcagtatggcgtgagcgacggcactaatgttgagattatttccggtctgtctgttggagatacagtcctttacaaagcagaagacggtgaaaatgttaagcctgcggatagtgttaattcaggtaaagattccgggaataaagaagcagaaaattcatctaacaattcagaaaattcttcaaaaactgataaatcacaaagtggtgacgcagactcaattgatgaagagtttacaactgaaagcgataatggtgaaaatgtcaaatcaaccggaaaatcagcgacccaggaagatcttaccgatttagagtaaaagtttttaggggaaatgcgtaaatgagcaataatgagaaagaaaaattaaatgataaaaaaagcggaatatttaagagtgcgtttttaaacgcactctttgaaataaagctgaataaaatccaggcgcttatatcggcggcaggctttcttattgcggccgcttctatgatagctgttataatagcgacgcattctatgataatttccgaaggatataggactaatcctttaggagctaatactattactcttacagtaaatgaagaaaaatctaaagtaaaaatagacggcttaagaagctctattttggaatatgatgattttatagacgttgtgccaactgagacggtttctaatattgaaatgtttggtaacttgagtacaagttcatattataatgtgcttgcaacagactattcgttttttaatcattcggctttgactattgataaaggccgttttttctcgacagcagatgtaacggcaagaactcatgttgcagttatcggcagtgatattgctaaaagtttgtatggtgattccgaccctataggacaggacttaaaaataaataatcagatttttagcgttgtgggtatattcgacagcgaaagcaaatcgtcgctgaatgaaaccgtaattataccatacaaaagcgccaggcttattttaaattcaactgacgttggaacctatacttttgtgtgtaaggatgggtttgaatcagatagggcggttaatcaagcggaaagctatatgggtaaggttttctcggataattctaaatactcgataaaatcaaattataacagcggtatggttagcgtaattcggcttattgttcttatagtttttcttattatactaattataagctgcttcagtttggccatgtttgccgcttatccttcaagaaccataaaaactgatttagatcaaacaaacaaaaagaatggttcagcatatgtttttcttaaattagagtatatttgtcttttgatttctattgcaggaacattagttggtttggcggcaggaatcggagccggctgcctatattgtctcttaaccggtaatcctctgtattttaacggcggacttttatttatgactgtttttttgttcttgctctctttagtatttggtcttttgtcaggtttggttccggggatattagcgtccaaaaagtttaaacgcagtgaaataaaataatatttataatattactttaatataactattaatagttatattaaaatctgtttttacataattataagtaaattttataacactttattatcgtaaattaatttatcttagtaattaaatttaatttgttatattttgttggtattctatatttttagtaaattaatgagacaaattattgtgtaaatatatttgcttttttttgtaagctgtgttattatgttatttatataattggaataatctggaaacgaaggtgttgttaggtgatagaattatgactgacacagccagaaaactagaatacgataacatatcaggtcagcagaatgaagtgaaaaagaaacttaatattattaaaaaaattcccaaaattgagctagtgtggcgcgtagtatggtgcgttgtttttatggtcatatttagtttttttgcttttggcttaattcgattaatatttggggactcggcgcatggattagagtggattgttgcagttgagacagctgtgattgtattttccgtctgtctttttagctttgcaatacggatttttaaagaattaaaaaatgttgtcgatgaggatacggaaatcatgacaaatgttgtcgggggaactatggtaacatacttcgacgatagttttacaataataaatgctactcctgtcttttacagcatactgggttatgaaaaaaatgatataaaaagaaaatatcgatgtgaattttttcgtctgctggtgggagacgactctaggcgggagtttggaagacaaaagcgcatgcttcgcgaaacgggtttttcagaggctcagtataaaattctcagaggtgatggaagccgtatttgggtttccagcagaagtcatttaaagaaaaatgataagctggaaactgttgtatatactgttttattcgatataagccgtgaaaaaaatatgcaggagaaactgcagctggcagaggcaagaaacaaaatcgtattggagaatatcaacagcggtatttttgaatgggatatgataaaaaatacgtttgaggcttccgaccagttttcacgcagatttatggttgatgaaaattttaaaattgaaaaaactattttgaaaaagtttgtgcatcctgatgatatatccgtgctttatgataatttaaaacttctaagagagggaatagaagataaccttgaaatattgctgaaattaaaggattttcaggggatttacagtcataacaggttagttttaagttcggtgcgtgataataataatgtccctgtaaaagcggtaggaatagttattgatgtggaagaacagtttcagaaagaaatggagcttaaaaataaagcttccagagattcgctcacagggctttataacaaagggattactcagcagcttatagaaaacactatactagaccgcggaacacaaaatcatgctctgattttatttgatatcgatgattttaaatcagtaaacgatacgtttggtcatggtatcggagacgaagctatcagaatagttgctggtttgtttaaagacgttttttatgatgattgtattgtcggtaggataggcggagacgagttcatggtattttgcagaaatattgatgagcgcggcgtcaaggtggaacagcttcttaataaaatcatggagcgggatacatttgtaaagtccggcgataaattaagaaatttaactttaagtgttggtattgccctttatgtcagtgacgcgagaacttatactgaattatataaaaaagccgatattgcactctataaggcaaaacaaaatggtaagaacagatacatattctttaaagatatagatgaagattaataaaaatggggctgagagatgatgtgctcaccaaagtcagactaaaaatctaacgttgggagggcgcgtcaatactcagcccttttgtttttaaataaaaaagacaccgcaatcagcagtgtctaattttttacttttcaagaccataacgttttctgaacttatcaactctgccgcctgtatcaacaagcttttgctttcctgtgtagaaaggatgacaagcagaacaaatttctatacggatgtcctcttttgtggaaccggtttcaataacgttaccgcaagcacatttgatctgtgtttgcttgtaatcaggatgaattccttccttcatcgtgtttcacctctttcaatatataactcaattatttatccatttaattagcaacgtcgtctattatagcacaacggaaatcaaaatgcaacacttttttcaaaaaatgtaaatatattttttgttagtctccaagacacatatcaatagctcttgcagtttttatccagtaaccgctctcttctacagctttgttttttccgattacgttttcaagagagtcataaccaagcttagttccgtctaaaactaccatattgccgaatttgccttccatcaacagcttaaccgcgtatgaaccgtaacgggttgacaagattctgtcgttagatgtgggtgaacctccgcgctgagtatgtccaagaatagtagcgcggcactcgagaccggctaaatgttcaagctgcccggcgattacttctccaactccgccgagacgtattgggtcaggactgttatcaataactttggatataactacgtctcctccaataggcttagctccttctgcaacaacaacaatagcaaaattcttgcctctggctctgttttctttaatagcgtctgcaactttattaatgtcgtatggtatttccggtatcaaagccgcgtcagctcctccggctatagctgacgctatagcaataaacccggcatatctgcccattacttccacaacgatggttctgctgtgtgattcggcggttgttcttaatttatcaatagattcagttgcggttgcaacggcggtatcaaaaccaaaagtggtatctgtcgaagctaggtcgttgtctattgtttttggaacgcctataactttaactcctttgcgcgcaaaatcacggccggacgtaagagttccgtctccgccgataacaataagagcgtcaataccggctttctttaggttgttgactccaacatccgaaacatcgccgcgctgttcttgtccgtgttcgtcaatatatgaatagtcaaacagattatctttgtttgagctgtaaagcattgtgccgcctttagagataattcctgaaacatcatgaagagtaagaggaacaaactcgtcttcaccgagataaagcccgcggtaaccatgttttattccaacaacttcaagaccgtatttgaggatagccgtcttaacaactgctctgattacagcattaagcccaggacagtcgcctccgccggtcataacaccgattcttttgatttcgctcataattagccctcctgtatttatgtattaaggcaaaattccgtatagatattatttcctatcttatattctattatgtttaagtaaatatgtgcaaaaattaatttcagagttcttatgcttttaaaataaagccgaaaaaacactataattctgcctggtgctaaattgcaccacgtaatctattttaacttatataaaagcaaaaagcaaggagaaaaaccgagtggtgtctaattttgtatactgtaacaaaaacatatttaaactgcggtgactttttcataaaatcacatactgaaatatggaataaatttttattttaactgtttatttacattgtgtggcgtttttattactttttttggaaaataaataaaaaaactgtaaaaaagatttaatttaatgttgcgtattttgaaatgttgagttataatacaaagtgcgggaagagggacccgtgaacccgaatgtttcggtatttggggcttgttcgaaaaagaattattttatatataggaggattaattatggataaacaacaagttttaacaaaaatgacagatgctggtcttgtagcggttgttcgtgcatctaatgctgaagacgctataagaatcacagacgcatgcctggagggcggctgcccttcaatagaattaacatttactgttccgggtgccgctaaggttattgaggctcttgcttcaaaatacacaaacggcgagatgcttttgggcgcaggaaccgttttggattccgagacagcaagacaggctattctttcaggagctaatttcatagtaagccccggtttcaacaagggcgctgcagagttatgcggacgttatcagattccttacatgcctggatgtatgacaatcacagaaatcttgacggctatggaagctggatgtgatatttgtaaagtattccccggagacattgttggagctaactttattaaggatgttaagggtcctttgccgcacgctaaacttatgcctacaggcggagtggacgtatcaaacgttgataagtggataaaggccggcgcagttgcagttggagcaggttcatctcttacaaaaggagctaagacaggcgactatgctgatattactgctacagctaaagagtttatagcaaagattaaagaagcgcgcgctgcactttaagtttttgaagagataatttgaaaagataattagtacatatttgaaattaaattatacaaataaaggagaaaattataatggctaaagttgttacaatgggcgagattatgctcagattatctacacctggtaatgagaagtttattcaggctgatgagtttgacgtatgttatggaggcggcgaggcaaacgttgcagtttcacttgctaattacggacatgacgctgagtttgttacaaaggttcctgataacccaatcggagaatgtgcggttgctgcacttcgcaagatgaatgttaaaacagataacattgcaaaaggcggagagagactgggtatttatttcttagagtcaggcgcttctatgagagcgtcaaatgtagtatatgaccgtgctcattcttcaatttctacagctgaagctgctgattttgattttgacaagatttttgacgacgctgattggttccactttacaggaatcactcctgctgtttcagacgctgctgcagaattgactgaggaagctttgaaagctgcaaaggcaaagggcgttaaggtttctgttgacctgaacttccgtaaaaagctttggtcaagtgagaaggctcagaaagttatgtcaaacctcatgcagtatgttgatgtttgtatcggaaacgaagaagacgctgaaaaggttctcggatttaagccgggcgctactgacgttacatcaggagaccttgaacttgccggttatgaggacatatttaagcagatggttgagaagttcaactttgagtacgttatcagctcattgcgcgtaagtcattcagcatcagacaacggctggtcagcttgtatctattcaagagatacgaaagagttctatcattcaaaagagtacagagtacatcctattgttgaccgtgtgggcggcggagattcatttgccggcggtacaatctgcggatttgttgacggtaagaattttaaagacgcacttgaatttggtgttgctgcatcagcgcttaagcacacaattcccggagacttcaacttggtttcacgtgctgacgttgaaaatcttgttggcggcgacggaagcggccgtgttcagagataattaataattataaaaattgcctgcaccgtttggtgcaggcttttttgttaattaaatataaatggcaaatttgtattgcccaataaatataagactgttgaatttttggaattatattaacatactataggacagtcctcaatattattgattaattcagaagttatgctgtttattacatcgaaattcatagcgttaatatatattgattcaagttcatcgtgcagagtatgtatgttgcttaggaaacagcgtgcctggctgtttaatttatcatacctgttttggatggcggacagccttgccgagttttcttcatccgttccgggcttaactgcagtctgatacaggtcaactatttcgtcgcttgtgcgtgacgggaacagttcgtgcggtgaagtcgaatcaaagatacacacgtccaaatcacgtattattaccatatccaaactatcggggtcaaagctgcagtgatatacttctgttttatagccgttatttttggcaaggttagcaatttttttcattattgtggattttcctgttccgggacgtcctttaataaaataccgttttgagaggtcagaggtcaaattctcgatataatttactgacccgtttggggttaaggcgccgaagaaacggtctattattttgccgttgtcatttgatttttcgctgtcaactattttattgcataactcaattgcagcactgtctaaactgttataatctatattgtcaagatatattttctcccaatcgtcgtggactgttttggcttttgaaagatttgaatatattccattatataattttgaaatttgctgtttaatatccagtatttcggacttatgctgtttaagtttgtttctgtcccatgcttttccgagatttatgtattcttcaactgctcccggagctttgggttcaataacgtgaggtgaggttccgtcaaccacagctgttttccggttgttgataatgataccgtccagagaatttgaatcagaactgcaatatatatggtcgatattttctccctggcttagaaaatagtctccgatttttttcatcattgtggattttcctgttccgggccctccttttaaaatataaatgttttcaagtccgtcaaggttttgttcaaagaaacttacaaaacctactgatgagttagcgcatgtaaagtatttataaattcttttggtcatattatcactctccattattaatttactatattaacaactatacattatatgtcaagaataattgtttgatgttataaactaactatattctacaaaatttattaaaatgagatttatttaggtatttatttatgcaggattatcttttcaattaagacgtgcctgggctttcaatgatgtaaatattatataaaaaagtggttttgcaagcatcggagggcagatgaaatctgccgcgtaaggcgcgcagccacggctaagcttattagtaaaaaggataatgacaaacttttttaagtatgttcacactccgcgtgatatggcagctcacctaacgtggtgtgcaagcacacccttccgatgttcaccaagaaacgctattttttggaaaattgattctaaaaaatatttataaaaaagtggctttgcaagcatcggagggcagatgaaatctgccgcgtaaggcgcgcagtcacggaaaatttattagtaaaaaggattatgacaaacttttttaagtatgttcacgctccgcgtgatatggctgctcacctaacgaggcgtgttaaacacgccctcccgatgttcactaagaaacgctattttttggaaaattaattttaaaaaaataattataaaaaagcagttttacaagcatcggaggtgtaacatcacttttcttaaaagtggggtcacactttcagaggtttgctatatgtgattttaatatttatgttcagtttatttaaacctatcaaatttttattcactgcatagaagatatacatataaaaatttcatatataaaattaagtgctatttttaagatagcggattgttaatatatttgttataaagctaatgtatatttattgcaaaagtcaatggtttttcaccttcaagagtaaatttaaatttactcttgaaaaatatgtatgtttatattataattaaatagtataatgtgaaaatagcggatttgtgcaaaaccgttgaatttggtttttaacatttttgtttaatatgatagagagaggttgatttaggtgcaaaatcaggaaaaaacaatggaaaaaatagtagcgctctgtaaaggaagaggatttgtttatcccggttctgagatttatgggggattagccaattcctgggattatggtccgctcggagttgaatttaaaaacaacgttaagagagcgtggtggaaaaagtttattcaggagagcccttataatgttggacttgacgcggctatacttatgaacccgaaagtttgggtggcttcaggtcatgtgggcggattctctgaccctctcatggactgcaaggattgtaaggcaaggttcagagctgataaactgatagaggacgcaaccggagagatagccgacggttggtctgatgaaaagatgatagagtttataaatgaaaaaaatatcccttgtcccgagtgcggaaagcataattttactgatatcagaaagtttaatcttatgtttaaaactttccagggtgtaacagaggatagttccagtgaaatatatctaagaccggagacggctcagggtatttttgtgaactttaagagcgttcagagaacatcccgcaagaagctgccgtttggtataggacaaatcggcaaatcattcagaaacgagattacacccggaaattttattttcagaatcagagaatttgaacagatggaattagaatttttctgtaaaccgggcaccgatttggaatggtttaaatattggaaagactactgtgaaaacttccttttatcattagggattaaaaaggaaaatatgcgtttaagagaccatgaccccgaggagctgtcacattattcaaacgcgactactgatatagaatatcttttcccgtttggttggggagagctttggggaatcgctgacagaaccgattttgacctaaagcagcacagcgagttcagcggtgagaaaatggagtatactgaccctgaaagcggcgagaagtatatcccttactgtattgaaccgtctcttggagcggatagagtagctttggcgtttttagttgacgcttatgacgaagaggttgtcgatcctgaaaagaatgacacgagagttgttatgcacttccacccggcgctcgcgccgataaaggcagcagtgcttccgctttcgaaaaagctttccgaggaagctgtaaaagtctatgagaagctggcgtctgagtttatgtgcgaatatgatgaatcaggctcaataggaaagagataccgccgtcaggatgaaatcggcacgcctttctgtataacctatgacttcgattcaagagatgatgacagtgtgacggttcgccatcgtgattcaatggaacaggaaagagttaaaatagaagatttgacggattatatcagagagagaattgcattttaataaatcatagattgggtgcttataaatgctttttaaaaaaagtttgcaggatgagcttttaaggtttataaaaaaagacagggttcgggcgcatatgccgggtcataacggcggagcagggttgagctccggctttaagcgcaatgcgtttaaacttgatgttacggagtttgatgaaacggataatctgcaaaatccaaacggtataattttaaaaagcgaggagcgtgctgccaaagcttttggagccaaaaaaagtttctttttggtaaacggttcaacagtgggaattgaagccgctatattgacagcggtaagaaacggggacaagctgatagtggacagaacttgtcacaaggcggttatttcaggaatgatacttgccggtgcagaacctatttttattgaacccgagtatattgaaaggtttggaatatatggagctatgtctccaatcacggttatggacgcgctcagaaataatcccgacgctgtaggcgtagttttgacatctccgaattattacggcatttgttctgatattaaacgtttggcaaaaaacatacattcctcaggcaaatttttgattgttgacgaagctcatggcgcacattttgcttttagtgacgagctgccaaaaccggctcttgaatcgggagctgatttggttattcacagcgcccacaagactttgccggcgcttggacagaccgcgctccttcatgtgggaaacacggagttagtagatgttttaaggctgagaagaaatatcaatttgctgcaaacttcaagcccgtcgtatattttgcttgccagtattgatgaagctgtttcaaaaatgtcaaatgaatatggaaagcagctgaatcgggtaatagagacagtaacagcaataaaatctaaaattggagttttggataaggtttcgtgcatgacgagaggtaacttagataatgattatgatataactaagctggcagttgacttttcaaaactgggaataaccggatacggcgctgctgaactgctgaaaaaggattatggaatctatcctgaaatggccgatgagagaaatgttcttttatatataacggcgagcacaacgaaaaaggatttggagcttattgacagggcaataaccgatatatctaagtctgagtataggcctcaggtgattaaaaaaccgaggcctatgccgcatacgagatttgaaatgcctatgaaagaagcttttttctcggacagcgttatgatttcggccgaatcggctattggaaagatttgtgcagaaattgttaattcctgtcctccatgctgccccatagttttgccgggtcaaataattgacaacagcgttgtggaatatctcaaggaatatacggatattgaaaaaatagccgttgtgtcaaacagtataaactccaaaacaggtcaaattgaggaggaaggttaatttcgtgagccattttagcggaatatacggacatgaaagtgtaaaaaagcttctggaaacggctgttaagacaggacgaataagtcacgcatatattttttgcggccctttaggggtcggcagatataccactgcaagggcgtttgctgcagatgcggttaagactgacctgaaacagcatcctgatattataacggttacaaacagtctttatggagttgagagtaaatccgattctatattagtggatactgtgagcgaaatgaggaaagatatatttataaagccatacagtgctgagcgtaagatttatatagttccaaaagcggacactatgaacgcagcgtcccaaaataagcttttgaaagtgtttgaggaaccgcccggatattgcactataattatgatagcggaaaatttaaataaatttttgccgactattttatcaagggcgtcggttgtaaaattttcagcattgccaaacaagactgtatctgactttttgattgacaaatataaactttctgatgaagaagcggccgcaaaagctgttatgagcaatggcagtataggaagggcggctgagttgattgacagccctcgtccggcaatgcttagaaaagagacgatagatggctttatgggacttttgggcagtgagaacagaaatatttataatttcgcaaaatttttaaagtctgaaaaagatgatttaagttttatattttcagttttaaagagcttttttgaagattttgttcatttaaagtttgggcttgcggatgaaatggtaaatgttgataaaaccgcggagatgcgtaaactggctaatgttgctaccaaacgtgccgcggtacagtttttggatataaccttaaaatacgaaagaattgctgcggctaatacaaatcttaggatttcaatgttttgtttagcctgtgaatattgggaggaaatacatggcagagattataggagtacgatttaacagtgcaggaaaggcgtattattttgacccggacgggcaaaacctttctatgggcacaatggtagtcgtagagacctctcatggtgtagagatgggaaaggtttctatcccaaaccgtgaggttagtgaaaaagatttaaaagcgcctctaaaaaaaataataagagttgcgaccgatgatgatataaagcagctgaatgaaaatcaagttaaagaaaaagaagcgtttaaaacggcgagtgaacttattattaagcataaactagagatgaagcttatagatgtcgaatatacgtttgacagaagcaaaattctgttttactttaccgctgacggaagagttgactttagagaccttgttaagtcattggcgagtgtgttcagaacaaggatagaactgcgccaaatcggagttcgtgatgaggcgagacagctcggaagcattggaatatgcggcagatttttgtgctgcagtacttttcttgacgactttcgtccggtttcaataaagatggctaaagaacaagggctatcgcttaatcctacaaagatttcaggagtgtgcggcagacttatgtgctgcctgcagtatgaagaggcggcttatgatgacgcgctgaaaactatgcctgaaagaggggcaactgttgaaactttggacggtaccggaaccgtggtggacacagcaacgcttaagcagcagataagagtaaagttagacggaaccgaaggtcataaaaccgaggtatacaatgttggagaattcaatattgtaggacatgagccttctgtgtcactggacgaattgaagtctaaaaaagagcaggaagttttagaaaaagctcaaagactgcttgaggacagcgagagaataaactcaatttttgcaaatgaagatactgagtttgagaaggaaacagagcgtgagaacaaagaaaatcagaacaaaaacaaaaataacagaagaagacggcgccctgcaggaaagaaaccggcacccaaaaactcaggaaactcagattctaaaaaaccggcagttaaaaattcaggaaacacagaatctaagaatccctctttgaaaaattcggagtctgataataaagagggaaacaacaaaaggcggtatcgccgtcccagcccaaaaaagacaggcaacggcggttataataaccaataagtttggagaaaaatatgcgaagattttttactgaacctgataatattgatttagacaacggcactttgactattattgatgacgcggcgcacatttccaaagtcttgagaatggaatgcggagataaaattatagtttttgacggtacaggatatgaatatgaagctatgcttataaaaatagaaaaagagaagagcatagccaatattttgggaaggagcctgtcagaactggaacccgaaataaaagttactctgtttcaagggattccaaaatcggataagctggagataatagttcaaaaagctgtggagcttggtgttcatgatatcgttcctgttaaaacgtcgaggtctgttgcaaagattgctgatgataaaaagggcaggcagaagatagagcgtctcaataaaatatccaaagaagcggctaagcagtgcggaagagggcttgtaccaaaagtttcaatgcctgttgtcttcagtgctatggctgatattttgaaaaattatgacctttcaataatgttttatgaggagctgggtcatgatggaaagaaaaatttaaaagaaattttaagggcaaatcctgaggcggaatctattgcagtattgattggacctgagggtggattttctccgtcagaggctgagactattcaaaacatgaataaaaataccttctgcgcaggactaggaaaaaggatactcaggacagagaccgcaggaagcaccgctctttctgtgattatgtatgaaaaagatgaaatatgagatataatgctgaaaatattcttcagcaaaatgaaggagagaagaaaatggcggcaatgacaaaaaaggaaaaaatggcggcaaaaagcaagaagattcgcgacaaggagcagagaagagaaaagcttacaaactggtatatgataaatctgagctttggtattttggctattatagcggttcttattctaagacagctctatttgatgccttcaatgctatcatatatgcagattgtgacgtgggtaatgaccggtgtgtttgcggctgcggcaatagttgtcttagccctgggactgaccgggaagataaagaataagcaaagggctgtgaattatagtattttcttgggcgtttgcgctttgggttcgctttggctggcactgtataataaaatcagagtagcggctgaaaatgttctgcatttcattactaataatacgaatttaaacatcaactcacattggaatattaatttgttgattataggtattgttgtttaccttatagctgcttttgtttattatgttataaagctgtatagaacaaaatagaagttatacatatataaaaataaccgggaaacagcggaaattattccgctatactccggttatttttatatagtatcgatttattataaactattttttcagcagtgaagccgcccagtccttgtcttctttggttacacggtaagaatctctcagttttctgactgtcatttttaagacagcgtctcccaatgaaaagttgtttgtcagataatcctttgtcaagtccctttgcttggcaaaagcggttgcgataagccacgcctgcgccatttgaacataatattcgtcacttttcacgctgttggcttcgtttagagcgtattcggtgttttctttatcgcagagataataatcaagcaaaattataagcccgactctttgttcccaggggttttcgctctttaaaaatctatatatttcaattttgtattcttcaatatatttttttatttctttaaacgaacttacgggacaatcacagcatgcccagttgtttactttagaggcgtaggttctgattctttgacagagttccccgaacggaagtttggcgtatccgattaccattccgtatatagaaatttcttcatgagataaggatttattatcaagaatgtccacataatccaaaaaagcgcgaaaagacccttttgcaatcaatttggcagtatcgcgcattttgggaacccttactccgtaaatttgactttcgtatgatataggtgttattttgctgttaaattctttatatttgtcgtcagcaagactttttaggtattcaatataggcttggtagctgttatcattccatattgtttgtgtaaaatccatattattccgccttttaatatatttaatcctcaaaatcaccggttaggacgttaataatccgacagtgccctgaatctaaagcataattggtagtgtaagccgttccgctggacatagagagaatatacacaataaccgccgaactgttgtctaccataaatctgttacgcttgtgcatacattcgggcgtatagctttccgatacatatatgacttcatcggcgcttccgagaagctttgtatattgatttttttgtatcttgttccatttgcaagcctggtctttgcacggaagagcaagtataagcctgatatttgaatatttagagcgaagtttaataacactttccgccgccagcgtatcaaagccaagagcgcctcctgagatataatttgttattcccttattatagagcgtttcaagtattttatccaaattagcaagaatgttgtcatagtcctgagacttaacaatcctgtgtccgctgaagcagcaagtatttttttgatttatattattttccgctgtaaatttcaaatttcatcaccttttatagtatatcattgattaagtgttaacacaagtctttactttttgctttttttgatttataatatttcgctagaggctggtgaattatgagaattttaaaacaaattggatttatatttggtatttgtttggtgggtcagataatagcggagctaataccggtgccgtttcccggaagcgtaatgagtatggtgctgttatttatattgtttatgcttaactgggcaaatcctgaaaagctgaaaaatgttaatgattttttgctggaaaatatgtcgttttttttcgttccgtcagcggttagcataataacaaaatatgatttaataaaaaacagtattgttcagattttgattatctgtgttgtttcgtttgtggtgacatttgctgtaacggcttatacagtcacttttgttatgaaaatacaagagcgtttcagaagaaaaagaattggttcgggagatgaatgctgatgcaggacataattaataacataacatccagcgccctgttcggggttacactgagtatatttgcatatgttttcggggtaatggctaataaaaaacttaagacgcctatagccaatcctgttcttattgctgatataattattgtaactattttattggcgcttaatattccatacgaaaattatgctgtcggcggaagttttatagagctgtttctggctccagtaacagcggctttggcggttaagatacacgctcagattaaagagctgaaagcgaattggctgccgctgattatcggaacggctgtcgggtcgctggcttctatattatgtgttctgtttatgtgccgtttatttgggtttagtgatacgctgacagtatctttatttccaaaatcagttacaacagctatagcgataccgattagtgaaagtcacggcggcgtttcagcgataacggttatctcgctgatgtttaccggtatgctcggtgccatgttttcaccagttttgataaaattattccgtataaaaaatccggtcgcagcaggcaccgctataggaacatcgtcacatgcactcggcacaacaaaggccttagaactgggagatgtagagggggcaatgagcggtattgccataggaatggcaggtttaataactactgtctattctatttttatgctgtaagggtttaaaaataaaagtaaatataaataacgattcatataattatacaggttaaaaattattttatagggtggagaagatgaaaacaaatagagtttattcaaataagtattgggaagtaaaaccttttccggagagtgtggaggagggaagaacctggcgtgaaggaatggtaggaggcaacggagaaaatggttttataaccagcggcgcgccttattcggatacgattatttatcagaatattaatttcataatgcctagtgatgaaccgagatatacgccggaggagcttttaagcgaacttgaggaggcaaggcaggctgtaataaattttgatgatacgtgggacgtgcatggaaggaagagaacatgtttttattgttttcatccgggtcatttactgagaatgaatatgaatgaccggaactgtgaaagttatgtgcgctggactgattatgaaacgggcgaagtgtgcgttagttttgaggatgaggacggaatatgggaaagaagaacgtttacctcgcatactgacaatgtaactattacagaaataaaaaaatcatctaaagattcaaaaatagatatggttataagtattgatgatgtctcatcgatgaaaaagttcgggcttcgtgatgaaaattttatgcagtataagaagcttgttgatgaagacggctcatatatagcccaagccgctcattatccgtcatacgaaggttccgagctgaaaaacggcggttatgccggggtcacctatgttttgaatattggtggaactaaagaaaagatactgcttgaaaacacagatgaaaaacaaaatgttggagaggaacaaaatccggctgtaaaaatctgcggtgctgaggctgtttatttgataaccaaaaccggcaggacttttgatatgggagaatttcaagagtttaagaatagtaaaagttataaacttgttgattctttgcttaatgattgtattgctgccgctgaaaactatggaggcagtaagttcagctatgatgacgctttgaaaaagagtgccgagatacaaaaggagatgtttggggcagtatatttttcgttggggaacgatgagaatatttcaaatgaagacttgattgaaagacagaaaagcagtgaagttctcagcagttcttttgtagaaaaggcatataaccatggaagatatgcaatgacctgctgcgccggaaaaactatgagtcgtttgtgcggtatgtggagcggcgaatggaacacaaaatggcgcgggatatatacaatggacgccaatgttaacattcagtccagcggtatgaatacaggaaatttaaaagaattcggaataggatatgttaattttgttctgaggcaaatcgaggactggaaagataacgcgaaaaaatcttacggtatggaagacgctattcaggttcctgtaaactgtgacggcgacagggcaatgatggtggaatacgacagcaactacccgtttcagtattggaacgcaggagcgtcttggatgatacagcctatctttgagatgtatcagtgctttggaaatattactgtaaatactgattttggagataaagaattgctcggcgatatattattgcctttgcttagaatgcagaccaacttttggaaacagttgtgcactcccgagtattttactgatacggatggcaatgcgtgttatttaaaaggtaaaaaaagcttaaatgacggtgaaaaatatctgataataccatcgtattctccggaaaatcatcctaaaggatatgaatctactataaccgccaatgctgcaatggatatttctgctgcacgcgacggtctcagaatgaatattgaggttgaaagaatattaaaatttgaaggatatgaggacagaatatcagaaattcagaattttgaaaagctattgcctgattataaattcgacgatagcggagcgctttgtgagtggtcaatgaaaggttatgaggaaaataatgttcataggcacataagccatctttactgtgcttggccggcatatgaaactcagcacagcaaagtgctcacagacgcatgtaatcaggccatagagaacagaaacactgaaaataaaggccatgacgacacggcttcacatggatgggtacataaggctttagtggcggcaagactgaaaaatccgaaatctgtgtatgaaaccctatatatattattaaacagtgaaatttattacacttcactgatgactgaccataatactgacagacgtgcagatacttattgtacagataccgggtttggtattgttggtattattaacgaggctttgctctattcaaatacaggagaaatagaacttttgcctgcgctgcctgtgcagtggaaatgcggagaaataagaggtcttatggcaagaaccgaagcggaagtctccattaaatggtttaatggaaaagcggaagctaaaatcaagtcttttaagcctcagacaataacagtatcatgcggagagagtaaaaaaacagttgattttaaagcgggagaagagaaagaattggagtttattctttaatgctattctgttataacagtcttatttcagttagtgcaatacaaataatttgagtcttaaaatgtttttatgataaaataaaaatctaagcctttccgatataattgggcgggcttagatttaatttttgttctttaagttatagctttgtttataattttataaattatagtttgtttatatatatttgtgcagggttttaaacatatcatccacattgataggtttggatatatgggcgttcatacctgaagaaagagccttggttatatcactttcaaagctatgggcggttatagctattattggtatggttacggcgtcaggtttttctgagttccgtatttgtgccgtcgcttcatatccgtcaagatttggcatctgcacgtccattagtatcaaatcaaaataattatcagccgaattattatactttttaacagcgtctaaaccgtcaaccgcaagttcaacgtttgcattttgtgattttaaaagctcggaaataatttcgcggttgagagcattatcctcagttactaagatgttttttccggctatacttttttctgaattttcagagtgatcgtttttacttaatttggtttgattatttttatatttaaatggaagctcaaccgtcacggatgttcctgaaccagatttgcttttaatatttatgcttccttttaaaagcgtaaccaaattttttacaattgacattccaagaccggtgcctccgtactcgcgggaaattctttcatcctgctgctcaaacggtgtaaaaatcctgtctttaaattcgtcagtcatacctattccgttatcggttattataaatgatatgtataaaatattatccacttcagagcggcgcaggatatcaaactctatttttccgtttttgccggtaaatttgactgcgtttgataatatattcagcattatttgtttgaaacggagagaatctccaatcagggcaagacctgaaaggcgtttatcaaaagatatttttaagtcaatattcttttcttctgtctgagcgttaattgcggcaagaagttcgtctacagcgtctttcaaaacaaatttttctgttttcgtctgcaattttccgctgtcgattttcgaaagatcaagtatatcgtttataagagaaagcagatgcttggaagcatactctgttttttggagataattgtttagttttactttatcatcgatattttgcttagacagattagtgaatccgattattgcattgagaggagttcttatctcatgtgaaatatttcttaaaaatttatctctagtttttgcagaattttcagctactatcagcgcgtcacgcaagccgttttcgtattctatttgtcgtttttttgtttcgtcgatatttcggtttgcaataagaatacatttgcagcctgattttgctttattatcatcgtgaatactttccacaaaatacatataccaagagtatttgccgtcctgtttgcaggtgcgcgcttcaaaactaaaactttcgccgcaaaatagttttgacatatttacatcagaaaagtattccaaaaaattttttctatcgtttggatgtatattgtttagacatatatactctatatatttttttaaaccaaattcaaaattgcatgaattagagacgccgtttctgttgatgacttccacgtttgacgaggtgttattataagtaacccgccacacttggtcatacatgctcatcaatactttgccgagtataacatcgtttgcagttcttttagctttaattttattctttactattataaaaaagcatataaaaaatataatgagaaacagaataattatgctaagcagcagcgtcatcatatcgggataactatggaacaatgttttcaggttgtaactgtcatcataaatattgttgtttttgactataatgttgtcgatttgaccgttggttattgaaagcagcgatttatcaattattctcagcagtgttgggtctgccgtatcggatacgcctatagatatatcttgtatagagcccgtaaggtcgttgcttactaaatcggaatatttaaattttgataaaagataattcgcagtgatactgttcgcgtaagtacaattgacgttgccgttttcgactgcgtcaaaacattcttcaatcgtgtcgtattctattattgcagaggtcgattcatatttctctcgaataaacttatttatgtaaaatccttttggaagcgctatggtgttcttatttgattcttcaatttttttgatttgtattatgttagagtttagataaggatttgataatgatacattgtgttcggacgcccagttatagtcatatgtgattcctgaaattatatccgcttctccttcatttatcattcggcatgcttcctcatatgatggagcgtcaattattgtaaatttcagaccggaatattttgatataagctgtaaaacatcggctgatattcctgaatattttttgttgtttgtatcataatattctattggcgcccaatacgggtcgtaaactactttgaactcaggcgagctgtttataaaatcaatctcctgctgtgtgaaattcggctggaatatttgaccgttattgaaatattttttatgcatctgatagctgaaggcaggtgaaatatttttcatttcaaacaatatattatccagtttattaagatatggactgcctttggttaaggcaaaatatacaggcatttcgggaaaccgggttataactttaagattttttttgctgccggatccaatagtataaataaggtctatttgatttgaaaataatgcgttctgcatttcaaattgggtcttaaagtatataggctgataggtatacccatacttatttatataatcatcaagctgatagttatgacggctgccttccagtatacctattttcaggtcagctgtttcacctaaattgtcaaagttcatatcttctcttgctgagggggcatagagttcatatgcggctgttgacatctcgtatttagaaaaatcatatttataggcgtcttccctatttttgcttataccgcagacaatatctacttgtccattttccagcatatttaaacaatcggcaaaaggggcttttatatattcgaaatcccatccggcatactggccaacctttgagagataatcataaacatatccggaaggatcaccactgtcattaagttcctgataaaaatctatttgatagaaaccaactttgagcgtttgtttttgatgtgaattttcatcactgaaaacagttaaatttataagacaaagagtaaataaaagaaagattgaaacgaaacgtttcattatccaagccccccaggaaaatcaaaaatcaataatagatattatttgatatataaatattatatcacgatatatagatttttgcaataacgtatggaagaaaatggaaatttttattttgtttacggcaataaactacatacacagccagtttagtattaaaacgctcgcaccaactactgccattgatgacgccagccataataaactttgaaccagcactttgtttttaaccttaggtttggtttgtctttttgaagacgaatagacatcaggatacagaaagctgtttattattctctgagcttctgttactatatcggtctcgcggttctttgaaaagtatttctgtacttcggatgtgttttgagaaacattgtctcttagaataaaaattgcctgttcaattttatccgacttgatatcattgattattacaacttggcgtttgttttttaacatcataagtatcaccactcaataaaattttttatatggagattattgccggaaatattaaatatatacatgaatatatttaaatgtaatttgttttgggagaaatttattatgacaaaaaaagtaatttgtatattattagtatatatatttatatttatggtttttccgtgcctaacaagtgacttcaatgaagtatatgtcaatgaaactaaaactgaaggcggcagagctgcggaagctgccgctgtgtatcttgacgtgccgcgcagtgttttggattgttcggcatttactcaaaaagcatattcagatataggtttgtcaataccgagagttacatatgagcaagcggagtgcggcgttaaaatatatgattatgaaaaactggagccgggagacataatttgtatgggcaaaggggcggagcctgataatattacccatgtcggaatttattgcggaaatgatataatgcttcattcttcgtcaagccggggaaaaataattgaagtcagtctatcagaatggatagaaaacggcggatatggcactccgtttcagtatgccgtaagagtttcccggtaattttggtgtgcgaaaatttaaagcccgataagattttattgattgagtctctttaagtattagttagattgattataagcgtatctgttttgctgtaattttttgcctctgagttattatcaaaaaagttttattattacataaattgttttgataagacataataaaaatttgtgaatcgacacttaatataaaattgtaaactaattatttttttattaccgagattgttggtatttttaaatatttatctataatattttatagatatttttaattatataaagtttagaattaactaggataataattgatttaaaaaattttaaggaacaaatttatttttaatgcggaaacaaaacactgaaatattggtttgtaataacttattattgcgattagaagtaaaatctgtagaaaaatttattaaaataagctatgataactaaatgattaaatagctgaggcaggaggatatggttatgaaaattaatagggcgctaaaaagtttcacagcaatggctttatctgctatattggcgtttggggcggcaggaacagcggcggcgtcaacgaatacggataacgcgtcggctgctgaattttctgatactgagcctgaccgtgcaattgcttttcccggcgcggacggagcgggtaagtttgcaaccggagggcgcggcggagagatatatcatgttacaaatttgaatgacagcgggacaggctcgctgcgtgacgcggtttcaaaaggaagacggatagtggtttttgatgtgggcggaacaataaatttgaagtcagatttaagtataagcggaaatataagcgttatgggacagacggctccgggaggagccggagtgactgtgcgcaacggaaagcttgctatggcaggtgataatattattgtcaggtatatgacgtcaagacccggtgaaaaaggaagcggtgagtatgacgcctggggcggatcaaaggggtcaaattcaattattgaccattgttcaataggttgggcaaatgatgagcagtttggactttattcaagcagaaatatgacaatgcagtatagcataataggtcctgcaaattgtctttccacacactctaaaggctctcatggattcggtcctatgtttggtgccgccagtaatacttggcatcacaatttgatttgtcataatatgtccagaaatttcaggggtaaggttgaaagagaacagcctaatgactatgtgaacaatgtggtgtatggctggggcggacaaacagcatacggcacttttggacatttaaactatgtgaacaattattttaaaaagagtatttcttcgagaaacggtgataattttggttctctcgacagtggttccaactatgaaactacaaagttttttatggaaggaaataagatgacggacaggaagggcaacgcggccaatcctatgagcaccaataactggaacggcggccttagtttaaaccgcagtcttaattattacgagtctcattatcgtgcgtcagagcattttcctattatatcaaatggtattgatgtatctgctgcaaaaaatcccgaatcagcagacgccgcttttaataatgttgtcagctatgcaggggcggctgtaaatttagattcaaggaataaaattgacgctgaggtattaaatgacgcttacaccggctcaggttctctgtcaggcggacttgagaactcaaaagtgacagcggatgttagaagcaaatacagtattaagtatgtaaattatgacgaatattacccaaaatcagttctcaaaaaggaaattatagacagtgacaatgacggtatgcctgatgactgggagattgccagaggtctgaatccaaatgacagcagtgatgcaaatggttattatattggcggagcctatactaatattgaacattactgcaatgatttgactgtagattcattccccgagggggtagttactttatcaccgacgctggacgagcttggagctgattattctaaagcaaaagaggacttaaattctcttaagctttctaaaactaaaatttcgtcggctgatgaaattagtttgccggtctcgggttctaagtttggctcaaaaataagctggagttcttcatcggattctttgaaaatagagaataatgctgttactcaggtgattcagccaaccggcgtgagtaatgaaaatgcatacattgccgcggatatagcgaatggtgattgtgtgcttaaaaagtatttcactgttacgatactttcttcaactatgaattggttcgcgtcgagttccgataacggcaaatcggcgggcacggttctggctgatggactgagcaatgtaagtggtattatcacgggagaactcggagcctcggtctccattgacggcgtatcaagaacgacatatataacgtcggatgcaaacggcggttacagcgatggcaaaggcagcggaacatgtcttaaatatacggctcctaatgatggaacgctatatggatatgcggcggaattggcggacacaaagacgctttatattgtacctgaaggagttgaaaattataaaactgactatgttggtatgaaggcaggcaacggaggaaccgttacggtttcagctaaggtaaaagccgggaatacatattatatcttcactgcgggaacaaaaggaaagcttttaggaatgaagtttgccaaaaaaacagagagttcttctgagatatatgaatcaaattatgaaaagtgggacttcgatgagctttcagcaggaacttcatatgctaaaaatgataccatcacaaacaagaatggaaagagtataagccttgatataactgacgcggcggattctattactattgcaaaccgcagcggaagcagtaactatctaaagatcgcggataacagtaaaagcaggttgaagtggtcgtataaaccggattcgccgttaagcggaaataaagtcgtatttgaatttgagtttaataaaagcgatattgaaaaggacacaacgttcctaagagtatatgatgaaattaatgcgaatgcaaataatacttattcaaacggaagtgttatatttgatttaaagaccagcagcaacaagggagagtccagttcaacaagcagcgagcttgttcttaccgattatttttctatgggaacaagcagcacagacgatagtcctaagggagtagattttggtttttcaaatttcacctatcaaaaagataaatggtatggtattagacttgaatatatgaaaaatgctgacggtaaaaacgaggttgcactttatactaaaaacgacggagcttcaaagtatacttaccgtgactccgttatattgggctcaggggttcagagaccgaatgcagatatagacaatttgactctgacgcctaccaaaatggaattaatgactccgggaagcggaactgttacaataggtatagataatatatcgattggaactgaaacacttgctgaagaaccaaaaacagatacctatgttttccgccaaaacggcgttgaagcaaccggctatgacgacagcgaactgacgtgcagtataaacggaatgcctgaaaatgctgaatatactgcggcggcagctgagtatgacggcaatggtatgttgataggtatgacaagaagcgaatgtgtgggagacggcgagataagtataatgccttcagaagcttcacaggaaattaaaatatttgtttggagcgatatggcaagtatggaaccactaatcgaatgtgggaatataaaaagaaaataaaatatttgttatgaatgtgttaatcttataataaattatatatttaatcaaaactactgttcgttgcgtagaaaaagagactgggttttgaacctgcctcaaaatctttagattttttgtctaacttttgggggtcggttcatttgccggtctctttttctgtaattaattattagaaatatggtatttataattacaacttacagcaatgctaaagtgaagtataagttttttagcttaaaagtttgttaattataatgttatgtaattaatcctatgtgtatattaatttatgtatataacaaatatttaacgtataaagtatgaacggttggcggatatatttgaaaagggattaaaatatttgtgtatgattcagtaatatagatgtgaaacaagttagggaaaacttaatattttagaacagagattaaataacacatattaaagcgttaaaatgtataagttatttattaattagaattgaaaacggccgtctagatttgaactgacctcacaatcattagattttgtctaacttttgggggtcacatcaattgacggccgttttcagtttttgcagttaattgtgtttaaagcagtatctgtgttttatagagaaaataattttataatatagttattgttccagcaatattacgtcattttgaggacttaataaatcatcccaaaggtatactttgatattatatttttctgaaaatgcaatctctatattctgagactgagaatcagatgaatatggaatttctataactttaatatcctttaaaatcgtgtttgtctcatcgtatactgcaacagcaaataatgcgtttttatttttagtattaacaatttcagcagttacttttccgttttcaagctttggatattctttgtaatatattccgggaatattcggcgttgcggtcggcgggtttgcactcggtgttgcagacggttctgtggtaggcgaagcagttggcggtgctgttggttcagcggtcggcgcaggcgtgctggtaggttcgccgattttgctgaattgagcgcttataactacatttttggccggcatagtaaaagtatagttgttttcgtcagttttttctactacacttccgctgtctacattgacggaattaacaaagtatccgtcttcgggggatgcgattatttttacggtttcaccttctttggctgttggaactttgtctgaaaaagtaacactctttaatcctattttcgatccattagcccaagcataatatcttgaatccgcttcaacaggtataacatacgtgttgagttcggctgatgacggcacatatgatttaataaaatagctttcggttgcatcatcataaaggttaaatggtttgccgggatttagaaataattcaagagtcaagtatcccggtctgtttggaataaagctaaagacgtttccggtaggttcatataagctgagtggaaataggacattggggttattaagtccttttaggacttttgttctgcttccgtttacatcaacataattccattgcacagcgtcccagaatgtaaaagttccgtcgctgctgtcttttccatttatattcagaactgcctttccgttgccgaatatattggttacaccttcaacggcgtctgccggaatattgtcgtcggcaagccaggttattttattgccgccgcttccgataccgctttccgtctcaatttgtatggttccgttttgaatattttcatcaatggcaatttcgtattttgggattgggggttctgttggttcaggggtagcggttggctgcggcgttggcgttgcattttcatctgtcagtttaagattgctgaattttgcttccgccatatactctttcctaggtgtgccctgtattgagtcgaccgccagtcctacgtacagagtttctgctaatcctgatattgttatagtttgaggctgtctcggattatctctccagttagtgccgctgtctgaaactgacagagtaataacgtcgccttttctttgcattctgaggtatttaggaacgcggtattcagatttgctggtgtcatatgagtcgctgttggatatttcttttccgctgctgtttctaaaccatgaaacttttgctgaggagccctgtgaggtcctatatatagcctttacattttcaccgtatttaagccagccgtcagaaagcatagccattctcgaattgccgttaaggttttccctaagcatgattccgcagagctcgccgttttcaaatttcggaacctgttcggttttgacagaaatatcaaaatcgcccttgatttcctgatacataaaatcgcaggtatccgaaccttttccggctccgattgctccgcttcccattatggtatatactccgttgtccaggctggatccgccttttccgttaaaggctgtagtgccgatttgagcatgactgaaactgcccggatcagaacatgattttgcatacacaatagatgtggggctttgagttgattcgcctttgttgttataagctcttgaagaaatataatgagtgcccggagttaatgttatatctgtgttaacagcagaatcgtttactgtttttaccagtttagaaccgtcatatatttctattttggttatatatgtgtcatctgatgaaggtgacgcttcagcacagtaattcaggtcgaagtctacagtcagaacctcccagtttccgttgtttatctgtttcccgtctatagtatccgaaatagactgtatcgccggattggtaacaactatagaagggtttgtgggtgctgactgttttaaagtccagtcgtttacataggcttctatccaagtatatccggcatattgaccgctttttactatctctgtttcagaagctgtgcccattccgttttcggatttccaatcgtcagggatggagaacacgcgttttgttgcaggcatttcaactaaacccgcaacttcattcgcattgtttattattctgccggtttggtttttaacgtcagctattattctcgcgtctatgctgtccctcttaggaagggttgcgcctgcgtctgataataccgtgttataagcttcttcggcgctttgggtttcggaaagttcatactctcccatatctattggggcggaaagcttgtttgcggccgacgagttgtttacgccgttccagttatttgccgtaacattggcatccccatacatatagtttccgtcaaaataaaaattggatttagagacatcaggataagcgtttgatatatcaaatattctgctttttatttttgacgcggtacccgggccgaatttataataattgtttatccaattcacgtttgaaggagtttgagtaacgttattgtatgaatacggttcggcgccgtatgcggagtttgtttgaccccaattatatattacgttattgcgaacatctgtgttttgcagctcacggtcaagacgcgggcttcggctgtcatgatgagcaagcaggttatgatgccatgttgagtttgttcctccgaaaatagctccgtatccgtgcgcgcctttaaagtggtttgacattcttaggctttctgtagccaggcagttttgtactgtcatatttgaactcggagtaccgctttcggttgagcctgcgtacagcgtcaaaagttcgtcaacgccccagcttgtactgcagtggtccaggataatgtttttgttccagcgtccgccgattccgtcaggttcaccgccgtttatatcggttggtctgactctcaaatatctcataataatattcctgacgccgtttgctatagaaatatcaccgccgagaagagttattccatctccgggggcggtctgaccgagtatggttaaattactgttttttattgtaaaagttccgtttaagcgaatggttccgccaacatcaaaaacaatgattctgccaggtcttgaaaccgcgtcagcgaatgaaccggcgccctttgtgttaaggtttgtgacatggtatactgtaggcgacgaagcgccgcgtgctccaagtgtatatttaccgccgccttcagctcccggaaatgccggaatattgtctgccccaaagaccgtatgaacgggcagtgctaaagtgagcagcgcaagcagaaccgcaaatgcggaacaaaatttttttagacagtttttttctccccttaaaatcataagtttaccccctaatttgtctgttaacttcattaagtaaaaaacaaattaattataacatatttattataaaaaaggtaatgaaaacttagctctaataacaggaattttgcctttgaatgtgaaaaaaattaacatttttagaaaaatccaatatttatccatatggagttgtaacagttcatgaagacatagaattcttgagacggttaaattataattaaagtaatatgctgatattggtttcagttttatactatctccatttgctgttacatagatagattattagtctaaatttcagtattttaatgttattcttgacgttaactttttctgctttttgttatactgtgtcttgaagcggtacttaatatataaatttaaatatctatttaattaatttgtatctgcaatttgataaatttattttcatattctttaatataattttattctcaaggcataaaaaaacatatttttgagaatttattttattcttcccggggaagacagttttttataagtctgtttttacttgaattgtgcaaaagattgacagttgattttatatttagcattctgccgggacctgttgttattaaaaatacatggcaaaacttaatttaaacttgtatatttgattatgactatataaaagattgacatacataagactaaattataaaatatattgtaagttcttatttatgattatatattagtataaacaagtgttttatttataagacgaacaaattatataagataaacaaattagataggatgaaaaacttatgaataatgaaattaaaatacgtgcggcaaaagcggaggacgctaaagcgcttctaaatatatatgagccttatgttaggaacacagctgtaacatttgaatatgaagtgccttctttacaaacttttgctgaaaggatttgtaatgtgctggacaagtatccatatctcctggctgaaaaaaacggcgaggttttgggttacgcttatgcggattcctttcacgagcgggcggcttataaatgggcggcggaaacttctgtatacataaagatgaataagaggaggtcggggattgggaagattctatataatgagctggaaaacattttgaaaacgcagggaattttgaatcttaatgcctgtattgcctgtctaagtaaaaaagatgagcatatatccgacgatagtttggtttttcataaaaagtgcggttataagtatgttgggaagtttcataaatgcggatataaatttaacaagtggtatgatatggtatggatggaaaaacacataggctctcatacaagtaatcaaccggagataaaaaaattcagtgagataaaaattgatataggctgatataaaacgcggcgctgaaaactgcgctttttaatctataaaattaataattccgcaagatataattttatgttttttattttaaaaatatttataaatcagtattgacattgaaaaaattgtatggtaaaatatatgtctgtatatagtgaggaagtttgcttattttgaggttataactgagactgagaaagagttgttgtgtgttagaatcaacgttttttcgagggatttcgcagtcttggattattagattttactatgatttttaagccccggttgttaagcgatttttttattgtattcggatgcccgaaatatatattttgtggttttataaaattttatacgagaggtgatcggttttatggtacatcctgtgaaactaggcgaaaacacacgtatgagttacggtaaaatcaatgaggttttggaaatgccgaacttgattgagatacaaaccaattcatacaaatggtttttgagtgaaggactgaaggaggtctttcatgacgtttctcccataacggattataccggaaatcttattttggagtttattgactatagattagagtcaaagccgaaatatgatattgaggaatgtaaagaaagagatgcaacatacgcagcacctctcagggtaaaagttcgtctgataaacaaagagtcgggcgaggttaaagaacaggagatatttatgggcgattttccgcttatgactccgtcgggtacgtttattataaacggagctgagcgtgttatcgtgtctcagcttgttcgtgcgcccagcgtatattatgctcaggattatgataagctgggcaaaaagctgtttacgtctcaggttataccaaaccgcggcgcgtggcttgagtatgagactgacagcaatgatatttattatgtaagaatcgacagaaccagaaaaattcctgtgaccgtgttaatacgtgctttgggatttggtactgacgctgaaattatagatttgttcggtgaggatgaacgccttatcgcaacaatggagaaagatacaaccaagacccacgaagagggtctgcttgaagtgtacagaagactgcgtccgggcgagccgcctactgttgacagtgctcagtctttgatttccagcaccttctttgatccgaaaagatacgatatggctaaagtcggcagatataagtacaacaaaaagctgatgttaagcgatagggttacgggtcatgtatcggctgagaatattatcagccctgttaccggtgaaattctgtgtgaggccggtcagacaattacaaaagaaattgctcacagtcttgaggtaaatgctgttaacgaggtcgttttagactgtgacggcaaacagacgaaggttatttcaaacaatatggttgatatgcctgagtatattttgaataaaataggcgaagagctcagctatagtccgcgcgagtgcggaattaccgagcgtgtcagacgcagcgtgcttgatgaaattttagaccagttcggagatccgaattctgacgagtttaaaacagctgttgaggacagacgcgacgatcttcagcctaagcatgtgcttattgatgatattatagcgtctatgtcatatatcggcaatcttgcaaacggagtaggcgaagttgacgatatcgaccatttgggcaacagaagaataagaagcgttggagaactgcttcaaaaccagtttagaataggtctttcaagaatggaacgtgtggttcgtgaaagaatgaccacatctgaccttgattctattactccgcagtctttgattaatataagaccggtaacttccgcaataaaagagttctttggttcttctcagctttcacagtttatggatcagattaaccctctcggcgagctgactcataaaagaagactgtcagcgctgggacccggcggtctgtcaagagaacgtgccggatacgaagtgcgtgacgttcaccattctcattacggccgtatgtgtcctattgagacccctgaaggtcctaatatcggacttatcaactcgctaagcggatttgccagagttaacgagtatggttttatcgaaactccatacagaagagttgaccatgagaaaatgattgtcactgatgaagtgacttatatgacagccgattatgaagaaggtttttatgttgctcaggcaaacgagcctttgaatgatgacggttcatttgtgaacaagaagattgtcactagatataaagatgaatttatagaagttccgcctgaaagggtggactatatggacgtatctccgagacaggttacatctatagctacagccatgattccgttccttgagaacgacgacgctaaccgtgccctgatgggttcaaacatgcagcgtcaggcggttccgcttttggttcctgagtctcctatcattggtacgggtatggaatataaagccgctaaggattcaggcgtttgtgttcttgccaaaagagacggaacagtttcccgtgtatctgccacaagaatagaagttaagacagacgacggcgatacggacacatataagcttataaaatttaagcgttccaaccagggaatgtgtataaaccaaaaacctatagttgaaaagggtcaaaaggtaaaggaaggtcagataatagctgacggtccgtctactagaaacggcgagataggtcttggaagaaatattcgaatggcgtttatgacatgggaaggttacaattacgaggacgctattctaatcagcgaggaactagttaaagaagacgtattcacttctattcatattgaggaatatgaggtagacgccagagatacaaaattaggacctgaagagataacaagagatataccgaatattggcgaggaagcgcttaaagaccttgacgagagaggtataatacgcgtcggagccgaggtagagagcggagatattttggttggaaaggttactcctaagggagaaaccgaactcactgccgaagagagacttctgcgtgctattttcggagaaaaagcccgtgaggtaagagatacttcattgagagtgccccacggagaatatggaattatagttgatgtaaaagtgtttacaagagctaacggcgatgaattgccgccgggagttaatcaggtagtccgctgctatatagcacagaagagaaagatttctgtcggtgataaaatggcaggacgtcatggtaataagggtgttgtatcacgtattctgccggttgaagatatgccgttccttcctgacggaacaccgcttcagatagttctgaaccctctaggcgtaccttcgcgtatgaacattggacaggttcttgaggttcatttgggttatgccgctaaggctctgggctggaaggttgccaccccggtatttgacggtgcaacagaggaagatataatggaagccttaaaagaggccggatacaacgaagacggaaagagcgtcctctatgacggaagaacaggagaaccgtttgataacagggtaacggtaggttacatgcacatgctgaaactcgcccatcttgttgatgataaaatccatgcccgttcaaccggaccttactcgcttgtcactcagcagccgctgggaggtaaagcgcagttcggcggacagcgtttcggagaaatggaagtttgggctcttgaagcttacggcgcggcttatacgcttcaggagatactgacggttaagtcggatgatgttgtcggacgtgttaagacttacgaagcaatagttaagggtgaaaatgttcctgagccgggagttcctgagtcgtttaaggtattaataaaagaattgcagagcttggctcttgatattaaagtccttgacggagacggaaatgaggttatacttcgtgaaactctcgatgatgacgaggttgaggaattgcctgttaacattgccggatttgaggacgatgaactcgttcaggctaaggcggctgaaccggaagatgaacttttggcagaagaagaggctgatgaagaagagaccgaaagcgatataattgacgaggtaactcagattttggcggctcctttgattcaggaaggcgacgctgacgtttcagcttttgaggacgacgaggatgttaagtcatttgaagaattgagagatgcagaagattttgatgatgaagacgacgataattactaattaagaacagtcagcataaactgttcagccgttatcggtttatgtttttcaattgatattgtttgcttaactcacggcagacaaagggttatacagtgagtagaaaggcatggtcgtttatgggagaatatcaaaattttgaagcaatcaaaatcggacttgcttcacctgaaaaaatcagggaatggtccagaggtgaagtaaagaagccggaaactataaactacagaacactgaaacctgaaaaagacggtttgttctgtgaaagaatattcggaccgcagaaggactgggagtgtcactgcggtaagtacaagagagttcgttataagggcgttgtttgtgaccgatgcggagttgaggttacaagaagcaaggtaaggcgtgagcgtatgggacatattgagctggctgtcccggtttcacatatttggtattttaaaggaataccgtcccgtatgggattaatgcttgatatttctccgcgcgcgcttgagaaagtgctgtattttgccgcttatatagttattgacccgggcaataccggacttatgaaaaatcaaatactgactgagaaggaatatacagaaaaccgtgagaaatacggcgatatgttccgtgccggaatgggagctgaatcaatacttgaaatgctccgtgaaattgatcttgaggaactatatcaggaactcaagaatgatttggaaggcgcaaaaggtcagaaaaaaatcagaactgtaagacgtcttgaggtcgttgaagctttcagacagtcaggaaataagcctgagtggatgattttatcggttattcctgttataccgcccgaaatcagaccaatggttcagctggacggcggaagatttgcaaccagtgacttgaatgacctttaccgacgcgttataaacagaaataacagactgaaacgtctgcttgatttgggcgctcctgatattattgtcagaaacgagaagagaatgcttcaggaggcggttgacgcattaattgataacggaagacgcggcagacctgttaccggacccggaaacagaccgctcaagtctttgtcagatatgcttaaaggtaagcagggacgtttccgtcagaaccttttgggaaaacgtgttgactattcaggccgttcagttatcgttgtaggaccggagctaaagatttatcagtgcggacttcctaaaaagatggctttggaattgtttaagccatttgttatgaagaagctggtagaagacggacttgctcataatataaaatctgcaaagagaatggtagagcgcgtccgtgaagaagtttgggatgtgcttgaggatgtaatcgcagaccatccggttcttctgaaccgtgcgccaacgcttcataggctgggtattgaagcctttgagcctgttttggttgaaggtaaggctctgaagcttcaccctcttgtttgtactgcgtttaacgctgactttgacggtgaccaaatggctgttcaccttccgctttcagcagaagctcaggctgaggcaagatacttgatgctgtcagcgaacaacctgataaagcctcaggatggtaagccggttacggttccgactcaggatatggttttgggttcgtattaccttactcttaaagatgatactgagctgggttctccgagagaagaggacggtcatactgtatatagggtatacagttctcctacggaggcaaagctggcttatataaataaaacagtaggtctgcacgctcctataaaggtacgcgttacaaaagagatagacggcaagacggagagcgctataatagacgctactgtcggaagattgatattcaatgaaaaaatccctcaggatttgggattcgtagacagaaccgaccctgataagagatttaatctcgaaatcggagatgaagttctcaaaaaacctgacgctaaaaatatcatcggcgacaacgttgaacccggtgttgataaaaagctgttaggtaagattattaacgccagcataaaggtgcatggcataactgaaacagctactttgcttgacgatgttaaagcaatgggatataagtattctacgattggcgctataactgtaggcgtttcggatatggaaattcctaaagaaaagaaacagtatctgctcgaagcggaagaggaaatcgataaggttgttaagaactttaggcgcggacttcttaccgatgacgagagatatcagaaggtaatcaatatttggaactctacatcagataaggttacaaaggcgcttatggataaccttaaacagcttaatccgatttatatgatggctaattcaggagcccgcggaagcgttaatcagattcgtcagcttgcggctatgcgtggtcttatggctgatacgtcgggaagaacaatagagattcctatcagagctaatttccgtgagggacttacagtgcttgaatactttatctctactcacggagcgagaaaaggtttgacagatacagcgctcagaacagccgattcaggttatctgaccagacgtttggttgacgtgtctcaggatgttattgttcgtgagcatgactgcggtacggatgacggaattattgtttcagatataatggacggtaatgaagttatagagccaatggcagacagacttgagggaagaactataatcggcgacctcgtttctcctgaaacgggcgaacttattgctgctgacggcgatatgataactcatgataaggcggctgaaatagttaagtcaggaataaaagaagttaagatacgttctgtggttaaatgccgcagtaaggttggtatttgttctaagtgttacggtatgaaccttgctactgcgaagccggttgatataggcgaagcagttggtataattgccgcccagtctatcggtgagccgggtacgcagctgacaatgagaacgttccacgccggcggtgttgctcagggcgatgatattacacagggtcttccgcgtgtcgaggagctttttgaggctagaaagcctaagggtgtcgctatcgttacagagggagcaggaactgttcatcttagcgaagctaaacaaaagcgtgagattattgtgactaatcaggagacaggtgaagcctttacgtatctgataccgttcggttccagaataaaggttcgcgaaggtcaggaagtcgaggccggcgatccaatcacagaaggttcgcttaacccgcatgacattatggctataaaaggcgagaccgctgtacagaattactttatacaagaggttcagcgtgtttatcgtctgcagggtgttgatatcaacgataagcatatcgaagttatcgttcgtcagatgatgcataaggttaagattgaaaatcccggagacaccggattgcttacaggttcgttaatcaatatatacgaccttgagaaaattaatgataaggttattgctgaaggaaaagaaccggcagagtattcagttcagttaatgggtattacaaaagccgctcttgctacagaatcattcttatcggcagcttccttccaggaaactaccagagttcttacagacgcggctattaaaggaaagacagatccgcttgtgggacttaaggaaaatgttattatcggtaagcttgttcctgccggaaccggaatgcctatatataataatattgatgtttatgcaagctatggcgcggttgcttctgacaataattcattgttggatttggacgctgaagactaatattagtttgatataaaaataagcatatgctcagcatatgcttattttttataatattgaaatgtgataaaaatattttgcggagtatattgcgcatattatattgaattctgtaataaagttttggctatataatcgtaatggatactataaaaattttattgattttctaattagttaattcacttatattgatagttgattactaagctatttatattttttaattataaaattatatttaacttataagaaattttaataaatatatttaatgagtattaaaaaatataatttaattatatagatataaaaaattataaatttctaattaatatattatttttattgaaggtaattatttaagctattttaatgttttaattataaaattatatttaaccataagatactatgataaatgtatttatgagttttgaaaattataatttaattattaggctataataattttatttgaagcttgttcaaatcattacttcaaattattattgtaatattggaattacaaatttatgttttatcaaactatgattcattctgataatccgttttcgaaaacatcgctttcattgctattattcggattattatcagaggattctgtagtttttgctgcttcatcattatctgtataatctgtcacttctactcttgataaattagacgcttcgttattggaatttgcttgatttgattcagaatcttctgataatttaatctcttgatttgagagaggttcttcttcagttggggttgtttttgatgcactatcaacgctgtcaaccgtttttgtcaattcttctttttcaataccgctttcacttctgacagaataagacatgctgtcgtcctcccatacagcggattgatatatatcatcattagattttaaaactacgtttttttctcctacttcaacctgttcttctttatcataaatattataatctccctcgcttccggcttttcccggtcctgttctatatgtcatacagtcatttttactattatattttatttgtactacgctgccgaatattaaagaaaagtcgtatggacggtagccgtcgggtatatatttcggtacagaaaaatcaaaagcagcaatttttctcagttcatcaatactgtttgcagactgcataggacttccgcttgaaacctctcctgagctgctgttatctatttgattatcatcagtattgtcgttttggactggcggtataatatttgaattgttttcatcttccggatttataggagtgttgtcaaattgattttgtccgtttatataactagagttgttttcagtataacgtggattatcagaaaaatcttttggttttacagcgctggcgtgccaggatttaatgcctgaattattggggctgttagaaatttcattattgtattcctgctcactatttatttggttagaatcaccggagttttcttcccttgaattgttgtatggaataatactatgattaacagtcggcggttctgtgtactgtgaagaataatcaaacgccgtgttttgaatattgggatttgatttaaaaactattatagatgtaaccgttaaaaccaaacatgcggcaatcccggccgcgcggcgtatatagtatattttgggggtgtatttcttttgattttttgcctgtaagattattttgttttttagttcgtcggacataactattttgtccattgcgtcattatattttttactcaaaatcatacatctcctttagtattggtttcagcttttctctggctctgtgtaaaagagaacggaccgtcgattctttttgtcctgttatctcggctatttgtgttgtcttatatccctcataatagaaaagatgtataacggtactgtatttagcgggcaggcttataacagatttgtatactaaattctctgaactgtattcatcataatatgggtgctcctgaacttcatctatagagcagatgtttctgcgccaaaatagttttaatttattcttgcagatgttggacgtcactctcattatccaaagtttttcatgtttttcattttcaaatttcccgttatattcgaataattttataaatacatcctgagaaacatcttcggcgtcctgcttgcttttcatatatgaaaacgcaagtctgtaaactgtatcgccatacttgttaacgagattttcaatattacaatctaacgcgtgcaagcaaacgcccccctttcaataaaatgataacacagtgaaagccgcataactgcggcttttatagttatgataacatatttatataatactttcaatcattgatttaagctcatcaaaagttataccgttatccgcatatattgaaaaactgaactcaccgttgttccattttgcattgtgcactttttgaccgtttccgctgtaagatatttcatatccgtttatttctgcagtttttgtaaattcatatgtattatagtcgccggatatatcttccaggcttttggcggttctgtaactgagttcgctttcgccgtttacgtatgtcaaatcaagtgcggtatttgaaatggttgttattttagataactcatagcctgccggcagcgctgttggaatggaagcgtcaattcccagactggcttttgcttcgtctacagtgttatattctataataggatttggaatctgaaccaatgaattatcttctttatctgaattgtcatttctagttatagtgatagtattattatcaatatttacacttatatcatcaagcagttcaaatagctttagtggtacgtaagttgtatcattcaataattcgggagctgccccaagcgatgatggagccgacatacctatagctgtggaactagcggtgtaataactgtcaagcccaatatagacagttgtatttttttcaccgttatctaaaaatacagcgttttcttcctcaatccattcaattttaaatccaagcttttctccgattaaacgaacgggcaccattagctgaccattattttcatagatatttgcggggatttgttcgttgtttattaaaacgtttgcggggcaggcttgtgttgaaaccagcagcggtactccgctgtcaatagggtcagcgtctgccaatacggctgttgtcaatgacaaagataatgctcctgcaagtactgcagctgtgatttttttgttcttcattttaaaaaacctccaaatttattattttataacttcatatagaatacaactcggaatgtaaaaatgttgcattttttataaaaatttttattttaatatttaacgacgataattgctgaaatgtttatatttttatccagtattgttataattataattcagttttaagacgcctcttttattattaaagtaaatagagaaagtaaaaatatccacttatttaatagatttttttaaagaaaaattattatatattttgtttctaaatcagagaacggctgaagctgccaattaacggactgtacaaagacaaacggctgattacatttcaatatatcaaacgtagatttataaaaggtataaaattggatgtgtaaatgtaaataaaattatatgatattttttatatcaagtcaaaataaaatttttatagtaaaacaattttaactttaatacagtttgagactatatttattataacatgatattgatataacataaaaatttatttatataaatatataaaatcgtaaaatgttttaattcggcagttataaggaaagtttaagacaggattatatttacgcatgtattaaggcttattacatttctgtttagttcaatgtgaaagccgggaagtctattcagtccatatcagtttattagtgataatatgcgcttttgtctttggtatttagtctttttaggcgacagattattttttctgtatagtaattctatctgtccgttcgtttatgtcagcataaataaagccttttacgcagttctaggtatcttaaaatgtgcaatcgacacagcgtttgactgtaactcagaatttcttttaatctattttgagaattatttctctctgaacattccataaataataccagacggacaatctgttaacaccgcggtttgaaaaagcgtttgcaaaccaattgcaatgagaagtatacgcccattttccagctgtataatttttattaaaatcgcttttttaaaaattttttaacctgttcttagttataaccagaatttcaagttttttagctgtatgttttactattatttcgccgactcatcaaaattggcggcggttattctattttaatgttattaaaccggatttctgtgatatgtctgccgctgttttcaatattctcaggtattgaggtgtgacgtttatcaaatcgtataagtctgcgcgcaaaaacatattgacaaatttcaatatgatgtatataatataaatgaatatagaaagaaggaggctcggatcatgacagaagatgaaaaaaacgcaaggatattcaaagctttttgcgactcaaatagattgaaaattttaggcttgctgcaaagcggagaaaagtgtgcgtgcaaattattggaagaacttaatatcgggcagccaactttatcacatcacatgaaagttctatgcgacgcagaaatagttgcagggcgcaaggaaggaaaatggacgtattattcctttaatccggaaggcgttaatcatgcaaaagaattgcttaatcaaattacaacggtaacaggcagcactcaatgcagccgtaattactgataagccgcctaaagtacgggcggcttacaaaataaacaatatatcgatatattgcgatgtgtaaatggattggagggtttttcttgcagattattatatctatattgaatttttttcaagatcaagtgttaggcatgaaatggctgaatgcggtgatcggcagcggtttgtccgccgttggtcttgatcttgaaagcaaggttggcgcaagtattcagtttttcatttacgatacaattaagattactgttttgctttgcgtacttatttatctgatttcctatatccaaagctattttccgccggaaagaagcaaacggatattagggcgttttcatggagtaggtgcaaatattgccgccgccttgcttggaacggttactccgttttgttcatgttcttctataccgcttttcatcggctttacaagcgccggtcttcctttgggcgtaacattttcttttctaatatcgtcccctatggttgatctcggctctctcgttttgttaatgagcatattcggatcaaaaattgctgccgtttatgttcttgtcggtttagttatagctgtcgcaggaggtacaatcattgaaaaactgcacatggaaaaacatgttgaacagtatatcaaaacagctggaagcgtagatattgaagccccggatttaacaaaaagggaacgattgaagtttgcgctggagcaggtttctgctactttcaaaaaagtttttccttatattcttgttggcgtcggtattggtgcatttattcacaactggataccgcagacttggattgaaacagctctgggcagcagcaatcctttctcggtgattttggcaacgcttgtcggtgtacctatgtatgcggatatttttggcacaattcctgtcgctgaagctctgtttgccaaaggtgctcagcttggcgcaatcttatcttttatgatggcggttactactttgtccttgccgtctctcataatgctgcggaaggcagtaaagcccaaactgcttgctctttttattggtatctgcgcaggcggaattatcattgttggttatttgtttaatatatttcactattttttggtttaaatgaaaggagattatcattatggcactttttggaaagaaaagaaaaaaagaagaaaccgcctcctgctgcggtaattgcaatgctgaaagtatggcacaggctgaacaagcaaaaacagagggggcaagcgttaaaattttaggaagcggctgcacgaaatgcaatcagcttgaaactgctgtaaaggcagcgttagagcagcttaacatggatgcgtctattgaccatattaccgatttttcacagattgcagcttatggagtaatgactaccccggctcttgtcgtggacggaaaggttgtgtcttatggaaaggtgctcaaggtcgatgaagcagttaaaattttgaatagagttaggagttaattctgcggagtgggctcttcgctgaataatacggttgataatacatgaagtaaaaaatgaattgctgtaaaataggcggaaacacggaggttttgagagaatttcaagccttcgtgttctttttaattttttatgagcgtaatcgttttgtcttcaatatacgccgtttactatggagaattacgcagtaaaagccgtaaatgtaaccgcgaattgctcatctgtttctgttatgtgaaggtataaatcatgttatacttttactgttttaaaagtgcttacaatctctcatagattttgaagcctatgcggttttgcccaaaaaatcccgcggaaaacgatgattgaagtataatagaagccgcataacatttgtattatgcagcttttacgtgtttttgtgattatatagagtgctgaaatggattttttgagaacaacgcgaaaaaatactgtttttatgtttttataggtcataaaaattttataattgcatagaagtctagcatatattgacaaatcttttaaaataccatatactagatttatcaatttatatggaggaatgaatgatgagtttagttataaaatcggttaatgataaagagtttgctcagtatggaagagtggtagaaggtatagagttcagccggcttcttgataaacttaaaaacacaactccggcgcctgctgatgaggtcatttatgtgccgggagatagtaatttggaatctatgccggaagcggagttgctcagcaacaatatatacggcggtatgccgattcaaattgggtattgtaatggaacaaacacaaagctgaactgcctggaatatcatagggacagcgaaatagatattgccgctgatgatgtggttcttcttttgggaagacagcaggacgctatgggcgatagctatgacactggattggttgaggcttttttgtgtcctgcaggcacggcggttgaactttatacaaccacactgcattatgctccgtgcagcggaaaactaggagattcgtttagagttattatagttttgccgaaaggaactaacagcgaaaagcctgatatagaaattaaaaatgatgaggacaagagactgtttgctagaaacaaatggcttattgcgcatcctgaatcctctgaggctgataatggagctgttgtgtgtctcaaaggcgaaaatatagatattgcggaattaatctaaatataatttgaaaggggaagagggagtaatgagatgttttaattgcggcgcggagatagagccaaactctgttgcgtgtccgaggtgcggcgcaggcgtgcgcaggccaaatgctgatttgacggcggaacagccgcctttgcgtcagccgggatataatatgagaccaaaccagcctccgagaggaatgacgccgctttacagtgaaccaataggtcagcccgtatcggtactaagatgggtaggacgtatgtttctgccatggatacctattgttggcggtttggtttattttataatgataattgtatgggcatgcggtgataagtttgatgaaacgtcaaagaactgggctattgcttctattattatgatagctttcaatttgctggttacaatagttatattttgtattttttatgcggtatttatggcgttgtttaacgatgcgtctgttcaaagggatttacagatgttctttgattcggtgccatataatatataaattaagttttgagaaaagtaacaattaatctatttaaattgtgacgttggagtttatagatacaaaagtatgtgcggttttatcggcaatgcttgtaatgtgtattcttatttcttgcggaaataattctatagttggtatatgggagccaaatggcagcggttatgaaatggaattttatgatgacggcactatgtcgtcaaaacatgaaacaggcaaatatgaaacaatagataatcatttgagaatattagacatgggttttatgggtcatgttctatcatatgattatgagataaatggcgatactttgatactgattaatgacagcggaatcagacgtgagtataccaaaaagaaataagataaaagttcaattaagaatattcaaattttttaaaataggacttgcaattttgtttagaatatgttaaaatctaatgcggtgctgaaaatgacagcggctaaattcggagaggtggtcgagctggcttaaggcgcagcattggaaatgctgtgtacgtttatagcgtaccgagggttcaaatcccttcctctcctccaaataagccaaaaccgccgcaaaacggcggttttgttttgccttaaatgattttttacacaattttattcaaaatatttaccgcttgctcttattttttggggggatatatggggatatgtattccctgtcgtattgacgtctgtataacgtaagcgtcgggcaatcccatgtatatttatgccttagtttgctatcagcgaggcgtggctatgactaaaatcgtgtatgcttatggttttcagtcttgatgattaggcaaactgttcgttaatttttactaatctagaatctttgagcggacatgtgtttcctcaaattctgaaatcgtcgttaaaggctttgtgcttataccggcgttttttatgttcatctgaaattttaattaataatatttggagatgcagtgcgcgtattaagcctatattcataagcgatgcttctttggcttagccccttaattttttgtgatattctgagcgttacgttcagatattttctatcaatatcaatcaatttcaaaacgtgtattttgtcctttctcagtacggtgtaaaatgcggaaggatacataataatcccagccatttaaatccggacaagtttcggcgtgtttaagcgcagatttggcgtatagtttaattcttcatatatgtaaaaatccatttctttgtttctatagtatttttaaagtttctatgtcaactgggtaattagataatcaagtttgacccggataccggagaagtatctgatatatacgcagggacgccgtttgagggtatgatgattatagcggccgggagaatttctactcatatgtgggaatctgagagtgggaagaaaaattattccactgatgtaacagtaagcgagataagttttggagagagcaaaaaaatgggtcagggcgataatgatgtgccggatgatatgccgttttaattttgccggctgttatataaagcaaaaagttagttaagcagttaatttatggcacgcactgtcatttacattaaagtataattaacatattcatagtatcacaactaagtctgattattgataaattgttttaagtatgttcacgctgcgcgtgatatgacagctcacctaacgaggcgcacaagtgcgcaatatatcacaactaagtaaatttattatatgacaactaagttaattattggcatttatagtttgtataacacaatatagtttatataacatacacttttaaataaaagtgtagccgcaattgacattgcaatctataacaaaacaagttgttttgtatcacacccgccctacagacggggtcacacctaccgtagttcacaaaaaacactgtgttttgggtaaatatttaaaaaataataaaaaatgttgtttagcaagcatcggtaggtgtgaccatacttttcttaaaaagtgtgtgttatacatatgattttattttgccataatctacaatgtcattattatgaatactcaatgcagatgaaatctgccgcgtaaggcgcgcagccgtggtaaagtttattaatagtctgtattaagtttcagtaattagtattgttttgaaaataggggtggcattatcgtttgctgaaaaggcaggttgtaatgttgttccgtaacaggggtggcgctgccgttcgtataaatcgggttgcagcgttgttccaaaggagaattcttatgggaaaagaagcatttgatttctttcctttagacgtgcatcttccatttctttttctggcaagaaaaagaaacgcttcaccaaagaaaaagtgcttgctcgcttaggtcgcctgcggctccaaagggcgctcgcccccactaatttcatcttgaatctgcgcttcaagatgaaaaagccttgtaactttcccgttggatttttgaactaccgtgaataaagattttacgagttagtattaagatagatttgagcaaaaagtaggtactaattaaaacgaatataaaaaaatatagaataattataaaacttatcaatagattagaaaataaataattagtttgtatattgaacactgcgtgttcagatgttggctcacctaacgcggcggcatagccgcccttccgatgttcgctgaaccccagcgtttttgacgaattaaataaataggaaactcgaaatatcttttttcacggtagttcacaaagtcaacgggaagttacagggcttttttcatcatgaagcatggcttcatggtgaaatgagcgtagtgcgagcgccccttggagccgcaggcgacctaagcgagcaagcactttttctttggtgaagcgtttctttttcttgcgagaaaaagaaatggttcaaacacctattataagtaaaataatatatattatatggggtcatatacatagtatataatttaaaataatatatagtaatataatttaaccctctttcgtattgaaagtattatttaaatatgatataatatattaaattcagggggggtatttaatgagtaaaaatattggatttgataacagggatcgttttattgaattaggtattacaatttccgcaataaggaaaatgaaaggattatctcaagaagaattagcaataagagcaaatattagccgctctcatttgagttatatagaagctccaaatatcgtgaggccgttctcattggaagttttatataatatagcagatgcgttggacgttagtgccggtgatttgttgaatataaaattcccatttagtgatgtaaaaaaagaatctaaatgattgaaacaaatactcttattatattttaagaatgaaaccatttaaaccattgaaactaaaccttgtatattgttttttataaaaaattatgttttttcaaacgtcggtaggtgtgaccacacctgcgaaagtgggcgtgagccttaataactctttatccgtaacccttcaacgtcaataatttgaatactcaaacgcggcaatgccgccgctttaggtgagctaacatttgaacacgcagcgttcaatatatcgttaacaattataaatataaaaataaaatattcttgacaaataaagagaaagagaatataataaaagcagataaaaggtaaccgttaaacggttgtcacaaaaacagattttaaattatataactgtcctgtgtcagaggacagttatattgcttttatggatactattataaaaattattataatagatataattactttaagtaagtatttccacataagcgacacctcccttctgctgtaagtaacagcatatggagatgacaaccgtcctacaattcccttttacctgctaaaagtaattatatatggtatatcgaataaagtcaaattaaaaattctttacataaattcacattttttaaaaaatgtaggtttgtcaatgatgtgttacaaaaaagattaaaagagttcaccgaaattgataaaagagttgatgtagtcaatgggagcttttggaaagctcccattgactacatcaactcttttatcaatttcggtgaactcttttaatcttttttgtaacacatcattgacaaacctacattttgaggaattttgtaataaattttatattatacatatgtttccgtaataacgttaattataaatcatcattttattattttcaccattttgacaccattctgcttctaattaccaattttccaataatgttacgcccttatctatttgagtctttaaaatgtgattatagtcttgtgtgatttcaacatttttatgccctacccagcctgatataacatttaatggtattcttgaatttgtaaattatgttacatatataccttaatccataaggttctgtgtgctcttcattttgtattcctttcataaaattattaattctatatataaacatcaaagtgagtatgaactgataaatatattaaaaatattctttgataaaatattacactttctgtcactgcttagattaagtaacttcccaacagaatctattttaaataatcctttaataaaaaatatttaaaattttaataaacttattcttttgctttttatcaaaattgtattttatagttttcttaaaatataaaataaatataaaaaatatagaacagctttatttatcaattatacttttttgaaataataattatattttaaaccaaaaaaacatagtaatattatgataatttacttgaattttacaatatattatattacaacatataatacatgggtggtgattatacactaaataataatataaaatataatttatttgaaaggttgtcatacaaaacattttattcgaaataaatttagtattttttataatttacaagtggataattatttataaaaaatttttaagtatttttctatatttattgattataatctcaaataaaatgtgtaactcaattgtatatgcaaacgaaaatattttcgataaaatagacgaaggtgtcaaactgaatagaaatctcaaacttactaaacagttagaacaacactatgatggatatactccgcaaatgtattatacattggtttttagtaacaacattcaatcattatgcagtaatacacttgagcaagaacaactaattgacttctgggttgaatagttttctgaataaattttaaaatacaataattatcttataatatcaaaataacataattataaaaaattaattctataaaaaaggttgaaaatgatgaagaaatttatttttaatatttttaatagcattaccagcaaccttttcctatgtttatgcagattttttgaatataaaccaaaatgataaaagcataaggctagccggtaacggcaccttagaaaatccgtatattattacttcagctcgtgaacttgatgaaatacgtaacaatttatcagctcattacaaactaggaaacgatattgatttaactgaatatcttagcgacgtcggtgaaggttatgctaaatggaacaaagaaggctgggagcctataggaaaaccagacggttctagaaacggatattttaccggaagctttgaaggagcatatcatattatatcaggtttatggataaaccgaactgattctgataatataggtctcttcggtggtgtaaattcctataataatgatacatgcatataaaatcttggcataaaaattgctgaaaacggtatatccggcaacagcaatgtcggcagtttaattggtgtttatgctacacaagataaagtcagaaattgctatgtaacaggaagcagcgtaagcggtgcaaaaaatgtcggaggtttgattggaaaccaaaatgtacttggcactacagttaactgttacacaaaaacaaacgttatatctgaaaaagatagtatcttaaacggaaatatcggtggtctgattggaattgcgagcggctcggttatatattgttatgcctcaggcaatgttaaaggaaaacgctgctgcggtggattgttagggagccttgagggtatggcaactgctaataactgctatgctacaggtgatgtcataagttctgatgatctcgccggaggtctaatcggatatttatacgatggaagcctagcaaattcatgcagcaccggcaaagtgcagggaaatatctacgtaggcggattagtgggtaagcaaggtggactaagcggcatcagcaattgttattcatcaagtaacgtaacagcagctagtgattatgccggaggcttggttggcgcacaaataagcccaccatattttcagaatttcaatagtataagcaattgctatgctggaggaagtattgaagaaacaaaaggcgaacactttggagccatatcaggttacttagatgaagaaagcagtatttcaaaatgctatcgttataatgattttactataaacggaaataaaattttagaagatgataaaaacagtgctccggataagattaacggcggtataataacagaaccaaaaccagctcaggctccaaatgtaaatattacaatatctgaaacagaaaatacagatcaatccgtcgctgtacagttggaaattatgtcaaataatgaaattaaaaatgtgagctatgttagagtagttcaaaaaataaatccttcgaacataatatcaaatggacatattacatcggcagactacaatacggatattaatcttttactttcagattttgaccaatatagtgaattaacaggagaaagcgaaaatgctgctgttatttatgactattatataaatgccggatatccgaatgataacgggaatacaataactattaaaaacaattcttttaaagtaaatcaaaacggtgaatatattatatgtgcagaagatataaataacaataagacatttatatatataaatattaataatataaattcaacgccaataaatacagagcaacccacagcttctcctaactatctttatgatataaaagacttgtccattctttcaatttcaggagataaacttgaaacccctccggaaaatgctagttttattgttgaaactagtgttaacaagaaaaaggacaataatacaaaggattatatattcgttgccatatatgccaagaatggaatactgctgaatcttgattatgtaaaagcaaattttgcaccaaattatgactgttcatttggctttaacatcccagcttcactaggcgaaataggggaaataaaaacgtttatttgggataaattcaattctttaaatcctcttgcggaaacaaagtccattagtttcaaataaacaagatgattgaacttaatagataacattaggatacaatatttactgtgtacttctctacaacaccataattagcaagagaagcggctaataaatacgaatattcatttttaatagaatcttcaaacatattcaaatctgtgcttgaaatataatcactcggtttaaaattaggatcaatttcaccatcattttcttttaaaagcataaaatctgcactatttttataagctgttaaattatttgttcgtatttgcgtatgtactgtatcgaagtgccaaatattatccttttcttcatcaggaatattactgccgtaaaaattaagcttattgttatctttatattttagagccagcatatcgtattccgcaccattacctattcccattatcgttggatcactttgcgggttaatatgtgtagaccatctattctgttggtcttcgtacaaatttgataactttttgccaaatggatttttttcattgaatacactaccttctaaatatgtaccatctgccatactatcagaaatttcaaaccatacttccgaatttacttccggtaatgaatcagctacccctttatgatgattttcgaaaacataagaagcatcgccttcccaattgaaattgccggaatcatagttcgccttataagccattatatttatatcagttatacccttatcaattgtaacactgccttcttcgaatcgttctttttcattaaatgaatcataatatgtatagatatcataggttccgttagaatttttagcagttaatattctataatagagcttacacaaaataaatcaatttgactattaataaaatataaatgttcatactaccagcgtctgtatgaagctttgtttgaaataaagtttagaacattgccaaccggcagatcattatcatttcagtgtacacctcccactgaaatgataaatgaaccctgtcgtcaaagagacaaaaacatctttttgactggggtataagtttagtactctttatctttacttcttataacaaaactgctcgtgtcgatctcataagttccactctcaaacatttcatagacgaccataccggagaacttatttcgttgtccgtaaacataacatttactgccatcttctgaaaattctccattatctattgttgtggtcatctgatttttaaatttatatgcagtaaaaatagcatcactcatattcatctgaataccatttctataaaactttgcaatacttgtcatccactgccacttgaacaaaagcattgtgcattcctctgtatcttttctttccaaaatctgcggttgtcctgccgttgcggcatcgcctataggcaaattcgttttacctgttaagaaatccgataattgctgttcgtatgacaaaacgccatcctcaacagtttctatgtataaagctctttcactatcgttatacgcatgccttaattccatattcggcatatggattataagatgaagtcttattgctttcctgcacttctgtatctgatatgtcctcagctacaacaagcatttttcctcccatgttttctgccgatgtttctataccattgataaatacacgtatatctgtttcataagtattcccggaaattccacctatactgcctctttcataacaaggataaaagtcttctgcaggtcttcctgttttatttacaaataatgctcgtatactatcgtcatatcctaccgtataaccatagttacgcaaatcttccgcacagatcatcattttgccatccaaatatgttacaatatctgtattatagattgtgttcttaatatcactgctgcttgcataaacgtttccttgtataatcattaatgtacttaataacatcatcattgcctttttcataacatgcatttctttcccatttttactttatcattaaagtccatttttataagtctcttaaataaccatttcgttatatgttatatatattataacaatacatttgtaatttatcaacaaaatttcaccaagtaactatacatacacataaaaataaggcgtaaacaacaaacaaaataatcaaaaacttttgattcagtattttaatgcataaaacaatgctgctaataacaaaactattccctgtttgaagcaaatttatattctgaatgcaaaagacgtatttaaaatacataagtgcctttagttttatttttactatttatttgcaaataaatcaactatatatgccttgaaaacttagaaaatcacgattgcagcttttactaaaatgacaagacaatatggctctgttggtacacaaaaagaaaaagttgacaacgactttaagccgaccatatactggatacggaacatattcttgggatcagcttataactttgcatagagagggaaccacgatatatgacacaacttttcagataatgccaaataattttattcaagcggcaacgtagcaagtcacacgaatattttcttatgggaatgaacgatgcctatgaggatggagcgtacatgcgtgatattgatactttcgtactgactaaagtgaatgtgcaaggaaaacggtttaccacccaggctattccactgccatatgtccttgatagaacaaaattttaaaatattttttatgttaggtttacattttaaattgtttcattctcttttatttatgaaaacgttttacattacacttaaaacaaaaaataaaaatttgaaaaaagaaagtttaatttatatcaacttacattgaaacatctcaatactcaaagcaatatgataacattacatccgctacatactttgtatacaataatttaggtggatatgtatataagtcatacgaaagtatttacggtgctccagctctttttaaggatcatataaaaccatatgtagaagctaataacggtgctcattattatgtacacactccatataaaagctatacttctgccagtgacagaataaacttcaactctgtatcacatagtataacagctaacataactgcatatatttcattgggtattatcgctgtaggaacaaagtatagcagttttgatataggaatgacttatgataagaagaattcatcatgggttccctgtgtgatgacacactcgaattacggatatacaactcctactccaattacggtcggtaataacgtacctcttaataatttttcaaaaaaattatccatcaactagatactgtacaacgaaaattgaagtggctcgctcaggtaatacagatactgtaacctatacataaacatacgaagatgcaggtggcaccacacttggaacgtgtaccaataaattcaattttgcagctggtgatttcttcgaagatggaacattaaaaatgagatttacacgttttatatctcttgtccccacaacaagaacaaatgataatgcaaataattcgtatctaaatgcaggcattagtaatttaaaactaaactcatcaaattgaacagctgcacaaattgactatgcatggtcagtacagggagcaaaatacttgaactaaacatctcaacactatcaggaagtgcatccaatgctgactccataaagattaagcatcagtatcagttgcattgacatcttcctttgatacaaaaattaggtatgttttaatacctcatacattatcatagatttatattttagaatcaaattttatatgcacatctaattgcattatagtataattctagactgtttaggatgcacgtggtaaaataattttaccacctgtatcctactacatttttcatttcgccatacttgttatactgttattcaatttcaagtacgcataaatccccaaaaacaagttatactctactcaagtatggatggtttttattataatataattatttaacaaccttacctatagtgttatactgtgtcatatcataagcgccacctatgtcagtataaatcaaaaaacacgaactccaatcatatgctcatgaaaattgattgatttacatggtaaagtataatataattatagtaaaatacgataacaggatgtgatttatatgaaaaaaactatactctctttcgcagttacagggttcataatgagcagcatatgtattgtggcagcgatgccaggtgatgttatacgtccaatatattctacagatatactcacatatatggacggcatcccactccaaggatatgcaatagatggaaaaaccatgatctgtcttgaggatctttcagattacggtttcagcgtgtattacaacgacgacgcacgcgcactatttgtaaataaacacagtgaagcaattaatggctttaatccggcaatagaacgcggcaaagttggagatattaccggatacacttatgaatcggatatacgagcttatataaatggacaggagatttcttcagaaaacatcaatggccgactcgcagtatgtgcagaagacttggctaatatggacactgttgtcactattcgtaatttaggttttgaatatcctgcctacttcattcgctacaattatgatgatacttctagagcattgtatcttttttcagatataacagatcataatatttacaataataatatcactgattttacaaaaggaataagcgtgtccaacggactttttactgtaatatctgaatctaaaaataactcttatacacaatatgcagtaaaaggtatataccgtgatacctctaattatgatggatgcaatgctattcgattttataagagtggtcgtactttcaatgcagaaaatgcattgaaagaatacggttttatcgcttctatcatgaaagacggcatctcaataaccgatatgagtttttcatccgatgggaaatatctctgcttttccggcgaaagaagcaaggcaatacccaattcacttatgggagtaagaagcgtatatgaatccggcgaatatatgctggatatggacacctttgctcttactaaggtgaatttgtcacaagcgttaaaatagaaagttacttcttttgcctttggcgtgttgtcaacgctctgcgctcatcaattataacaataggatttgtgtcttgaatgtaccgcatagctgtttcgccgttcagcttatcctgtgcctgatttataatattttggctctttttaaaaacatctatatttattatcataatttcaatattgctgcttgttgcaaactgctttacatcggacagctttgcggagttgtatataaaatatctgcacggcacattgtcgtattgattcataaaatgttcttttgttatttcaaatgatttatatacactttcacggattgcaaccaaatgtattttcatcttgatacacagatgaaagagaatttgcttcttcaaaaataataatatcccattttattttatcagcattttcaatatttggggttaagtattcatatatagtaaggacaattccatcatagacaaaagaatcattctcaaatgcaatacaaaatggtatactgtatttttcagaaatcatttcagcccactgaacaagtaaatcaggatttgggatagctattaagatattattttctccctcataccaactttgagaaataataaacattgctatggctttttcccatacatgcttcatcgcacagaatcacgcctttttgataagggttgcgaacagcaaatagcgcggctgcaacctaataaggatacacatcaatttttccctccgcaaataccggaagaagtgtgtcctcatttaagacacctccgaaacattgtttaatcttacaaaatattatatcaataatcaccataaatgtcaacgtatatcgttctatcgcacaaaagaatcgcacacaaatgtgattttcttatatttaagttattattgatatatacaattgaacagcggaatgctaacaggtctattaatcatgccttaacctctcgttttctatttgcttttgttttttatatatctgttcaatgtttcttatttctgatagagcacgcttacagaaatctttttgggccgacaacaggcttgtatgatagttcccccaatagtaatagtcaccgtttttacatttccatgtaacaaagctattaggcaatttggggtgaacatccagcacaatttctatttcgccaaccttaatttgatttataattaaatatcctgagtttattctttggatatccataaaatcctccactataaaagcggtatcccttaatatcatgagataccgctttaacgttcatattcctttttacgctgccgctttttataccagtcgtctaatagttttatcataacatcctctatctgcttttcagtataatcttccgggaaatactttttaaccttatcacctgccaatgttattttaatcttttccggcttctgttcctgcataatagaatctataacattgggatttagcttaccattctgtgaaaaacgccgcatttttgcagcctgtgcaatagatggtgaagcctcctccttttcgattgaatttagaacctctgcctgttcctttggtgcctaaataggataacccaacagctgcatttaaggctattttcttttcgtcaaccatttcaagtaacgggtcaattagattcgtaaggcgtatgtaacttgtaatttccataagatttactccagcttcttgagcaaattgttcccgtgctgttaactttggcacaaattgtgcagatgttaaatctgttctttcaccttgacgtttcatagcttccagcttcagccgatacgcaaaagccttttggctcggcaggatattttctctttgtaaattgctgtctaccagtaaaattgccgctgtatcatcgtcaagattttttactacaaccggaatctatgtaattcccgtaagctcacatgcttttatacgtctgtgccctgaaagaatttcatatccgccttctctatgaggtcttgcaataataggcgataataccccattttgttttatactctccataatctcctccatactttcatcaatcaataccttaaacggctgctgctcatacggctttagttctgatatgtttacagtctgtattatttctgtattgtctccatttccggtttttaatattttattctccataatagctatcacctactctctcattttttcatatcatagcgcacacgccagtcaatatatacatctgaggtgctgtatgaattaaaaatagcagctatcagatagctgcgtacatttcgtatcttcgtacagttttcattcattgccaaaagcatattgctgatatgtgtgtaatttattttcatgaaaatactttttaccacaggagccgtatactgtacatggttaatataatagctttcagccggaaaagtcagaacatccgccataatatccacaatgttgtcaattacctctttttcctcatgcagaattaatccctcatactctatatttctttttacaagctctctgtatttttcataatcctcaatcctatccattgaaaaagtttcacttgctgtattacacgatagataagattgatgatttatatactcagttttattattatcagtattgttatactcagtattattaatattagtattaattgctcgtgattttcacgattccggattcgtgctggttctccggcgttataacaaagcttttaacatatataatatcagtcttccccaatccctgacgtctccgttctatcaagcctattcctgtttccttatcaagctcattcaataattttgttgccttattatcggcacacccgaaatcctccataatattttttaaggtatagattatatataccttgttttcatcgtcaaaccatctgtttttaactgataatcccattcggtcaagcataaatccgtataatacctttgcatcggttgatagtgatttaaacgtcttatccttaaaaagaatttttggtatacggtaaaagctgtactgctccgcctgattaccatagtaataatcaaatattattttctccatgctgttccacctccttattttggtaagtcaagaccaccagtaaactggtggcttgcacagcccctataaggggctaatacaggcttaacccctgtaaggagcacagaagtttgacaccgcattactatcacaggcagccgctcacgtgcggctgtattttttgcctacttattcttgctacccgtaaacgggtttaaatactctttcatgcttatttgatccgatgcataatcctcctcaagttgattcctgatatattcggatattatttttttatttctccccactgtatcaacataatatcctctacaccaaaaatttcttgaaccatacttatatttcaaattggcgtgtctatcgaatatcattaatgaacttttccccttgagatatcccataaactgtgctatacttatatatggtgggatactaacaagcatatgtatatggtctaggcaggcttctgcttccattatttctactcctttttgtttacaaagctttcggagtatttctcctatatctcttttcaactgaccatatatttcttttctccgatatttcggtgcaaatactatgtgatattgacacctgtattttgagtgtgctgtgctctttatttcatttgtgctcttctttaacattattaaaaacctccatgatatattttttgtaatgcggtcgccaaaccatttactattatatcatggagatttttcttatgctaaagctttttatcttcctccggtagaaccgaaggtttttttccacgtctaaagaccccaacaaaaagagctaactgataaatcaaatcagttagctctatatttatggaacaatacaatttatgttgcaggtgttgccaaaacgttgccacaagatatatccagaacggtgtaacccgcactgaagcgtttctttttcttgcgagaaaaagaaatggttcaaacacctattataagtaaaataatatatattatatggggtcatatacaaagaaaatataaagtttttaaacctttattattagtgttatttatttttttcaaatgttattttaattttatgagccttagagatttttcttaaagtgtttatattatatatagtatctccagcttcataacttctaatagttctttcttttagacctatgctttcggcaaattctttttgagttagctctgtccattctcgtaatatctttattaatgatagtatataaactagaaaaaacttaatatgatttgtatattgaacactgcgtgttcagatgttggctcacctaacgcgcttgctaacacaagcctaccgaagttcactgaaaacccagcttttttatgagttaaattaaatagaatctctatttttttaattaaattaataagaactcggaaaatctttattcacggtagttcaaaaagtcaacgggaaagtaacaaggctttttcatcttgaagcgcagattcaagatgaaattagcgggggcgagcgccccttggagccgcaggcgacctaagcgagcaagcactttttctttggtgaagcgtttctttttcttgcgagaaaaagaaatggttcaaacaccttattatgtaataataaaattttttatatggggtcatatacatagtaaatataaagctttttaatcataatgtttaaatcaaattccttttgagtgagttatataaggataataattatttcaatttgttattatctttataactttctattagactgattattagttctgtatctttttcattaagcttattaattccatttattattttatgtattttttcaggatactttatattttcattaaaaaattcatatggcgttatttcaaaatatctgcatatttcaaaaaattcactcattgacggcatagcttttcctgatgatatatgatttatgtatccttctgaacgtcccatatctaaactcatacatctttctgatacattttttctcattcgcaactcagttattctttcccttataaaattttcaaacatatatattctcctaaaaattgattttttatattatttgtattatacactattttgttgtaattttagcgaaagcgtcatttagaatgacggtaacaaaaaaagtgataaattgaaagaagaaaatataaaaattgcataaattaaactattagttcaaaaacaggtatgattgactatactttaaaatatgaaaaataggaatataatctaacattacatttgatttaataagataattaaaaaaatatgtgcacgcaagcgtgcggcggcagctcacctaacgaggcgcataaatgcgccctgccgaagttcactaatagcattttaatatgaaatattttatgatagaaaacgtcgttagctgtaaatacatttaaaatttatatgtcatattaatctatatcttattgtctaaaaatattaataatattatatataatacagatttaatctgttgctttaggaagaatagtaataccccaggacatgagggacgaaatgcaaattagaaaaaaagacgaagtatctataattatgagaggtgaagaaataagaatcagaaagacagaaaatttctgtattgcatgttgcgaaaccgaaaatcttataaaataccaaaataaatatatatgtcaggactgtatagcaaatattaaaaaactatagttaagaaataaatttacaaaaccacactttattataaaaactatcatagctgaaagcgtaacaatatgataaataaaaaatctgtgacggttattgttccgtcacagattctataaaactatttatatgatgacttaacctatataacatatttgttatattaaaatataacttacttcacgtttatttcaataacctttttattgtctgtttttgacacagtgattgataaactttcatattcaaacgaatctccgttttgcggaagcctccctaactgctcagttacccagcctccaacagtagcggagtctgaactcagcttgagattgtatttcttttcaaacttgtctaaatcggtctttcccataattataacctcaccgcttgggagctgcttaaactcatcatcttcttgatataaatctcccacaagtttttcaagcaggtcggttatggttataaccccgtatgttccgccgaattcatcggttacgacagcgaaataattgtgactttttttcatattctgcaaaagtatgtcagctctgatactttcgggcacagcatacgcctttactacggctttttccattattatatcttttgtagggtttttcagtataaaatactttctggcgtctaataaccctataatattgtcaatggttttatcgcatatcggataatatgaatgttccgaagcggtgattgtttcatgccatttgtcaatatcgtctttagtccacagcacatcgagctcggttctgtgagttgctatttcgtcagcgtgcatgtcgtcaaactcaaacaggttttgtattatttcattttcttcatggtctataacgcctttttcacttccggcgtttgccatcattcttatttcgtcttccgtaatttcttcatcctccgcattcgggtcaatgcccagcagtctcaggatagagtttgttgacgcggtaagcagccatactataggcgcaaacagctttgaaatcatagatactaaaccggaaattgccagcgctatactttcagattttcgcattgccaaacgtttgggaacaagttcgccaaacacaagtgtgaaaaatgataatattattgtaatcaatactaccgaaatagtatcgagtgttttttcggaaacaggcaggtttaacttcattattgcgtttacaagcatatcggaaaagttgtcggcggcaaaggcgcttcctaaaaatcctgaaagtgttatagcgacttgtatcgtggccaaaaagcgtgccggctggtttgtcagccttgccagtctgagcgcacgcttgtcgccgtctccggccagtttatccaaacggttgccgctcattgatataaccgctatctcggcgcaggcaaatatggcgttcatggctataagcactgcttgtaaaatgatttgtcctgttaaattgctgttcaaaattaaatcctccttttttaatatagttattttgaacatataaaattttgattttctgccggtaagaacttaaaaacacaaaaggacacaaccgtatcaattataccaatacggatgtgccctatattcatattaaattaattaaattactactgtcactgtcgtcgtctgacatttatgtatattcctttccggcagattatcaagcacaatatagcatatattataaaatttgtcaataatatttttataaatttttttaaaaactagaatataaaaataatatgtactaattcaaataattataacaaaatttattgcacaggttcatatacagcgtcacatcgggtaaaatctgagaatatagtatttgtgtattctccatttaccattgaccgatagtatggtttgccgcggtataagagagaaccgtctgtttttataatatatataatcgaactccctcccgcaaagtctttaacatcatctgcgattttgaccatgtttagcacattcttttcatcactgtcggtgagaatgtgaccatattcattttctcctgctccccaaagagaaccgtcagattttaacgcataacagatattgtttgctgccttgacattgatgaatccgtctcccagcttgacaggagaggtgtagttggacatcgatgataaataatcatatgtctcgaaactgtatgtttcaatatatcctagttgtccgccgtagcttgcgccgaatccccataagcttccgtcttgctttatgtagtagtatgtattgccgtcagtcgcaactgacatagcattgtcggcacgctttaccggagctgagtagtcctttttgtctatccattcgcttcccggaccgggcgcgcttctatatgtccaaacgcttccgtcattttttagataaataacatagctttggccggaaaattgttttacatcacagtctatttttttatatccgtatccaacatcttcccaaagtgttccgtcggtatcaatgtaattttggtatgaagcggagacggcgttttcaacagtgcacacgtcttcagtctcatcatccgatgtttttatatacagtttattgtctttagccaacagccagttttcgctgtagtttccgtcaagtatatttcttcgtctgtatacggcgtttttatatgagtcagtagaaaacggtgcggtatataaattatcattttcatctattacagatatttctgaataattgtttgttccgaatctgtcaaacttgggcaaataatcgcattttgaaacatttaaatcaccgttgtttataacgctaaggtctgaaacgtttataccatacagatagctgctgtcaataacagcggaacgaataaaaccatcgcgcctgtcaatggttgaagtggttgaatcgttgactgtaggccaaaaatgatatgtgctgtatgaatgctggaatcctaaattatcaccaagctccttattgccgaatgtaatatattcgtctttagcaatataacttccgattgtgtattcctcggtaccggattcataataaaatccgttttcggtgccttcagtaaaatagcccaaatattccatgtcagaaattgtacccggaaattcagacattacgctcttatcaaatctttttcctataccgtgaggaacaccgtttttggtttgtccgtaataagtaattccgtttcccaatacaagttcggttttattttcagcggtttcaaaagcattatccaattgatactttactgtgtttaatttagcaagacggctgttgtcgtcgtattcaacataaccatatttatttaaagccgaaagctgtatcagagttttaccgtctatattacaggcttcggtaagttcgccgcttaaataagtttttatatcggttgaatatacctctgcaattttggtgtataacggaatatcagactttaaaatgtttatttcatctttgctcagcgatgttcggtcaatgctgttgtttttctcgatactcaaagttctgagttcgttgttccaatccacatcaaagccgtaaccgcgcaaatcttccgcgcatatataggtatggtcctgataattgtatgacttgattggctgctcgtcaatcaacgctccgatatctgtagtgtagacgtcgccgttcttctcaaaggctgaaacaggagcgttaacacaactgcataatagaattgttaatataataactacggatattatttttttcatattcatcaccttataattaataataaaattattataacatataaaatactgatagtcaaaattgaaagctgtatacaaaaaagactgcggcataaaccacagtcttgatttttaaattaattgagcatacaataagccgagttctgtcaatgatgattatctatctcgaacgtgtgtcgccacacgcctctagccaccaatctccgaagatgccgggccggcttagccttcgattcaggtgttgctccgagtggggtttacagcattgataagtcgccatatcaatgggtgagctcttacctcgcctttccacccttacctgttaaaaacaggcggtatatttctgttgcactgtccttagagtcgcctccacaagccgttagcttgcactctgccctatggagctcggactttcctcacggccgattaggccacgcaaccatctggtatactcaataattaactgaataaattctgcgttttacagaagtgtaacctttataaccccgtcaatatcttcaatctcttttgcgatagccgggtcaattttgccctgaaggtcaagcattgtatatgcgtagtcaccgcggctcttgttgagcatggtgtctatattaactccttttgctgcaatcaggtcagtaatatgcttcagcatattaggaacgtttttgtgagccacagtcatgcgttcgccattcttttcgcccatgtcacagttaggatagtttacgctgtttttaatatttccgttttccaaaaagtcttttatctcattagaagccataacagcacaattttcttcactttcaggagtagaagcgccgagatgcggcatgcagataaccttgtcgttattgagaaggtcggccgtagcaaagtctgttacgtaacatgaaacagttccgtcctctaaagccgcctgaatatcggttgtatcaaccaaggtgtcacgtgagaaattaagcagtcttgcaccctttttcatttttgcaaaagcctcggaattaaacatgccaattgttgacggcaaagccggaacgtggatagtaatataatccgactgagccaaaaggtcgtcaaagctggttgccttttcagcaaatctagtaaggtgccatgctgagtcaaccgagagataagggtcgtagcccacaacattcattcccaggtggtgagctgcgtttgcaaccttaacgccgattgcgccgagacctacaactccgagagtttttccgtaaatttcaggaccgacaaagtttgacttgcctttctcaaccaaagaagcggcttgatctccttcatcttttaatgtctttgcccagttgataccctgaacaacttttcttgaggacaggaggagcgagcagataacaagctctttaacagcgtttgcgttagctccgggagtgttgaaaacaacaatacccttttcgctgcacttatcaagagggatattattaactccggcgccggctctggcaacagccctcaggctttccggaagctccatatcgtgcatcttaaaacttcttaagatgataccgtcaggattttcacagtcgtcagaaatttcataattctttccaaggattccgagacccttttttgagattttgtttaatgttttaattttatacattatgaattctccttttcaaacttagtcataaagtcaaccaatgccttaacgccttcgataggcattgcgttatatatgctggctctcatgccgccaactgttctgtgacctttaagattaacgaagccctgtgcctttgattctgaaacaaattttgcattaagctcatcagaatcagtaacaaacggaacattcatcaaagaacggtcttttggaacaacagtacctctgaacatctttgagttgtcaaggaagtcataaagaatctttgccttttcaacattcttttcgtgcataaccttaacgccgcccatgtcttttatccattcatataccagaccgcaaatataaatagcgtatgtcggcggagtgttaaacatagagccgtttttagcgtgtgtttcataattaagcattgtaggagtgatgtccatagcgtttccgattaagtcgtcacgtacgacaacaacggtaacaccggcaggacccatgtttttctgagcgcccgcatacacaagaccaaacttgttaaagtcaacttcttcagataaaatacatgaagacatatcagtaacgattgtggcgtctccaaagtcgggaagcgtgttatagtgggtgccgtaaatagtgttattataagttatatgtacataatccgcgccgggagtaagcatacttttgtcaacatccggcaggtaagaaaatgtcttgtcagcgcttgaagcaatttcattggctgtaatatagcgttttgcttcagccagcgctttctttgcccactgtccggttgtcacataatcagcgaccttagacttgtttccgagattcataggaaccatggcgaactgtgttgacgcgccgccctgtaagaacaatactttgtaattgtcaggtatattcatgatttcacggaaagtagcttctgctttgtcaatgatagcttgatattcgccgctgcggtggctcatctccataacggactgaccgcttccccccatatcaagcatttcttcctgggcttttttcagcacatccagcggaagcattgacgggcctgctgaaaagttgtaaactctactcatttttttctcctccacaatatatatattcttttattatttttatattaatatttcataaattattatttggtcataggtttcaccatataattatatttataaacctcaacatctattctaagtaaaacttaactaaataattaactattacattatataactaaaaatttaaatcgtcaatatgaattcgcaatttttttaacaatccgacaattttcatcaataagccttaaacggcttccgtactggtcgtataatcaggcggtttaacagccgcaatattattgacattgaaatactaaaatgttatacttgacagtaattaacggttgacaataagggtgatgaatatggcggaaataaatggttttgtgcatttgcatacgcatacggcctacagccttttggacggagaaggcacggttgaaaaggtgcttgaccgagctaaagagcttggacaggaagcaatggcaataactgaccatggaaatatgtatggtgttattgagttttacgagtatgcaaaaaaaattggggtaaagcctattttgggctgtgaggtttatgttgccgccagaactaggtttgacaaaacctatgagcttgattcggagcggtatcatcttattttacttgccgaaagtaacaccggttataaaaatttgatgaaaattgtgtctatgggttttatagatggattttattataagcccagaatagatatggagctgctgagagagtacagcgaaggaattatagctcttagcggctgtatgtttggagtgctttcgagaaagattcttgccggcaattatggagcggctatagagacagcgaaagagtttattgatatttttggcagagatagattttttgttgaggttcaggaccatggtctttatgatcagaaaaaacttaatgtcggcttgataaaacttgccggagaactggagcttgacatagtctgcactaatgatattcattatgtgaaaaaagaagacgccgagtatcaggacgtgttaatgtgcgttcagatgggaaaaacagtcgatgatgataaacggatgaagatgtctacttctgaactttatgttaagtcagaggatgagatgaacgaactgttttcatacattcctaaagcaatacaaaacactgctgaaattgctgagagatgcaatgtggagatagagtttggaaaactgcatttacctgagtttgatgtgcccgagggttatagcgcgtatgaatatttaacaaaattatgtctggacggatataagaaaagatatccaaaagaggcagcagatagagacagtcaggtatacagacggcttgaatatgaacttgagactattaaaacaatgggctatgtagattattttctgatagtctgggactttataaaatacgcaagagataatgatataatggtaggccccggaagaggaagcgccgcaggaagcgttgtggcttactgccttgaaataactaacgttgacccgattaaatatgatttgatttttgaacggtttttgaatcccgaaagggtcagtatgccggatattgatattgacttctgctatgagcggagacaggaagtgattgactatgtcaaccgcaagtacggaagcgacagagtgtgtcagataataacgttcggaactttggcggcaaggcaggctatcagagatgttgggcgtgctctgaatatgtcgtatgcgtccgtggacagcgttgctaagcaaataccgtttgaactgcatatgaccttgaaaaaggcgcttatcttaaatccaaagctaaagcagatgtatgacggcgacgaaagtataaaaaagcttatcgacactgcaaaggcgcttgagggtctgccgagacatgcgtccacccatgcggcgggcgtggttattacaaaggagccggtgtataattatgttccgcttcaaaaaaatgaagatgttataacaacacagtttacgatgacaactattgagagactgggactgctgaaaatggattttttgggtctcaggacgttgactgtaatacgtgacgcagctgatatggctgaaaaatcatatgggataaaactgaatatgaactctgttccgctggacgacgaagaggtctataaaatgatttcaaaaggtgacagcgatggggtgttccagcttgaaagcacaggaatgaagcggtttatgaccgaacttaaacccacaaatcttgaggatattatcgccgggatttctctttaccgtccgggacctatggagtctattccgcggtatgtcgataataaaaacaatcatggcagtgtcacctataaacatccaatgcttgagcctatactaaacgtaacttatggctgtatagtttatcaggagcaggttatgcagattgttagggagcttggcggatattcgctgggcagagcggatttggttcgacgggctatgtctaagaaaaaagctgatgttatggctgaggagaagcataacttcgtttatgggattgatgacggtgaaagcaaggttgacggagctataaagcgtggaatagatgaggagacggcagtttctatctttgatgagatgatggattttgcgtcatatgcttttaataagtcccacgccgcggcatatgcagttgtggcatatcagaccgcctggctgaaatgtcattatccggctgaattttttgcagcccttatgaattcgtttattgacagcggcgacagaatagctaaatatatactgatagcaaaaaagaacggtcttgatataattcctccggatataaacaaaagcggaagaaaatttaccgttgtcaacggaagtatagtttttggtttgggagcaataaaaaacgttggcgatggggttgtggctgctatagagtcagagcgtctaatgaacggagagtttggctcttttactgatttttgccgcagaatgtcagggaagaagctgaataaaagagtggttgagaatcttatacaaagcggagcctttgacagtttgaagataaaaagaagcgttttgttatatgaatatgagacactgatagacaagctggcggcgtctgcaaagaatgagcttcccggtcagataagtctgtttgatatagaaagcgaagaagacgggcaggaagaaactgttgaggcagataattttgaggatagacatgaactgcctatagaacagctgctagccatggaaaaagagagtatcggtatgtatgtgtccgggcatcctcttgacgaatacagggagtttcagttcagcggcagagtatcgccaatattaaatattttggaggatgaagagcataaatttcttcccggaagtcagaccgcagtgtttggtattataacaagcgtcagagttaggcggacaaagcggaatgatataatgaagtatattgttattgaggatttgacaggaagtattgaatgtttggtttttccgaccctggtgcaaaagtatgacgacatgttggataaggacagtaaaattattgtcagaggagatttggatataagtgaagactcggcgcctaaagtcagggttcagagtattgaaagactgcttccggcggaaaatttgaaagagagaaaatacagtgaaagcaagttatatataaaattaaaatcaaacgacagacaagctcttggtgatgttaaaaatatactgtcaggcacgggcggcaatattgaagttataatatattttgaagatacaaaaaagacgttaaaggcgccggacagtatgaaggtgagtcctgaaagcgaaaagataagaatacttaaaaatatgctcggcgaagataacgtgaagcttgtaaataagtcataaatgtaaaatctatctatatgaactaaggtgaaaattttggaaaaaagaaatacaaaagcagaggttcttgaaatacttttaaattctggagaaacgcccgtatcaggggaacgtttggcggaaaatttgggaatatcaagaaatgcggtttggaaagctgtgaccgctcttaaagaagagggatataatatatccgcaaaaaggaactcaggttatattttgaataaaagcaatgtgctgtcggtaattgaaataaaaaaacacttaaataatcctaagattgctgatagtatagaaattcaccgattggtcagctcgactaataacgtagctaaagaatatgctttaaatgataaaactactgatgtgcgtatatttatttctgaggagcagagcggaggaaaagggagacggggcagaagtttttattcgcctcctggatcaggcatatatataagcttcctgtttcaccctcagataaaggctgtagacgccgtacggcttacaactgtcacatcggttgcggtatcgaaggctatagaaaaatccactgggctggaacctcagataaaatgggtaaatgatgtgttttttaatggcaaaaaaatatgcggcatattgaccgaagcgctgaccgaccttgagacaggtatggtagacagcgtgattattggcataggagttaatgtgtttggcggcggatttcctgaggagctcgccaaagtcgcaggagccttgtctgattctgaggactgcacggacattgacagaaatgtgattgccgccgaaattattaatcagatgttggattttgtccgttgtgacgacggtgattgtgtaatcaaagattatattgaagattataaaagtcgttctatggtacttggtgaaagaataaaaatattaaacacgggagagtttgcattagttcaagatataaacgaaagcggtgctttggttctaaagctggacagcagcgaaaccaggattttggacagcggagaagtaagtataagggtcagcggaacagaaaaatgaggttattttatgaagaaaatcggaacggcagtattgttatttttggttttgctcgcttgttttcctatttgcggatacgcgatagagtttgatatggatgagatatgcgattctgtagtggttgttcactctatgaattcagttggaacagggtttgctatctcaaaggataagatagtgacaaaccagcatgttgtgagtactacaacaacttatacaatcgagacaagggacggaggtttgtacaacggccggcttatagcttctgatgaggctaaagacttgagcctgatagaggttttgggaggcaatcttccgacaatacctatgactgaggatattccgcctttgggcaccgacgtatacgctgtaggctctccgcagggaatgggatttacggtaagccgaggtatcttatcaacaacagacaggcagttaaacggagtgcattatattcagacagacgcggctataaatcccggaaacagcggtggtcctctgctcaatcaaaaaggtcaggttattggtgtcaataatatgaaggttgaagacgctgaccgtatatctctggcgatacccatgagttcagttgtgacgtttttggagaacaacggaataaacgttcagctttctgatactcctgacgctgagcttgaggctccgggcagtgtagtgatacaaagttctgccgtatcgggcgggattgaacagtcatatgaacagtattcaaacagtttgagaaatcagtatactaaaatattagagacggttcaaaatgaaaataaaatacttgttttaggactaattattattgcggttctttgttttgtatttatgcttgtcatgctttcacaaaaggaaaaattgaaacgttctgaggataactttaaaagagcgatagaagcgctgaaaaagcagggaatgcagatgaaaatgatgcagagaatcagatttacaaatcaaagtagagaaagtgaaaccggtacaaattcagcgtctgatagaaactgcggtgaatatcaaactgtacctgaaagccggagtgcgtttgtatcaagaatgccgagaaaacgttcggaggaacagcagaaaaagtatagaaagaggctgtattagaaattatgataaataaaggtcaaaaaaggtttttagaatgtgagagattgattatatttattggtctaatgggcgttggaggtttcctgggggcgtatacttactcaatccgcggcggagtgttctgcaatgctcaaacggctaattttgtattgctggctatggcgatcggaaaatgggatttgagcggtgcggcatatttgctgatacctatttctgcatattttttaggagccgtactctcagaggcgctgccgattcatgttaaaaagtttggtttggttcgctgggatactctgcttgtaggtatagaggttttagtaacatttatgcttggtctgcttcctgaaaccgctccatatcagataacgcaggtagctgtaaactttatctgttctatgcagtataatacgtttaggcaggcggagggaacgcctatgtcgacaactttctgtacaaaccatttaagacaggttggtataaattttgtcaaatggctgaggaagggaaagtcggatagtttgggcagaagtgttaagcatttgtgtatgttaggaacctttgtgctttttggtataatttctactgttttatgcagattattcttaggcaaagccatatggggagccacaataatcttgctaatcgtatttttggacctgcttcatgccgacttaacctgcgagcatgatttgcttagtgaaaaaccgttgggacattgattgttaacagtatgttcattgaaattttgttattaatgtgatattattattttgtttggtgatagagttagaaagagatggtgtgtatatgaatttatctgatgataataaaaatgagattgaatcttcgcaaatgagcggagttttagatgaggtcgatcagaataaaactgacagcgttcaaaatttatgcggtatagcaaaaaagacgtctataggcggacaggctgtgattgagggagttatgatgagaggtcccgaaaaaattgctactgcggtaaggaagcctgacggagaaatagttgttgatgaacagcctcttggaaaaggcagaaaaagcaagtttgtaaaattgcctattatccgtgggtgcgttaatttttttgactcaatgattgttggcgtaaaatcacttatgttttcggctaagttttttgacgtggatgacgatggaaacgaagtcgagcaggagccgggaaagtttgaggcctggctggagaaaaagctggattcagaaaaagcaatgaatgttataatctattgttctgttatcttttccatgtttttatcaataggtttgtttattttgctgccgacattgatagctggttttttgactgattttatgcaggtgcataataatacggttttgacccttatagagggtattgtaagaattgctatttttatagtttacttatcattggttgcacagatgaaagatataaaacgtgtgtttatgtatcatggtgcagaacataaatctatattttgctatgaaagcggactgccgctgacggttgataatgttcgtattcaatcaagactgcacccgcgctgcggcaccagctttttgctgatagttatggtgataagtatattggtgttttcaattataccgtggcagcaggaaagctttactcatatccctgtgattggtgtaatgttttcagctatgccgtgggcaatttggagacttatattgagactgctattactcccaatagtagccggaatttcttatgaaattataaagtttgcgggacggcatgacaattggtttacccgcgctataagcgctcctggaatgtggtttcagcttataactaccaatgagccagaggatgaccagatagaggttgctataaggtcgctgaaagctgtgataccggaggataagactgcggatgtgtggtaaaggctgactcacatagttaggcagaaggtgattttatgacattaaaggaattgcgcagaaacgcgcataatagattaaaagaacaacccaatatatcatctcccgagcttgatgcggatttgataattatgttcgttttggatttaaaaaaggatgaattattaactaaggatatatctgtgccggacgcgctggctatagaggtgaacgcgtatttgaaccgcagactggcaggtatgccggtgcagtatatagttggaaaaactgagtttatgtcccttgattttatcgttaacaaaaatgttttgataccgagacaggatacagagattttagtagaaacagtgattgagagatataagaacgtatctgagcaaatcaggattttggatataggaagcggcagcggatgtgttggaatcagtatggcaagatatttgccaaactccgttgtgacagaacttgatatatcagaagaggcgcttaaagttgctgagctgaatgctgaaaaaaatttggtgacaaagcaaatgaattttgtctgccgtgatatttgtgatggaatttcggatttagagccaaaatttgatgtgatagtttcaaatccgccgtatattaagacggatgatttacttgagcttcagcaggaggttatagaatacgagcctgttgccgcattagacggcggagatgacggtcttgatttttaccgtattataattaaaaaagcagttcctaaaaaaggcggaatgacagcgtttgaagttggtataggtcaagccggtgacgtcgccggtttaatgtttaaggcgggatataggaatatagatattattcctgatttagccggaatagaacgggtagttttgggatatgcggcttaaaaatacgtgttaaaataatatttagcaatgattatattatgaaaatttttaaaaaagtatttgctatttagcatgattcggtttcgtctaataatatgggcggaaccgttttttgttatgtagaaaattattacgaaactgtctctgtaatttttagttataagcaacatctaaacgttgtctataattaaaaaagattttgagaaacgtttctgccaacagatataaaattaatgaaaagtaaaaaggccccgagagacttagcacgataatatcagaaaaattgttaaacttattttggaaaataaaaaaatttagtggaaatttacagtaatcaacagttgtgataatgtgatgttattatagcaaagaaaccgatattgtgaaaattattgtaaacgacagtaaaaaagttgaaaagagagaaaatataaaacactgcaggtaataattgtgaaaattgtaggtttttattaaaaattaaaacggttttaaaaaataatatagaattgatatttaataaatgcgttgatgtcaaattaaaaagggttcgattgaaccctttttaattaataagtttaaaattatttgaattttttataggaaagtataaattacaatatatctactaaatccaatgattttaagaaatgtagcatttaccttaaatcaataaagctgtcttccgtttcaatcaatgattagaatactatttcattttatttttgtaataactgagcaatcgatttagtattgcttctcaaatatctggataaacaatataatgaatccgggttaccttgtgttatatagttatctttttgaagacagctaagagtggctctgtatcccagctcttttaatatcgcctcggaatttttgcacatctcaccgtatggataagcatatgtcactggtgtgatgtcgcagttatcttttagcagctgttggtttttttctgtgtcggctataaatttttccctgtatgtttcgtcagactcgccgtttttttgccccacgccttttctgttgtctttattgtttttatcacccggaagcatgtgcatattatagctgtgattgcctatttcaagcctgtcgttgtccacaagctcttttatattgtcccaggtaagatacgcatattcaggattgctgtcgtcaatactggaaaacttttcagcatattgaccgacgattgaaacgaccgccttcatatcatatttttcaagaagaggaagaccgtattctaaattattttcaaacccatcgtcaaaagttaaaactattggcttttcaggcaaagcttcattcccgtcgacgtaatttataacatcttccatcaaaacagtagtgtatccgttttctttcaaatattttaaatcttcttcaaatgaagagataggaataacgtaagcgtttactttagatgggttcttggtcaatccatggtacataattataggcagttcaactgatgtgcggtcatcttcagaaaaactttcggcgaaaccaaattgtgaatcattatttttcaaagatgagaatcccactattccgactacaactgaaataataaatataactgaaaaaaataccagcgtcttcagtctgacaacaaacataaaaaatcacctcatatatagatagtattagaggtgattgtattttattcagatttttaatgtcaaataatggaattttggacaaacgtattaaatattaatattttacttcatattcataaggagccatcagcggctgcatgttatcgtcccatataaatacccttattaatgagcgcaaacctgtcttatctacaggcagaacaagcgatggaagagtcttatgaccgcttgccggaatttcaacgtcgtttttaactattgaacctgtcacatgttcaaccaattcaccatcagcgtcgctggattccgtgtatgaaactacatagcagtctacaaatttatttttatcggtatcattataaagctgaatagaactctttaatgaatttaaatcagcgtcaaataccaaaggatatatttcggtgtgcaattcgggtgagcttacaggggcagaggtaggagccggggcaaaacttggacttaaagtttcaattatattttgtatattgagagctccgtatccatattcaggattcttgccgtcgtcgcctagatggtctgaagtttcagctattaattcaagaaattctgcgggggtaatatccttattaaaatattttgctattgctgcggccgcagtcacatgaggtgtagcgtatgatgtgccggtaccgcgggaataggaatgtatcagattgtttttaccgtctttagtcaaagaactgctgtaaatactttcaccgggagccataacatctacagaagtgttatattggctgtgtgaagccctctttttggaatatgtaagcgaaccaactccgattacattatcatagccggcaggatattttattttagtagctatttccgtttctttatttccgtcatttccgaccgcagcaactactatgatattttttgacacggcatgttcaatagcatatttaaaagattctatatagctgtcaaatgtcaggcttaagtttattacatcgcattcgtaaacatccacagcatcataaaaggctttaataactttagcgctgtcagtttttttctctgtaaacactttgaagggtataacagtggaatttggaagaataccggcagttcccataaggttatttgtgtcagaggctaatattccggatataaatgtcgagtgcccatatgtatcataaattccggttccggtgtagtcaactccgggcgcaatattttgagttatgtcaggatgtctgtcaggtgacccgctgtctattattcctattttaatgttttttgtatccaatccatattgccaccagtatggcgactttatcatttccatattccattgattataatagtatgtatcatttggctgagtgaatgaactgagactgtttaaaactgcaatatttgaattgtttgattcagaaagaacgttgatatcagttatttcctcgttgtccggcagcgagatgatataattaggctctatatactcaacgttttggtcttggatcaggctgtctataaactcttcggattcatttgtaactgtgtatatattctcatcttttactataggtgagagctgattgacgtcactttcttcagccagcattacgggagctgatttgaactttactatgtatccatcgtaagacgtgcagtcttctgcaaaacatacagtttgaaatacaattatcagcaggcatgtaagaacagccgaatataatattttgttaaaaaatattttcataagcaggcacctcaaaatttgtaaactttcttatgtatttgtaatattttgatgtaaaaccaattgcaaaaattataacatatatttttttcaaattcaattattttcataaatatataataggaaatttcggggaatttaggcttataaactattagattgagttttatttgccaacgaaagagaagatacacgaaccacactttcattggaggaaggatacttgatagcatcgactaaattaaaaaatttaaaacatggatagtcaacactaatttagacaacttatttaaggttagtaagccgatattctttcggggtcatatagcccagtgatgagtgaatcttgtgattgttaaaccagtttacataatccgataattcataataaccatttttgcaaagctccgccttgatttttcgggttccataattattccgactttgccggaattttcccgaatttctgttgtcaaaccattttattttggtatttgtggatactcatcactaatttaaatactcaaaaaataatttgtatactcaatgcaaacgtagtttgccgcgtaaggcgagcagctgcggaaaagtattatgacgaattgttaattttagaagaatgctgttgtattaaaacagaataatgaaaattatttattttctaataatataagaaataaaaaataggacttcattattatttgaagtcctatttttatgtactgtactatcacataatctacatctgttttttataacagcctatttctattgttcagtatgctgtttttatcgtataaatgtaattgtctttatagttttgcgtaatattaaaaatttattaatatattcccagctgtccaacgttattattaccgaatacccatatgttgttgtccttatctttagcgatagtaaaatcgaatccgccgtctatcttgacaatatttctcaaaccggcaataagagtgggagtaagagcggtattttgtattcctattccaagctgacctttgctgttgcttccgaaaccgtaggtgctttcaccgtcggtatagaagctgtggttatagccggcgcctatgactgcagcggtttttccggttgacgtcggaacgtttctgcttaccttatcacccaggcccagctgtcctacagagttgtatccccatgtaaacagctcgtctgatgtggatactgcgagcatatgactgttgccggcagtaatgtccttatagctgcccgtgattgcggtgggtgttgaagtgctgtcgttggttccgctgcccaactgtccgctttcattattgccccaggtgtaaactgtttcgcctgagagagccgccataaatttctctccgcatgtaacttttgatacgttgctgagacctgttaccggcgcaggaacgtttgctgcgcttgttccgcggtcacctaacttgccgtctgtgttgctgccccatgtccagagagttccgtcgctctttatagcggcactgaatccggtgcctgccgctatatccgttatattgttcaggcctgaaatttttgaaggcacatacactttgcctttatatgcaccatgaacttcaccgctggaattgttgccccagccccatacttctccgtttacatcaagagccagtacgtggtgtttgcctttggcaattttaacgatttcaggaagaccttcaactttcagcggcgtatattgattcagctttacctgtccctgacccaggtcatagtatgcgccgtctccccatacatagacttcgccgttatatgttaaaccgacagcggtttcacgttcagcggcaatgtctttaaatttcatggacataatttgtgacggaaataatagctgtgttatattttgcccattagtgtaagtgaaattattgagtttagatttataaaacatctgtccgtttttgtctgagaatacccggcaaatggggataaccgcgtatgtatcattatatacaaccgctggactgttgctgttattttcattgatgtaatcatacagctgatatgacgctgaaccgttgtagtcaacctttacggcaagatatttttcgctttttgcgttataatcgaagattccggcgacctcacggtatacgaaagttttgcccggcacagtatatttggtgtttttacaagttacatcaacgctttcaagggtaaattcacagctgggataatagatttcttcatccatccagtatttttcccattcaatttttgtttcccaccacgaatcttttccaggataaacgattccgtcatttggataatagatattgttttcaaaccaaagctgtgaaactataaggttatagtttgaatcatatttaaaatcaaagacaggaataagaattccgtcgttgttataaatcggtccttttgtttcgcggtctgcccatggcgcatatattccatactccgcagtgccgttgtttttaatttgcaccccgagagaatagtcccgctcaggtctgagaggcggagcagaaagtgccggtctcaaatttattgtttcggacggaacattgtaataattaccatttgcatatacttgtatgctgtcaattttaaaagcggcattcagattattatcagggtcataggttacgctgttattccaccaggtatagttaggaacaataagcttagcgctgtctgaaaacaattgtccgttttggtcggaataaacatctgcaatccaaataagcgcataatcatcaaaatatgcaatatctttgttatcctgccccatttcaagctggcggtctcccgggtcaagatagtattctgcggaaccgtcatagttaacttttgcgcagagctcgtatctgctgtttatctcatagtcataatttgcttcgataacatcatatttcaatgtttttgccgggacagtataagttttgtttttgcatataacgttaacgctttcaatgttaaatctgcacttttgaaaatacggttcattttcatctataccggtatattgtctccattctatggatgttgtccaccactcaagctttccgggattcacaaccccatcgtttgcggtcccgtccgccgttgaaagaaggtttgtcagatcaaggcggcctccgctggaaactttatcatattcggacgaagtgtatacagaagataagattatatcttttaattctgcgccccttaagctcggattatatccttttaacagggcggcagcccccgcaacacatggagcagccatagaagttccgcttaaatatttatattctccgccgggaacagtgctgtaaatacctgtgccgggagcggcaatatcgactgatacaacaccatagttggaggtgctgtttaaagaaccgctctcatcaaaattagctacagatattatgttttcacattcaaagccggatggataattcggaactacgtcagtgtcaactccttcatttccagcggcgaaaactaatagtcccgggaatctttcaatagctgttttttgggcaaggctgcttgaagttcctccgaaacttccgtttattatatcaaaatgattatctgtggcatagttaatggctttaataactgccgctgagctgattctcctttcatcaatccctacgttcagagcggcaatttttgttttccaggcaaccccggttacgccgattccattgtttccggcggcagcgatgatgccggccacatgtgagccgtgataggcaatatccattgggtcgttatgattgaaagtgaaattccagccgttaatatcgtctatatatccgttatgatcatcatcaacaccattgccgggaatctcgtcttcatttacccacatattgggagccaaatcaggatgattataatcaacgccgccgtcgataacgccgacaacaacatctgaacttccggtaaatttatcccatgctatcggtgcgtttattctttccattccccacagttcattgtaaaactcgtcgttaggtatggtatcatagaaatattgtatgtagtcgggttccgcccatagaacgtcttcatttgcttgaagctgcttaatggcgtcaaaaacaccttgttcggattgattatttaattcaataaggaatatatcaccgggcgagtctgctgtatcatcacttaaagtcattatttcgtcttcttcagacgcgggtgaaatcagctcaatatccgctatatcaatgttgtcaaaaatagagctgtttaatactgcggttttactatcaactgaaaacggcgctttatatttgccggcggaattttgtttcagagtgacaataactttgccgggcagaatatcatcacaggttccggcggaatccggcggaatctcatcatttaagccggcgttattgttttcttccagtatcgggctttccgcagttggaacagaaggatctgccgtctgaacggaagtttcggcagttaaaatattgtcttctgccgttggaattggggatttaccaatggagctatcaatggttgtttcttcctgcggaatagcttcttcagcaaaagagttaataggtaaaataacagtgctgagcagcagggctgccgctaaaagtaaacttagattctttcgtacttttttcatttgtacattctccttttaatttttattgataattcaaatattacaaaatattgtcaaatattgaattaccataaaaatcatatcatattattaatttaaatacaatgttgaattatagataaatatattaataaattattggtaaatattaataaaagtattatacaaaagtattatataatatgaaatgtgcgatgtgtttcatactattgcatataaaagtataaacgtaaatataaatatatatttataaaaaacgaataacggaagagtgttatacatcacgataaaatagatattgtaaaatattaatcaaaagagaaatattataagaaaagtgtatagaaattcatataagatatatactgcggctccgattataaaagttttgttgtaataaaataatactgtatgatttaataggtagaaaataatgtaataaaaataatttttatatttaaagaactaaaatttaaaggtgataaacaaattgaatttatgtatcaaaattttatccatattataataagacagattgttttaagttggcaaggctgggttaagcataatttctattatcttaatgctgcactatagccgtacctgaaacaacatcattttcgattatgatatcatatgtatatggatctatatagccgtctccaatatagtattctaatcttttgccgctgtaatatgaaacatttgacggatgaccaagaaaatcaattacttccgtttcggtttttccaaaaaactggtattgtttttcgagatcttcaatcatataaattctaagatttgcattgttatcccaattttgtctgctgtatgctgaaacagaatttttaactatattgtaagcccctgcgttaataagtgctgcagaaagaatgcaaaatatcaaaattaaaggtattgtccggcttatttttaatttttttctgaacaatatcggtaatataacagcgcatatatataaggtaaaaaatgaatatattaatattccgttttcaaaattttgaactatactattaaatcgaatgaaaacaaaagttgttaataaaataccgccgctgatgattattaataatataaatgataaatattttaatatttttgaattcatttttcacaccccgaaacaattatatcatatataaaaataaaatcaaataattgacgctattttaatatagcgtgcaggctgtgaattggacataagtgctttgacagtcttatatatacaaattaatacttattttttaaacaaaaatcttagaaaattaaagatagttttatgagaattaaaaataatctaagtataatcttagggcaataaaaaattttaaatggtttataaaataatcaaatatttcatattgcacgttttatatacagccattataaaaaataatcataatttaattataagtattacaattaaataaaaacgaaataaaagcggttaaagtgaacaacggtagtgcagatgaaatctgcatcgtgaggtgagccctgccctgccttgaaaaggcggtacgataattcacaataattcaccaatgtttaagcaaacatagacctttattgcacgtcttcatatataacgattcaaaaaatattatcaaatataataacccaaaattctaaataaaaatttataagaaaatatttttataaaaatcataaaaagccgcaaacagcgattaaatcagcgcttgcggcttttgtgtcgaatagaaataattggataaaacggttgttttggtgacaaaatggtaataaaacttcaaaataaattataacaacttattatagagttatatagagttattttttaaatacaaataaatattcgtgtgcaatcaataaaaaattatattttatactattggttttccaataccccgtggccttgcaattatgctgctcttttataataagttcttttaatttgaagcctgcattttcaaagatacgcattacatcaaaagacattggtatcatatgacctttttgtcttgtatctcccataagcacagcacaaaacttgtcctttttaagtatacgataactttctgttgcgacctttttcatttctttgagaaagtcttttacttttagttgtgataaatcttcctctatgccatcgctatacttgataatattagcatatggtgggtgagtgcatatcaagtcaatactgtcatcaggcaaaaaatcaagttttcttgcatcaccttttttgatatatacttttccctttgcagtcttgtaatcaaaagccgtcttttctctacatcgctggagtgcaacatcatttacatctactccaattatatcacgatttaatagttttgcttctacaagagtagtgccgcctccagcaaactgatctaaaaccaaatcgccctcttgggaatatcttaatataatatttcttggtatgtacggcgaccaattgccacgccatttcgcatcgtgagttgcccaatctccacgttgcggaaaagaccaatgtgttgtcatttcaagctcaaaatcttcaggctcccatttttttattttcttttccgccattatttaaaaacctcattgattataccattttctaaatctttgatgttataaatatactccataacatcaaaagtttcttcaagattgtttcttgcacttgtccaaccttttccgtctgtaaaccaaacaaatgtaaaaccgtttattgtatcggcttccatagcaagtgttttgtaacttcgagctgtttcatttagtttagaaccgttactaccataaaaattagtttctataccataaatcatattttctgttttgataacgaaatcgaagcgtttttccatctttccctgatttgaaatagctgataagtcaatattccatttttcagtaatttgatggatatatatttccttgaaatatgttttatctttagtaaaaccggctttctttataaagctctcgatcaagttttccatcaaatgaccaccacgattttttctgccattggagtcaagtccagtttcaactcctgttacataatcaacaatgttatttataatatgattagccattaaatcaaacaatcctgttttacgcataaatactttatactgttctgccgacatatttggtttcttaaacttatatgtaaattctccgtcactgtcaatagcataaatttcatttgatctaaccgctaaaagtaacggaatacattttaatatttcgggatatttttcaattaacgcttcaaaatcagcttcgatattctttgagcctataagggagtttaatatattaagctcaacttttatactctcaacatttctgtgtaccttttcaaaatcaatatagtatttataatctgcaatactatcacgaaaatcggataaccaagttgtaaaatctctgtttctcatattagaaactccttaaaaatttgatattaatagttcttttatttttcctcttgatttgccattacaatttatcatacgagtagcttcaactcttttaattgtatgtgcagagtaaatgttgtcaaaaaaatcgtcatctgtattagtatttttgggatctgaattactcacaacgattttagcaccttttttgtgcatacacttcacaaattcagcaagctgaatttgtgcttcgtcattaaataaattttctgtatatgccgtaaaacttgccgtttcggttaaaggtctgtatggaggatcaaaatatacaaaagtatgcttatctataaattcagcggactttcgataatctccgcatataattcttacattttgcagtttttccgatactgtacgaagatttttttcatcacagataaggggatttttatacgctcccataggtacattaaaaagtccttttttattaaccctgtagagtccattgaagcaagttttattaagaaatatcatcaatgctgctttttcgatattttcatcttcactgccatttattttcaaatcgttaaatttttctctttttgatatatagtatgactttctattttcagtttcaagaggcacatattcgctttgatatttattaagaaactctagcagttctttaatatgctctcttataataacataagtatttattagttccgtatttatatcactgatatatatttcacttaaattgtatttgcttaaaatatcaaaaagcaccgcaccgccacctacaaatggttcggcgtattttgtaataacaccattatcaaaaggataataactttctatttcttttaacaactgccctttgccgcctgcccatttaagaaaaggcttaacatttttctcatttgttttattattatatcttgcgcttctttcatcaacaggcttttcagcatttattggtataagccacatgttgcctaacatttgcacattttttattctattttcagagcaaagaacagccactcgtctttgagatataccccacttatcggcggcttcttttgcagacataacttccatatctagacactccttgtttattataaataatattatattctaaaactagaacaaaagcaatattgtttttgcgttttctcagttttgtacaaaaatataaattttatttaatagcaagcacagcaaatgagtacccgtttgcgaaaaatatgttttgcacaaaaagaacagataagtcaagagcgggcgtagcttgtatatttactcttgacttatctgttctttcattcaatatgtcagttgagggggaattaattccttactttgacttaatcccctttattccaaaattcagtttaaaatgtttaattttgataaaatgttaattcatatttaatttatttttttgtgtcttaaaattaaaaaatcatcaaaaacgcacatttatacagcatatttttagaagtatagtctttttgctttttatataaatttgattacaaataaaatgttttttatatctgtcatggtgataaaatggtgacaagcattacaaaatcaatttatataaacttataacaaaaaaattatattatttttaaaaacctttattttacgctattttaaacaatatcatataataacttataaaaagtaatattaaattatgggtcataaaaaaatatttaaaacgaaataaaagcggttaaagcgaacaacggcagtgcagatgaaatctgcatcgggaggtgagccctgccccgccttgaaaaggcggtacgataattcacaataattcaccaatacctaaatcaatataaactgttatcgcacatcttacagaagagtgtcaagccttaccacgattgaccaaatactttaactttcaatatacactatttaaaactttgaataaagtcacgaaaattataatatactgctttttcaagaaatgttatagaatgattatgattaaaactctttagatgtataagctttttttctgattcttcattatcaagccctgtaacctccataagttttttctgagtattaatgtttgtatcatacaaaacgcagtcgggcgccagcaaggctgaagcaaaaatgttagcgaacatttccatgtcgcttggctcagctttatcactgcggttccaaactgtgacgccgtccatacatgctaaattttctgtttcaaggtgccccatagctatatgtccaagttcatgcgaaattgttaaatgacgtctttctgttttatcggaattaaaaaaagtataatatgaatcattgattattgctgtaaaaccgtcgttaatcataaaattttcaagacgcaggctaactattaaattttcaaatattttatagctgccgagccgaactttcattaaactgcaaagtcgtgatatattgataggcagtttagaaattttataacggtataaaatttcaagagctttttgatatgcagttcttttattatcataataatcaaagtatttgtccactgataacacctcataggttattatcagctttcatacattaattattactttgtttaaggatttaaagtattaaaatttttcaggtgatataaattcttgtatagattctgtctgccagttagttttaaggcggctgacaaaaggtgaaaattgttcgcgaacttttatttccagcggctgtttataaaacatattccgtttgtataattcttcaatccgctgagcgcgtttttctgcataaatatatggcagacggcacacttccataatttcttcaggagtgtggaggttgagttctttaagaacacatgcgggagacattatgcggattgcaaacatatccgcttctttttcaagctgagaattcatattctttttgtttgtgtaaagaattttaccgttattgctttcaatcctcgttttatgccccaataagatatgtgcaagctcgtgaagaataacaaaatttatatttgcatacgaacggtaatcgtttttgtaaaatataaaccagtttttgtcgaataacatacaaaaaccctcttcatcaacagttcgtccttgctgaccgattattgagattatctccggaagttcttcatatgacttaatttgtatgtttagctgttcgcagattttaaaaacatcaattggcagctcgcatatattgaagtcaatcagaaacttccatgaagcattacgaacatttctgtatagaccataagaattattcattttttgcaccgtcatttttgtcaaactgttcaggcatagccagtctcagcatttctctgactctttgcagctgttcggaagtcaggtcgattttttcattgtttccttcaaagctgaatattaatccgttgtcattttttgactcggaagactcagaggcgggaggttctgactttccaagcagataatcggtagtgacgttaaaatactccgcaagtctttttatattatctaaattaggttcggtatttccattttcatatttgacataagttgttctgtcgacaccaagaaaatcggcgacttccttctgtgttttcttcatagaaattctcaattcttttaacacggtcatttttatcacctctaccctattataagtgaatattaatcacctttcaaggcggtgtgcaataaatccacttatttccaaaaaaactattgacaagtgcaaaaatttcacttataataagggtgtgaataaattgcacgatagaggtgataaatttgaacagtataaaatcttttagagaaaagctgggtttaacgcagcaggaacttgccgacgctctttcaatagaaagatctactgttacaaaatgggagaccggcatggcaatgccgcgggcgagtaaactcccggatattgctgaaattttgcattgtcaaatcaatgacttatatgttacaatagaagaagcgaaagataaagcaggtgcgtgacagtggatttggatgtttttattgaacccagtgaagacggggaaagtgcttaaaagttgatttcagtgaaattgataaagctgttgaaagactgaaccatatgcaggagagtatttcagaagctaaagccgctgcggaagaacttaaacagcttcttgaggatattaaattcgtgactgtgtctgttagcaaagaagacagtagaaaagataacagttaagtatagaataaatcggaagtgaaaatagttcagcagccaataagaagctgagttattcacttgtctttttatattaagccggccgcagtttttcggtttaaaagatttgattagttcacagtatatttttattatgtatatatatttcttgactcaatatatataacttttttacacaattatatttgtgcagacgtccttttggggcgttcgtaaagggatgtgcggaatccgcacacccctttttgctatagttttatttagtcaatttttaaaaagagtatatataaaatagggatagtttcattaaacagttgtcttaaaaatattgctaattaaatatattaacaatacttaaaatgagtaatgaaatttgctgtccattttattgtctgttttctatgtatattcacgcttcgcgtgagatggtagtcacctaacgcggtgtgcaagtaaatatatcacaactaagcaatttattatatgacacctaagttaattattggcgtttatagtttatatggcattatatggtttatataacatacacttttaaacaaaagtgtagccgcaatttacattgaaggtttatcaaaacaagttattttgtattacacccaccattatggtggggtcacagacattcaaggttaaaataaaacaagtcgttttgtataacgcccaccattcaggtggagtcgcaccctattgacgttcactaagacgcccctttattttttatattgaattttaattttacaaaaacaagttgctttgtataatacactctttacaagtgtggtaatagttacatttcagatgcttgttatattatattttatataatttttttattttaaactcccataattttttcgtccaattcattgtagcctatccacacctttaattttttgtctagttctttgttgaatttccaaattaaatattatgcctgtattaaatgtacacgcaatataatataataaatctttgttctttatattttctttaattgagtttctaaactatagcattttacgttgtctatatattagtaatttgatataatttataaatactacagagaaaaaaacggaaaattttattcaataactattgtgcggcaagaagattagtgttataattgttgccaggttcaatataaatatattatatcaaaaaattgccttgtttggcataatggagtatgtttatgggaattattaagttaatcaagaatgaaatacatttgacttttgaacgtgaccctgcggctcgttccaaagctcaaatattttttctttatcccggagttaaggcgattatataccatagaattgcacataagctgtatggtatgggaagatattttttagctgactgggtatctatgcacgccagaaaagttaccggtattgagattcatcccgccgcccaaataggtaagaatgtgtttattgaccatggtatgggtgtggtgattggagaaactgctgttgtcggtgataactgtaccatatatcagggtgttactctgggaggaaccggtaaggacaaaggaaaacgtcatccaacgataggtaataatgttacaataggcagcggcgctaagattttaggaccatttaccgttggggataattcaaaagttgccgcaaatgcggtggttctcaacgagataccgccgaacagcacatgtgttggcgttccggcgcatattgtaaaaagagaaggagttaaaattgctcctgcaaagcaggtttatgtcgcagacctagaccaaattcattttcccgatccggtatctatggacttgtgcagtttgagaaattctatagagcgtttgtataggaaagttgagaatattgagtgcggtgattataaagaagatgaaaccgattgattggatataataaattagatgaaagggttttctacatatgaaattatttaatacgcttactagagaaaaagaggaatttgttcctataaaaccgggggaggttaagatgtattcctgcggtccgacggtttataactatttccatataggaaacgcgcgtccgtttataatatttgatacgttaagacgttatttggagtatcagggatttaaggttagattcgttcagaattttactgatatagacgataagatgataaacaaagccaatgagcttggcatcactgttaaagaactggctgataaatatatagaagagtattttattgatgcaaagggactgggcattcatcatgcgacggttcatccgagggctactgaaaatattgacgctataatagatataattcaaaaactggttgacagtggttatgcttataatgttgacggtgacgtctattacagcacaaagaagtttaaatcatatggaaaactatcgcaccagccgcttgaggatttggagagcggagcaagaatagaagttaatgaggataagcgcgaacctatggattttgctctttggaagaagcaaaaacccggagaacccgcatgggaaagtccgtgggggatgggacgcccgggatggcatattgagtgcagcgctatggctaataagtatcttgataagactattgatattcacagcggaggtcaggaccttattttcccgcatcatgaaaatgaaattgcccagagcgaggcggcaaactgctgtcagtttgcgaattattgggttcataacggttatataaacgttgacaatagaaagatgtctaagtcgttgggcaacttttttactgttcgtgacgttgccaaagaatttgattatgaagttattcgtttctttatgctttcagcgcattacagaagtccgataaacttcagtaaagatttaatggaatcggcaagctctgctctagagagaatttatacatgtatagacacattaaaattcttaaagaagacagcaagcggagaagacgcgagaccggaagagattcccgtgcttgaagcggtcaatggttataagcagaaatttatagacgctatggatgatgatttaaatacagcggacgctatatcagttatatttgagatagtgtcggaagtaaacaaaaatattacctccgcttctgagccgagcgaatatcttatagaatatatattgtcagtttttgatgagcttggcagcgttttaggaatacttgggcgcaaagagaaggaaacggttccggatgaagtaaaagagatgcttgaggaaagaaaaaatgcgagagccgataaagattgggcaaagtctgatttaatcagggataagctgaaagactttggctattcagttaaggatacagctcaggggcagcagttgattaagctatagttaatttaaattaccgcttttagaaagtttaaataaattagtttcataataaaatcggatttgctgttttaagctaaatgatagaatagctgtgcggtaaaacctgtttgattaattaaatattattatatccgcctctttttgaggcggtatttgttaaaataagaaattaaaatacgatttggaggaaccatctcttattagggatacagagtgagatatacgtgaataagttttgtaatatagcacaaaatattattacgtctcggtttgtaaaaattaaaagatatgataaatgttattttagagaatttgggtatagataagctgccgccggagcagtattcgccattaaccttagcttatttgggtgatagtatatatgagttatatgttaggagctatttggttaaggatggaaatgagaatgtaaacaagcttcataaatcagctacaacatatgtttgctgcaagggacaggcggagtttttcaggaaaatagaaaatatgctgtcagaaaaagaaatgtcagtgtttaagcgcggaagaaatacaaaatcacatgttccgaaaaattctgaaatgtcggattaccgtgtggcaaccggagtagaagcgctgtttggttttctttatctttcgggagaagaagagcggatatgcgaattacttaaacatatttttgattaatagatttgcctgtttgtttttatagcgcaatgaacaatttgcgtagaattttacataacaataatattaaagcaattattataaaacaaatggggcggtataattgaaagaaaaagttcaggatatattgttaatattgcttggcggaagtattatgggttttgctctggatttttttcttgttccgtctcaggtcactgccggaggtgtcagcggtgtatcaacagtattgtattatttgtttaacctgcctattggattaatggtattggttctcaatattcctatttttattttagggtttataacatttaattctagatttttaatcacttctctgataggaacagttgcgctttcagtatcagctcaattttttgaacttgaaatattcaggagctttcagccaatatcaaatgatatgctgctctgttcggtattcggcggctcaatatatggcgttggtcttggtatagctatgcgttcgggcggtacaactggcggtacggatatactttctcttgtgctgaaaaaatggtttccgtcaatgtctgtaggtcaatttattatagctattgacggtatagtaatattggcggcaggattggcgtttcagagattagacacgattttgtattcaatagttatgctgtttgtttgctcgtatgttttagatacaatgctcgagggcgtaaattttgcaaagattgtgtacgttatttctgaccataataaggaaatagccgaaatgattgcgtctgaacttaaccgcggttcaacggcgctttccggattttcaatgtacagcggaaaaaacagagacgttttaatgtgtgtaatgagaaaatatcagcttccgccgttgaaaaaaatggttatgaatatagacgaaggcgccttcgtgattgtaactgacgcaaaggaagtaataggacaaggctttaggataaggaacaaattgatataatttaaaattataaaatcctgtgacttgttatgcgggattttattgtgctattatacatcttgaatctaaaagttttttgggttataatatcaaatatataatttaactttataaaggtgaaaaaatggaaaaaacagaagctaaacagcgtattgacgaactgaaagaaatactgaatgaagcgaacagaagttattatattctagacgctcctgaaatcagtgactttgaatatgataagctcatacgagagcttattgtattggaggaagaatatccggagtataaaactcaggattcacccagtcagagagtgggcggcggcgtgcttgagggatttgaacaggttactcacgccattcagatgcaaagccttactgatgtgtttgataaagaggaactttttgattttgacaatagaacaaagttatctctcggtttagatactgttgaatatgtaacagagcttaaaatagacgggctttcggtttctttggaatatagggatggaatgttttttcggggttctacccgaggcgacggaaatattggcgaggatataactaataacctcaggacaataaaaagtatccctctaaagctgacggaacaaattccatatttagaggtaaggggagaggtgtttatgccaaaacccgcgttccttcgtttaaatgagttgagggaagtggcggaggagccgcttttcgcaaacccgagaaacgccgccgccggttcgctcagacaattggacagcagtgttacggcgcagagaagccttgatatttttatttttaacgtacaggctgttgagggaatggagtttgtcactcacagcgaaagtcttgattatatgcggaaattgggatttaaagttattcctgacaggcggattcagcacgggattgacgaggtctatgatgaaataatgaggcttggtgaaatgcgcggcaatttagactttgaaattgacggagcggttgtaaaagtaaacagtttggaagagcgtttgttacttgggtcaaattctaaaacgccaaaatgggcaacagcttataaatatcctcctgagcgccaggaaactgagttgattgatatagtgcttcaagttgggagaaccggagcggtgacgcctaacgctgtttttaaacctgtgagggttgctggttcgttggtatcaagggctactcttcataatatagattttattcattcaaaggatataagaataggcgaccatataataattcaaaaagccggagacgttatacctgaggtcgttgaggttataaaagataagaggaagcctgacgctgccaaatatgagatgccggatgactgtccggtttgcggcgaacctcttgagagaatagatgatgaagcggctactagatgtacgaattcaaactgtccggcacagcagcttagaagcataattcactttgcctctaagggagctatggaaattgacggcttaggtccggcaatagttgagaagcttattgatgagggtttggttaagacctgtgctgatttgtatgaactaaaaaaagacgatatagtaagtttggagggattcgctgagaaatccgcttcaaatcttatagagtctatcgaaaactccaaatccaggggccttgacagacttttgtttgcgttgggaataaggcttattggttccagagctgcaaagctgatagcagaacgttttggcaccatagaaagtgtagctgaagcaaacgccgagcaaattgcagaaatccctgatataggtgaaaaaatggccgggagtgtagagcattatttttctgaatctgcaagtattgagttaattgaacatctgcgcaaatgcggggtggatatgacttatgaagcagtggaaaaaggcggtatattttcaggaaaaacgtttgtaataaccggcaccttgccgggaatgaaacgcagcgaggcaaagaaacttattgaggacaacggaggtaaagtatcgtcaagcgtatcaaaaaagacagactaccttttggcaggagacgaagccggcagtaagctagacaaggcaaataagctgggaataaatgttatatctgaagaagatttggaaaaaatgcttgacaacaatttctaattgtgttattataacctgcggtaacctatggcttaagttttgggatatggattcaccgccctctactaagctttaaggggctaatataatatggaggtgacacaacatggataaggacataaagcaggagattattgaaaaatacgctacacacccgggcgacactggttcgcctgaagttcagattgctcttcttacacaaagaattaatcacttaaatgagcatttgaagattcataagaaggaccatcattcaagacgtggtctgcttaaaatggtcggtgttagacgtagcttcttgaagtatcttgaaaagaaagatattacaagataccgtgctatcgttgaaaagcttggcttgagacattaaaaacaattgacggcagcctgcgcatttttcagcgtgggttgcctttggtttattttgtaaacaaagagttgagctcactttagcagttaaaaatatgcattggcgctgataatgcctgtttttaagtgctaaacgggcctctcttttaaaatatttaggaggtttatttatgtcaaagatttatgaaacagaagttgccggaagacccctttctttggagtttggcaaggttgctggactggctaacggttcggtaatagtaagatacggagacacagttgttatttcatgtgctactgcgtcagacaagccgagggatggtattgatttcttccctctcagcattgattatgaagaaaaaatgtatgctgtcggaaaaattccgggaggatttaacagacgtgaaggaaagccgtcagaccacgctatattgacgtcgcgtgttatagacagacctatgcgtcctttgtttccaaaggatttgagaaacgatgtttctattgtttcaacagttgtttcggttgaccaagataattcgccggaattctgtgctatgataggttcatctatagctgtcagcgtttcagatattccgtttaacggtcctgttgccgctgtatatgtcggaatgatagacggtgagtttattatcaacccgactgttgagcagagggaagcaagcgatcttaaccttgttgtttcaggaagcgctaagaaagttgttatgatagaggccggagccaatgaggtttctgagactgatatgtataacgctattatgtttgctcatgaagaaatcaagaagatttgtgcctttttgcaaaagatagttgacgaaatcggaaagccgaaatttgaatatgagcatgttacagttgatcaggctttgtttgatgatataagagactatgcagaggagcaggttaaacaggcgcttgacacggatgataagactgtcagagacgcaagacttcttgttgtatatgaagatgtttatgttcattttgaggataaatatccgcaggaagaatataaagaccaaattgatgaagctctttataagctccagaagacaatagttagaaactggataatgtatgaaaagaaacgtgtagacggcaggggaatcctggaacttagacctctttcatcagaagttggtcttttgcctagagtgcacggaagcggtttgttcagcagaggacaaacccagtgtttgtctgtaaccacattggctcctatcggagacgctcagacaattgacggtgttggtcttgaagaatcaaaacgttatatgcaccagtataacttcccgtcatacagcgttggtgaaaccagaccgtcacgcggtccgggaagacgtgaaatcggacacggcgctttggcagaacgcgcgcttttgcctgtactgcctagcgtggatgagttcccgtatgctattcgtgtagtatctgaggttttgagttcaaacggttcaacttcacagggcagtatttgtggttctacattatcattaatggatgcaggcgttccgataaaggcacctgtagccggtatttctgtaggtctgataaccgatcctgaagatgatgataattttattacaatggtagatattcagggattagaggactttttcggcgatatggactttaaagttgccggcactaagaaaggtataaccgcaattcagatggatcttaaggttgacggtcttacacctgctattatcaaaacagcattagaacagacaagaaatgccagattctatattcttgatgaagttatgcttaaagctatagctgagcctagagaaaatatttcagagtatgctcctaaaatcattaatatggctataccggttgacaaaatccgtgaggtaataggcagcggcggtaaagttatacagggtattgttgccgataccggagcaaaaattgatattgaagaagacggtcgtatttatatagcagccgttgacacaaaagccggcgagctggctaaaaagatgatagaggatataattagggaacccgaagtcggagaaatatatgacggtaaggttgttaagattatggactttggcgcatttgttgaaatacttcccggaactgacggtcttgtccatatttcaaagctggcaaaaggcagagttgaaaaagtgactgacgtcgttcacgagggcgatatgattaaagttgaagttattgagattcagccgaatggtaaaataaatctgagaaagattgaagattagtttttaaatatttaagcggtcgagtttaacatctttgttatacttgaccgctttttgtcattgtgatacaattacaataaatatattttgttttaggggtggattttatgctatataagataaatatacacacaggaagaggagaccaaatgatagatattaccggaaaggttcaggaatcggttaaggattcaggcgttaattcaggtctttgcaccgtctatgttcctcataccacctgtggattgactataaacgaaaatgccgaccctgatgtgcaaagggatattttgatgactttagataggcttgtgccatatgatgaccccaactttcatcattatgaaggaaattcagcagctcatattaagtcagggctttttggcttttcacagaatattattatagaaaacggacggctgcttcttggaacttggcaggggatttatctatgtgagtttgaaagggttaagacttcaagaacggtatatgtgaaaataatggaaggataaacagttatcctaagaattactaatgagtaatggatataagatgtttatcttaatatttttatatgttaaaaaactctgtcattgatgttaagggaacgttcttttactactatgactagaggtctaaagaattggcttttgcgcatattacaaaaacttttatactttaataacagtctaatacgccattgtggaatattccgcaatggcgtttgttttcagtctgagattgctgataagcaagctattattgcaaattaattattagtataaatgctatataaaaatttaacctttgcttctttgaatattgtatgcgacttttgcggcgagcctgtcagataaaaacctaaggccgaattttcctagtttcattgtggttccgggtattatgacagtctttttcttaaacattttcttaactgcgtacgaagccacgtcagcgctcttaagtcctttaatagcaaattttactccggcggtgttgttgaaacttgtgtttaccggaccggggcataacgcgccaatgtaaacatttgaaccgctctgcctgagttccatagctatagcttgggtaagtctgagcacatatgctttggttgaataataagttgccatcagcggtcccggcataaaagcagcagaagaggccacatttaaaatatatcccctgtctttttttataaaatcgtttagaaataattttgttagtatatgaagtgcggtaatattggtatctatcatattaagttcagtatttatatttgtattgttaaactctccgaataaaccaaatccagcattattaatgactatttccaaatcgtcttcattagcgattccctgaacattttgatataattcaaggcaagcgtttttgtccgacaaatcagaggatattatatatgatttcgttttaagcgaatccgctgttttttgaagtctttcattatttcttccgacaagtataatatcataacctaaatcacttaatttctcggctatatcacgtcctataccggaacttgcacctgtaaccaacgctttcataaaactcctcctaaagtataaaatcagggtcacataatagaaaaaattctatcggtgacccttagattatttattatactattatattatactttttcaactgagattataactttttcaccgttaatatcccattcttttccgtcattttcttgattttgaatttcatcagctaaagtctgtgtttttatttcatcagcaaatttaacgaatatatcatttattttattgcttccgctaaagtagatatttatacggtcttttacttcaaatccggaatctttacgcattgtctgaagtttgcttattatctcacgaaggaagccttcctcaatcaaagcgtcgtcaagatttgtgtcaagaattacggtaaatccaccgtcactgtctgaaacaagcccattcatttgctgggtttcaatcaaaacgtcatcttttgttatttcaacgtcagtgccttgtacattgagcttcagcgggcttcctgaatttagaacagacataacctctgctccatccatcttagccacctcgtcaaatataggacgcattagcttaccatacttcggacccattgttctcatctgaggcttaaatttgtatgatataaatccgctggcgtcttcaacaaactcaacttctttaatattgagttcatcgagaattatataaatatagtccggattaatttcagtatttgattgaatatacagttttttaagcggctgacggttttttatgttagcttcattacggcatgcgcggccaagcattatcacctttctgacagcgtccatatctttctcaatttcagggaaagacagcttttcatccatagacggataatcacaaaggtgaacgctttctggagcgtttttatcaaccgacaatactaggttctgatatatttgctcagtcataaacggtacaaaaggagcgcacactttagaaaattctaccaagacagtataaagcgtcatatatgcgttaattttgtcctgagtcatttcaaccgtccagaatctttcacggctgcggcggacataccaattggacagctcgtctgtaaattgtgttatagccctggctgactcaacaattttataattggcaaggttattgtcaacctcttttattacaccgcttaatttagaaagaatccatttatccatcactgaaagtttatcaatatccagtgtgtattttgtcgggtcaaattcatctatatttgcatagagaacataaaaagcataagtgttccatagagtacccaggaattttctttgtgactcagacacgttcttttctgagaaacggttcggcagccaaggagcagagttggaatagaagtaccagcgtatagcgtcggcgccctgctgatttagaacatccatcggagcgacaacattgccgaggtgcttgctcatcttctttccgtgttcgtcctgaacatgtcccattacaacaacgtttttataaggagattcatcaaacagcaatgtgcttattgccattaatgtgtagaaccatcctctggtttggtctatagcttcactgataaaatcagccgggaaatgcttttcaaacagttctttattttcaaatggatagtgcagctgtgcaaacggcatagagcctgaatcgaaccagcagtcaataacctcaggaactcgggtcatttcgccgccgcattccgggcattttaatttaacttcatcaacatatggcttatgaagttcaatatcatcagggcagtttattcccatttctttaagctcttctattgagccgataacatgtttatgtccgcatccgcattcccaaataggcagtggggttccccaatatcttgaacgtgacagaccccagtcaataatattttccaggaagttaccaaaacgtccgtgtttaatattgtcaggcatccagtttacggtctcgttattagcgagaagtctatcgcgtacggcagtcatttttataaaccatgtgtcgcaagcgtaatacagaagaggggtatcacatctccagcagaacggatagctgtgttcaaaaggaattactgagaaagccaagtttctgtctttcagattacgaattataagcttatccgcatccttaacaaaaagcccgctaaggtctcctgtgccgtcaacaaacttaccctgactgtcaacaagatttataaaaggaaggttgttttcaactccaactcggttatcatcttcaccaaaagccggcgccgtatgtactataccggtaccgtcttccattgtaacataattatccgcaacaaccctatatccgtctccctcaggctttgcaaaatcaaacaatggttcataatgcataccgcacaggtctgtaccaatatattcttctaaaattttatattcgcagtccttaggcagaaccttttcaagcaaggcttttgccaaaatatacttttcatctccgcattcgattttaacatatttctctgacggattcacgcatagggcaacatttgagggaagggtccatggcgtggtagtccatgcgagaatatactcgcctttcggagcatctttaatctgaaattttactataatagaattttctttaacgtctttatatccctgtgcaacttcatggctggacagagcggttccgcagcgaggacaataaggcatgattttatgacctttatagagaagtcccttatcccaaatttgtctgagagcccaccaaaccgactcaatataatcattgtggtatgttacatatgggttgtccatatcggcccaaaagccaacgcggtcactcatttcttcccaatcgctttggtaaacaaagacgctgtctttacactttttgataaagtcttcaacgccgtaattttctatttgaggtttgccgctgatgccaaggcttttctcaacctcgagttcaacaggcagaccatgggtatcccagccggcttttctctcaatcaagtatcccttcatcgtgcggtaccttggaatcaaatccttaattgcacgagtaagaacatgacctatgtgaggctttccgttagcggtaggcggtccgtcaaaaaaagtaaagatttcggctccctcgcgattctttatactctttttaaatatatcgtttttcttccaaaagtcaacgatttccttctctctgtcaacaaaggaaaggtcggttgatactttgcgatacatttaaatccctccaattctataataaattaattcttaacaaaattatatactcattaattttttcgataattaaccttaatattgtatactaatttaaaggatgtgtcaagggctgtaaagaggttttttaagcctccgaaatttgaattaaattagataaaaagccgtttaatttattatagattttcaaatgtttgcggacaatactggaatgtgtattttacaatttagtttattgtattatatctttaaggttaatattttgaagacgaaataatatttttaaaacgagttagatatttttttatgatatgttataacatgaacagcgttaatataaaaatgaaaagggtaataaaaacctaaaaaaatctactgtactgcatttccaatctaaagtacaaagtgtccattaaaatatatataatattttttgtgtttgggttacagatattttagtagtaatataagaaaattagtgtatataatacacttaagatgaaggtgttattattgtctgacttaaactttttacgtatctttttagaaattaaaatatagatataataattttgaattgaatatataaattaaaagcaccggaacatatatagttcggtgcttttgattaaaataaatcttcgtttctgcttgcaatctcttcagcgtgggaggcttttaactttgccagttccagcgctcttttatttttaacttgctttctgttttgaatttgatttttacttgaatatgttttgttataatctggagcagcatttctttttgaaaataacgccttgttctcctcatccgcctgcatatttgcaagcgcttcagcatgttctcgtttggctaaagcaagctctaaagctgttagcttttttgccggcggtgttatcgtaacaggctcagtttttttctttctcttttttttctttacggctttttcagcttttttagcttttttcaagatttttggctccgagacagtaacatactttttcttttttaaaggagttctggcacggaataatgcttctgtgttatcatcctttttaaaagttctcaaaaagtatttaggattcagagcggcgccgatagttctgaaaaatcttccttcagccaaagcgtagtcaggcattttggcaaaagcatatgtaaacagcgttccgattaagaaaaatatcggtggcagccaaattgacgcatatggttgaaactctaaaatttcaccaatttcagatgaatttatgcttgaaataccaagtgtaaccaatacagaaaatcctatgctcaaaagtgttccaacggccgatacacaaaagtttataacctgaataagtctaaatccaaataaagacattataagagcagcaagaccaaaaacgaggagcactatacagcctatcatcaaaagctgtatttcaggcggagtagtcacaccaaaaaagtcaaaaaactttgaaaccataccaaaagcgattgatgaaatgctgaacccttcagttacatcattcagttcaatcgaatttattccaaacatcggcaagcgctgtgagataaacaataaaatataggcagcaatcgcaaatgctttaaaactaactttctgcaaagctgttatgaaaagcttttctgttttcattcgttaaccctccttgcctacgtatgttttattataataaaaataacttgtttcgtcaatacataattagaaattttgtcggtttttagtctaataccccaagttttataattcttccggagcgaagaagccccagcatagcccaatacattataagaatacgaggttcaaacaagttagaatccagcagtgaagaaatagaaattccaagcagcgcggcaagtccggcggcaaatataattttttggcgcggtgtggctctgaacatacatgttatggaagagtgtgcaattcttaaaatataatacataaatccaatcataaatacagcgccgacatctatgagaatgttaaagtacacagcgctgatgtgaaggttgggtatgtttatcaaagtgccgccttccccgtaatgctgagctgtggaattatagatgttgacaaagttgtctgtgctcactccaaatccatttgtccagaaatttctcaaagtatagacaatgttttcaataatatttccgttattgctgccgttttgccacattaatataatgttgttgagtacgcgccctgaaaagaacggcgccaaaaacagaatcattggtatataacgtctgtcagtcaaaatgattacgataacaagctcaataaaataagcaatgaacgcggctttagactgtgtggccgagataacccaaaaagatactcccataaccagtattgaatatataaaccgtctgattttagattctaaagttatgggataaacaaatgcgaaaggaaaaagcagtaccaatatctcagcaaaaattgtcgaatccccgtaaacgccttgtatagctatgctcggattgtcggcatgataagcctgaactatcccggttatacacaaaacgaccattgccaggaaaagagacattaaaattaattctaaatcatcctgagttctgactgtgaatgatatcagaaaaaataaatcaacagccaataaaaagtatgaaagggatttgcaagccgcaatcggtattgacatgctcatcatagctataaacatgaatataattatgtttatcagaataaatataacgcctgtgcgctgagtggagttatgagaaatataaattagcgatacgagcatgaaagccggaaccatataaaaattatcccatagagatgatgggaataaaagcacaaacagcagaaacacacctatatatataggatgaaacttaagccttgaacggggaatataaaaagcaaaccggcgtatgcctattgtggtatatctgtaaaacgcacttgcataccaggcttcgccgacaactttagtattaaaaaatatttcaagatacttattattcataatttttttttcaaaccaagttataattgctaaagtcttactatgaataaaatcgtatttcagacgcggaatcagaatatttgtgatccacataattatctcatataaaaaactgtttttatatatgtctattatctcttgtctcacatttatatcctccaaaaatctcattaacgaatatcgctgatatagacatcaaaaattacgtcaccaataatgatttgagcagattgacccatcaaataaatgtttttatcaatttttataccgtggtctgtcttcataccttcaaccgttgtaacaaattctgctttagcccgaacaggctcaggcgttggaaaaggtgtgggagacggctggtcttcatcatcgttttcattattttcagcgttcccgtttgatattgcggcaacggaataattttcagttattggagtaagatttatattatcaagcacacctatttcattaccatagcttccgtcaatgcaaatgtcgccgtattcaactttgtttaacaggtcgattggcgagctttcacatacataggtaatagtgtaggtttcatatttattgtttcccctgccccaagctgatttgtatataagagcagcgacgctgagaataatgattgcaagcagcaagatatctattatatttaatttccagattatttttttcgaaagcataatttatctcctatatatgtttaaattgccacattaatacattatatattatatcgctttttgatatttttttcaatccatatttttagttttaatattacaaaatatttactaatatcaatagagaaagatttttaaaatttttatataatttatctgaagattttatcattccgattatagcaaggagcggcagtaaatgttttataaagttttatttagaaaaaattgtttacatttcaactgcgacaaacaattttgatctgacaatgcttgtataaatacaatacttttttaattatattaaatttaaaacgaaagattagtatcagaaggtgtttttagtgaacatcggcagggtgtgcgtaagcacacctcgttaggtgagctatcatatcacgcttagcgtgaaaatatttaaaactatttgttataaatatttttactaataaatttttccgatattgagtactttacgcagcaaactgctttcgcactgcgtatttaaaagaaattgataagtgtcgtgaaagatgagtggtaacgggaattattttaattatagttaacttctatatcataaaaacatatgtcatctattgttaaatttcagaatttataagatagtttatctaaacaataagttagataaaagtttaacaaagcggctgatttgtcataattattttttgtgaaaaatgttttttaaattggattgacaaatatttaacaagtgtgtataatgtgtattgtaaagagattgataaatatttaacaatttattccgtaataaagaataaaagcaaaacactttagtctgtgaatctcattaattatttatagtaaaagttaagtttttataatatttacagaaaagtgatttatgattagcatattatggatataattgttattaggcctaatttaggcttcactaagaaaattaattaatttatatatctgagaggagtaagaacttatggtaagtacagttcaggaacttgagcaggaaataaaaaaggtaaggaaagctcagcaggagtttgcgaagttctcacagaaacaggttgatgaaatatttaaggctgctgctatagccgccaataaacaaagactgccgcttgcaaagcaggcggttgcagaaaccggaatgggagtagttgaggataaagtaataaaaaacaactatgcagccgagtatatttacaataaatacaagaacacaaaaacatgcggtgttatagaagaagattccgcttatggtacaaagagaatagctgaaccgataggcgtaatagctgcagtaataccgactactaacccgacttcaacagctatttttaagactttgatttctttaaagacaagaaacggtattatcataagccctcatcccagagcaaagcaatgtactattgacgcggcgagaattgtatatgaagccgctgtaaaagcgggtgcacctaaaaatattatttcatggatagatgttccgtcgcttgagctcacaaatatgcttatgggagaagctgatactattttggcaaccggtggtcccggaatggttaaggctgcatattcatcaggaaagccggcgcttggtgtcggagccggaaacacgcctgcaattatagatgatactgctgacattcttttggcagtaagttcaataattcattcaaaaacttttgacaatggtatgatttgtgcttctgagcagtcggttatcgtgcttgattccgtatattcaaaggttaaaaaagagtttgccgacagaggatgttatttccttaaaaagaatgagattgacaaggttagaaagaccattttgataaatggagcgcttaactcaaagattgttggtcagtctgcttatacaatagcgaaactttcaggagttgacgttcctgaaactgctaagatattaattggtgaggtcagcagtgttgaactcagcgaagagtttgcacacgaaaaattgtctcctgttcttgcaatgtataaagcgaaagattttgatgaagcgatagaaaaggcggagcatttaattgctgacggcggatatggacacacctcaagcgtttatctgaatgcggttactgaaaaagataaactcaacaagttccaggccgctatgaaaacctgccgtatattggttaataccccgtcatctcacggaggtataggagacctgtataactttgatttaaacccgtcactaacgttgggatgcggttcatggggaggcaactctgtgtccgaaaatgtaggagttaagcatcttattaatataaaaactgttgctgagaggagagagaatatgctttggttcagggctcctgagaaggtttactttaagaaaggctgtctgccggtagctcttgaagagttaggcgttatgggtaagaaaaaggcgtttattgttactgacagttttctgtacagcaatggttataccgacccggttacaaacaagttggatgaaatggggattaaatacagcgtattttcagatgtagcgcctgacccgacccttgcctgcgctatcgacggcgccaaagctatgacggcgtttgagcctgattgtattatagcaatcggaggcggaagcgcaatggacgccggtaaaattatgtgggttctgtatgaacatcctgaggctgactttatggatatggcaatgagatttatagatattcgcaagcgtgtgtacacattcccgaaaatgggagaaaaggctatgtttgtagcagttccgacatctgccggtaccggaagtgaagttactccttttgcagtaataaccgacggcgacagcggtgttaagtatccgcttgctgattacgagcttatgccgaatatggctattgttgacgctgatatgatgatgaatgcgcccaaaggtttaacgagcgcgtcaggtattgacgctgtttcacatgcacttgaagcttatgcttcggttatggcgactgattatactgacggtttggctctgcgcagtcttaaaatgatatttgaatatttgccgagagcctatgataatggtccaaatgacccggtagcgcgtgaaaaaatgggaaatgccgctactatggcaggtatggcgttcgctaatgctttcttaggtatttgccactctatggcgcataagcttggagccttccatcatctaccgcacggtgttgcaaatgcgttgatgcttgaagagattatgagatttaatgctagtgaagttcctacaaagatgggaacgttctcgcagtatgaccaccctcatactttggcaagatatgcagaagttgctgattatctgggatttggcggaaagactgatgaagaaaaacttgagaatcttatcaaaggcataaatgaactgaaagagaaaataggaatcaagaagacaataaaagattatggagtggacgaaaaagtatttttggatacgcttgacgaaatggtagagcaggcattcgatgaccagtgcactggagcaaatccgagatatccgcttatgaaagaaattaaagagatgtatttaagggcttactacggcaaataaatattgattaaccgttgttggtttgttataattaatttaagagaatcccgccgttggcgggatccgtttaaattttcagtggcgaattttcgacgctgaaacattgaataacggggcaataccccttattgaattaatttaagagtaccctgctgttggcgggatccgcttaaattttcagcgccgcaaaccgccgctgatacattggataaagggcaaaacccattatttgatattgttaacaataggtcacgttgattctgaaaggagcaaacaattatgaagtacgaaaaaattcttgccgagagacccgataaggttatttataaagacggcgaaaatgctttaaaagtttttaattccaattattctaaagcagatatattgaacgaagcgttgaatcaggctagagttgaggaaactggattaaatatacctgcactgaaccaggttacaatgattgacggacagtgggttatttccacaaaatttattgaaggaaaaacgcttgctcagttaatggatgagaatcctgagaaacttgatgaatatcttaacttatttgttgatttgcagctggaaatgaataaggagactgttcctcttttgaacaagttaaaagataagatgaacagaaaaataagcgagtccgggtacgacgctactacgagatatgagctgcacacccgccttgagagtatgccaaagcatacaaagctttgccatggtgattttaacccgagcaatattattgtcaccgataacggaaccccatatattcttgactggtcacacgctacacaaggaaacgccagcgctgatgttgcaagaacatatttgctgttttgtttagacggcaaggaggagcttgctgacaaatatcttgatttgttctgcaaaaagagcgacacggcaaaacagtatgttcagaaatggatgcctgttgttgcggcatcgcagtctgtaaagggcaagcctgaagaaaaggaatttttagacagatgggttaacgtggtagagtacgaataagaaataagttttggaaactctaaaaggactgtaaaaagtcatttttaagaaaaacaataaaaaccattgtaaaaagacttttattgtctaaatacaatggttttttattatttatatattttattgtgctgtatgacaatctgattatagtctttttatattctgtttggttctttttaatttattatattttttaatataataacagattcaataatattttttgttacagtgcaacattcattaacgttagtataaatattattatcaaagcacagatatataatttagcttcttttcgtattgcctttaagtttgggtcgttttcataatccgtattaaataaagtttgaagaccaatgaaaataggacgtttaacttctttctttccggtgacaagaacgttataatatctgtcatataggtcgtgatgataagtctttatgtatttatcccctttttttgcgatgtcaaaatatgcaaacaccattaccattaatgataaaaagaaataaacgcctttaaaccatccttgtaaatctccgccgcttctgagagtagaaaagactacgtacaatgctccgcagattattaaatatacgtataaatgtgatttatatcttgtttccattttgctttctccatttcataatacatcatgtgagattattttaacatcaaggcaaaagcttgtcaaccttaattatattttagttatattatttgtattaaaggtatatatattattttaatttataaaaagtaatgtgttaaatatataacatataattaaaaatcagtgttgcaaaaggtaattttttgtgatacacttataaagtctgggctatgttgtgaatgtggttttcagaccattctaaatataggaaatacagtaaatattacatacgggaggtctcataaaatggctataccatttaagggaacaaaggaacaagaggaacagctgaaagcggtgattgaatctcataagggagagaaaggtgccactattccggtgcttcacgaagcccaggagatatatggctatcttcctattgaggttcaggaaatgatttctgagggtcttgacgtgcctcttgcagaaatatatggaatcgttactttttatacccaattttctcttaatcctaaaggggtttatcctataggagtctgtcttggaacagcctgttatgtcaagggcagcggagaaatacttgataaaatgaaggaaatattaggcatagatgttggagaatgcacagctgacggcaagttctcattggacgctaccaggtgtataggagcgtgcggtttagctcctgttattactattggtgacgatgttcacggcagattgaccgccgaccaggttgaggatatattaaaacagtatcagtagaataaaagttaatgcataatttataatttataattcatttttatatatgaattatgagttgtgagttgtgcattaagttaatatatttgttcaaatttttgaactctgtttataaccaagtataaaggggtggcttatgctattatctgatgttaaagcggaaataaatgctcaggtcttgaccggagaaaatgatgaaagccttggagcggttgatatacataacgcttgcggcagtgacttgatgagcgacgtgttggcttttgttaaagaccaaagtctcttgcttaccgggcttgttaatccacaggtcgttagaactgcagagatgatggatatcatagctatatgttttgttagaggaaaaactccgcccgaaagtcttattgagcttgcgaaagagcagggaatagtccttctaagcacaaagctgcctatgtataccgcatgcggcagactttacagaaagggtttggagggcaggaaagatgcagaaacattatgatgtagacggccatgatttttcgatagcaggggaagcttccagcaattttaaaagttatcttaagaagctgggtatagcgcctgaggttatacgccgagttgccatagcaatgtatgaagctgaaataaatacaataatacacggcggcggcggaatatgcgacgccgaggtgtcaaaggacagaattacgattactttcagagaccatggccccggaattaaagatatagatttagccatgcaggaagggtattcaaccgccagcgaccaaattcgtgaaatgggtttcggcgccggaatggggcttcctaatataaaaaaatatacggacggcatgaatatagattcaaaagttggggtaggtacaacggtagaacttattataaatatatgaggtgagggtatgtcatactttcattccgtcacacttgataaagataagtgcaggggctgtacaaattgtataaagcgctgccctactgaagctatcagagtcagaggcggaaaagccaagataataaaaggccgctgtatcgactgcggcgaatgtattagggtttgcccataccatgcaaaacgggcggtaacagatgattttgaggaactgaaaaattataaatataatatcgccttgcctgcgccttctttatacggacagttcagcgatgtaagcgatataaacgttatactcaccggccttttaaaaataggatttgacgatgtttttgaggttgccaggggagccgagtatataagcgcggcgacaaaagagatatataaaaaacgaagcggttcaaagccattcataagcagtgcgtgtccggctgttataaggcttatcagggtcagattccctaatctgattgacagcattattgaccttatttcaccaatggaaactgccggccgtttagcaaggaaagaagccgtccaaaagaccggacttaaaaatgaagaaattggggtgttttttataaccccatgtccagccaaaatgaccagtataaaatctccgttgactttggataaatctgaaataagcggggcaatatcagtcaatgatgtgtttgcaaagctttttccgattataggagatataaaggagccaaaagctcttatgaaatcttccctgagcggagtatattggtccagaagcggaggggaagcggacggcgcggctatagagaattatatagctgttgacggaattgaaaatgttattaaaatacttgaggaaatcgaagacgataaggtttccggtattgactttattgaactgtcggcttgtctcggcggatgtgtgggcggcgttttgaatgttgtcaatagctatgtagctaaaaatcatataaagaatatatcaaaaactttacacaacagaccatgcgaaacaaaagatatagatttgggttctctgtcatgttcaaaaaagctggagtatgagccggttatggaactggatgatgattttgacaaggctatggaaatgatggatgagcttgaggaaatatatgattctctgcctcagctggactgcggatcatgtggcgctccgtcctgtaaagctttggccgaggatatagtgagaggttttgccgatgagagtttttgtatagtaaatatgaaagctaaggttcaggaacttgctactgagcttttggcgtcagataaagataaccgtgaagaggaggagtaactctatgaaaatatcagatttagttaaatttggcgagtatgaagttttaaccaatcctgactatgaggataaagaaattactggctgttatattggtgatttgctgagctgggtaatgggcagagctaacagcggagatatgtggattaccgttatgagcaatataaacattgttgctgttgccacattgtcagacgcttcatgtattgttcttgccgaggatgtggatgttgaaagcggaattatagataaggccaattcccaaaacgttgttattttgaagacagcaaaaacgagttatgaagcggctgttgattattataaattaagcagtaaaaatgtttagctatgattttcatattcattcggcattgtcgccctgcggcagtatggatatgactccgggtaatatagttaatatggctaagcttttagagattgacgccatagctctaactgaccataacactattggaaatgctgaagctgttatgaaggcaggaaaaaatataggcgtatctgttgttccgggtatggaggtggaaacttccgagggtgttcatgtgcttactctgtatccgaatatggagcgtgctagtgaagtttcgaattttgtatacagccggcttccggatatagaaaataagccggagatttttggaattcaggcttatatggatgaaaacgacaatattattgactatgagaaaaaactgctcatatcgtcggcttccatatctataagcgaacttttttatatagttagtgaagcgggcggattgttttcgccggcccatgtcgacagggattcatacagcgtgctgtctaacctgggatttatcccggaagacatacctgtgaagtggatagaagtttcaaagaacgttgaggatttggaagcttatctgcgcatgcgtcctgacttgaaaaagtataaaatacttagaaactcggacgctcactatcttgagagtatgccgggacagaaaaattttcttgaacttaacagtgttgatgaactgtttaataaatagaactatttgataaataattgattggtggtgagctgattgaaagaactatctcttaatattttggatattgttcagaattcagtaaaagcggaagcgacattgattgaaataattattgatgaaaatattgatgatgataaactgacgattgttgtgtctgataacggatgcggaatgagtcctgaatttttaagccgtgtcagagacccgtttacaacgacaagaacaacacgcagggttggtatgggaatacctctttttgaactcgccgcacagcaggcggggggaagccttgagattacttccgacgagggcgttggcacctgtgtcactgccagatttcagtataatcatatcgacagagcgcctgtcggcgatatggcaggaacaatggttactttagtgtctgttaatccggagattaattttatttatatacatagggtaaatgattcggagtttgtgtttgacacccaggaaataaaagaaattttaggcgatgttccactggattcaacagaggttctgtcttggataatggattatattacagagggtctcggaaagataagagaagacaaacaaattagtaaataataaattccatatatagatttattgacagtaggaggtcaaaaaatgaagagtttggaagaattgaaagcaatccgtgacagggttcaaaaccagatggatatgcgtaatgacaatgataatgataccaggattgttattggtatggcaacctgcggaatcgcagcaggagctagaccggtgctgaatgaatttttgcaggaaataaacaagcgcggattaagcggcgttaccgttacccaaacgggatgtatcggtatgtgcagacttgagccgattgttgaaatatttaaacccggcgaggagaaggtcacatatgttaaaatgacgccggataaggtggctaaggtagtgacagaacatatagtaaacggcaggccggtcatggaatatactattggtgcggcacagactggaggtaaataaccaatgaacatatatagatcgcaagtgcttgtctgcggaggtaccggctgtacttcttcaggcagtgcactgctaatagacgagtttgaaaaacagctgaaagaaaacggcttatatgatgaggtaaaagttgttaagacaggatgttttggtctgtgtgcgctgggaccgatagttattgtctatcctgaaggcgcattttacagcatggtaaaaaaggaagatgtaaaagagattgttgaagagcatctcttaaaaggtagaatagtgcaaagacttttgtatgatgagtctgtacatgagggcactgacgaaataaagtcgctgaatgaagttgatttttataaaaaacagcaccgtataactttgagaaactgtggtgttatcaatcctgaaaatattgatgaatatatagcaagagacggatacgaagctttgggtaaagcgcttaccgagatgaagcctcaggaagttatagatactataaaagattccggactgcgcggcagaggcggcggcggatttccaaccgggctgaagtggcagtttgcggctaactcggtaaatgagcagaaatatgtctgttgtaatgccgacgaaggcgacccgggtgcatttatggacagaagcgttttggagggagatccccatgcggttttggaggctatggctatagccggctatgcgataggctcaaaccagggatacatatatatcagagccgaatacccgattgcggttcagagacttaatatagctataaaacaagcccgtgaatatgggctgcttggaaagaatatatttgacagcggatttgattttgatatagaaattagattgggcgccggagcttttgtctgcggtgaggaaactgctctgatgacttcaatcgagggtcatcgaggcgagccgcgtccccgtcctccgttcccggccgttaaaggtttgttcggaaagcctactatacttaacaatgttgagacgtacgctaatataccgagaattatattaaaaggcgcagactggttctcaaaaattggtaccgaaaagagtaagggcacaaaagtgtttgctctaggcggaaaaatcaataatacaggattggttgaggtgcctatgggcacaacactgcgtgaaattgttgaagatattggcggtggaattccaaacggtaagaaattcaaggcggcacagaccggcggaccatccggcggatgtattccggcagaattgattgatactccaatcgactatgattctctgatagctattggttcaatgatgggatcgggcggacttatcgttatggatgaggacaactgtatggttgatatagctaagtttttccttgagtttacagttgacgaatcctgcggtaaatgtactccgtgccgtgtcggaaccaagagactgcttgaaattttgactaagattacagacggcaacggaacaatggaagatttagatcgtcttgaaagcctggctgaagctattaaagccggctcgctgtgcggtctcggacagacagcgccaaatccggtgctttcaactttgaagtatttcagagacgagtatgaggcgcatattattgataagacttgccccgcgcatgtctgtaaggggcttgctaaatatgaaattgaccctgaaaagtgtaagggctgcgggctttgcgctagacagtgcccggtgggagcaatttcgggacaggttaaaaatccttttaaaatcgacagtgaaaaatgcattaagtgcggcgcttgtcttgagaagtgtccctttaaggcaataaccaaataggaggagatagaaatggcagataatgtaaatataaaaattaacggaatagaactatctgttcctgccgactatacggttcttgaagcggcacgtgaaaatggcattgatatacctaccctgtgctatttgaaagacatcagcaaaaccggttcttgcagaatgtgtattgttgagattaaaggtgcgagggctcttcaggcggcatgtgtttatccggtgtcggaagggcttgaggttatgacaaacactaaaaaggtcagagaccaaaggcgcgtcacacttgaacttttgttgtcaactcacgagaaaaaatgtctcagctgtataaggaacaaaagctgtgaactgcagtcgttgtcagaggagctgggagtagattcaatagagtttgaaggcgatatgaacagttttgaaatagacgacgtgtcaccgtcaattgtgagggataataataaatgtattctatgccgccgctgtgttaatatgtgcaaagacgtacagactgttgcagttattgacaccatgcagcgtggatttaataccagggttggcacagcttttgaaaaggcgctgtcagatacggcctgtgtaaactgcggtcagtgtatagtgtcatgtccaaccggggctttgagagagaaagataatacacaagaaatatgggacgcaattgcggacgatgacaaatatgttgttgttcagacagctccggctgtgagagccggtctcggcgaagagttcggattcccgataggaactccggtgacaggaaaaatggcagccgcactaaggcgtttgggatttgacaagacgtttgataccgatacaggtgcggacttgacaataatggaagaggcaaacgagcttttagagcgcatacaaaacggaggaaagctgccgatgataacatcgtgcagtcccggctggataaagttttgtgagcataacttcccggactttttggataatttatcatcatgcaaatcaccgcatgagatgttcggcgcagttataaaatcttattacgcaaagaaaaacaatatagaccctaaaaagattttcgttgtatcagtaatgccttgtgtggctaaaaagtttgaagcaggacgtcctgagatggagtctgacggacttagagatgttgatgcggttatttcaactcgagagcttgcgagaatgataaagcaggctggtataatgtttgacagactgcctgatgaggaatttgatgttccgtttgaacgtgccagcggagccggagttatattcggcgcaaccggcggagttatggaagcggcgctgagaacggcggcagatacgttaggcggaaaatctgttgaagagattgaatataatgacgtaagaggcgttgaaggaataaaagaggccacagtaaatatgggcggtattgatgttaaggttgctgttgctcatggcttaggaaacgctagaaagcttttaaacaatattcgtgaaggcaaggcggattatcactttattgagataatggcctgtccgggcggctgtgtaaatggcggaggacagcctatagttccgtcgagactgaaaatggatattgatgtcagaacggagcgcgcaaaagcgttatattcggaagacagagacagcaagattagaaagagccatgaaaatcctgatatgacattgctgtatgaggacttttttgaaaaaccgggttcacatcttgcgcatgagctgctgcacacgacgtacaaagagcgcgggagattttaattattataaaaatgcccttctgaattcagaagggcatttttgttggattattgtttttattaatatggctatattataataatttaattaaagtggaaagttatatatactgtataattgagttttttataataaaaattttattttgttttgcgtgtatattataatgtttttatatttattaatttttaaaataataaaattatatactatgtatatgaccccatataaaaaatttattattacataatagggtgtttgaaccatttctttttcttgcgagaaaaagaaacgcttcaccaaagaaaaagtgctgctcgcttaggtcgcctgcggctccaaggggcgctcgcaccccgctcatttcatcatgaagcatggcttcatgatgaaaaaagccctactactttcccgttgactttgtgtactaccgtgaaaatagatattctgagtttctatttatttaatttactaaaaaagaaggtttttcagtgaacatcggtaggcttgcgatagcaagcgcgtgaggtgcgcagtagcggaattgttaatatcttttattattttctttatagctttctataagattaattatcagttctgtatctttttcatttagtttatttattccttttattattttatgtattttttcaggatacttcatattttcattaaaaaattcatatggcgttattccaaaatatctgcatatttcgaaaaattcgctcatggacggcattgcttttcctgatgatatatgatttatatatccttccgaacgtcccatatctaaactcatacatctttctgatatgttttttctcattcgcaattctgttattctttttcttacaaaatcttcaaacatttatattccctttcctatatattatatatattataaaatttattcataataatttgatgtatatttgattcattttctaatttttttcattattttttaatatttttaaaaatataaaatatgtttttgattttcaattgataattgtctgaaaatattagttgtttcttcaatataaatttactttataatctgaatatcaatttgtggtaatattataatttgataaaaatttagtgtgttttattaaaaaaataatattatttattgatagtttatttaaaatatgataatatataaaaataaaacgaggtgataaaatgtcagaacgtcttaaagaattacgtaaatctcttaaaatgaatcaaacaaactttgcgaaacaaatagggataactcaaacggcgtattcaatgattgaaaatggaataaatcctttatcaaacagacatatcaaagttatttgtctggcatataatgtcaatgaaacgtggttgcgcacaggagaaggagagatgtttatttcttctccatatgaacaagagtttgttaaaatattcagcaagttaacaacagagactcaacaacatttattgtgtattatcaaagaacttctaaaaatacaaaatgaatttgtaaataaagagcaaaaatatgatgctgaataaaaactatattttatactgttataaaaacaggtaattaatatattgaacactgcgtgttcagatgatagctcacctaacgcggcaaactatgtttgccctaccgatgttcgctaaaaactctgctttttatgcattaaattaatatgaactcgaaaaatcttttttcacggtagcacacaaagtcaacgggaaagtagtagggcttttttcatcatgaagccatgcttcatggtgaaatgagcgtgggcgagcgcccattggagccgtaggcgacctaagcgagcagtactttttctttggtgaagcgtttctttttcttacgagaaaaagaaatgtttcaaatacctattataagtaaaataataaatattatatggggtcatatacaaagttgattttaatgaatgttttctttatataatgaacactgcgtgttcagatgatagctcacctaacgcgcttgttaacacaagcctaccgaagttcactgaaaaccacatttttatatattaatttaaaaggaaaactcagttttttcaataagtaaaatataaatattatatggggttatatacatagtataataaataatattttaattaacaattgtcgataaatagagtatatttgttataaaaatttgagtttgatataaacttgtaatagagaatggcgcaaaatcaataattttatgaatcataattagtgtcttaaataagagatatatatgtaaatctcggtcaatagatgatgtatattagagcacaaaagcatacattatatatttcaaaattctatttatttataattccaatcaagcctgacccaggcaatatttataaatcccttatgttttcatatcaaaatattatgtcaatggatgacattattttattttaatatacggaaatattatacagattaattgcgcaacatactgttatattgccaataattaaccttttagcttaaaaatagtcatttatctatgtaaaatagcaataattcttgttgaaaaaaacatttgtttatggtaatatatctatatgattttaattgtaccggcatacaaattatattggaggtgctgtttttatagaggggaataacagttgacggtataatattaagttcttaaatttttggagcaaggagaatttttatgaaaaggatattatcatttgcagtagcaatctgtatggttctgtctgtttgtttcgtcagtgtgtccgtttttgcggataatgcggaactgcagggtaacgctttgccagcctttcccggagcagagggcggcggtaagtttacaaaaggcgcacgcggcgtattggatagcggtgaaggtaaattagaggtttatcatgttacaaatttaaacagcgagggtccaggttcgtttactgacgcaataagccagtcaggaagaattgttgtgtttgatgtgggcggagttatagacgttcctagtaccgtttatatcaataacgataacataactatcctgggtcagacagcccctggtgatggaatcacacttacaggcggcgatttgcgtataggcaatggcgtgaaaaatgttattattagatatatgcgcgttagaccgacgaataaaaatggtcaggaagttgacggcttaggcggtcaatggaactcggatattattattgaccattgctcaacaagctggtgtgttgatgaggggctgaccctttatgcaggttcggctgaatctgatacatatgagcagggaaagcgtttgacagttcaaaatactatcacatctgaaagtatgagaatgtcggggcattttaaaggcgcacacggttatggcgcaattattggaggaaccaacgccacatattaccgcaacttgtttgctcatcacgacagccgttcgccgagacttgacagagttctgcaaaatacagactttagaaataacgttgtctataactggggcgtaaccaactcagcctatggcggcgagcctacttcaccgcataataaggttataaatccgtcaaaggttaattattcaaataattattataagtacggtccgagtacagtttcaggcaagagataccgtatatatgattttgcaaagatggctaaagttattgacggagtgacttataagagcaaattctatatgactgataactatgtggttggaagctcaacggttactaataataactggtctaacgacggcaccaacagtgcggctgaccaggtggaaaaggttgacacgccattttctttaggcgatgatttgtatccggatttgaatattgcagaaggaaatatattgcctggaaaagacgtaatgtcaaatcttttgcctgacgttggagctactcttccaaaaagagacgcaactgacgctcgtgttattgccgatgttttaaatcagaccggaagaattattaacaatgaagaggaggtcggaggactctccgatatcgaaagttcacagagaacctttgaaatccctgcagattggaaagctgcaaatggtatgggagccggcgccgctgaagctgatatagtgacaagcggtgtatgggcaggatatacatgggttgaagcttatgtaaatgattggactgagcagcaaagcgctcaggctccgacaaatcctgaaatagttgttacaagcccggttatcgcttctataaacagcaccgttgatggtcagactgttcaaaagggaaactggactgttataaaagacacggatacattaagttataaagcgtctgcaaaagctgctgacggaacaaatataacaaaaatggaactttacgatgacgagtcattgattaaaacatacgacggagtttcttcaatagatgattcacttcctctcggtataggcacacattatctgtcatgcgttgcgcataatgataaaggtgagaagaccagaagcactatttcgattgtttatgtaacaggcacaaacaagcctgagggctggactcagaaacaaatcgggccgcctgcatattcgggaaaaggaatagtttcatatgatgctgatacagatatttatactatgggcggcagcggtaagataggcggaaagtccgataagcttgattttatgtataaagaggttacaggcgactttgacatatctttaaaaatggaagatataatggcaaatgagaatggagcagttttgggactgatgctccgtgaatctcttgacgccggttcaagaatggctgctttggtagacggctggataaaatatggcagaaatgaccgtattgttgcccgcactactaaaaacgccaatatagccatcgatagtgaaaattccaattctactgataataaaatgggaatatttatgagaggcaaggaaggcgagatagtttccggtaacattttgggtgaacacccttatgatacagctgaaaacggaaaatatcatttgccaaactatctgagaatacaaagaagcggagataatcttttgttctcagtttcggacagcggaactgactggaaagataatgccagacagccgtatacaatgaaaataagcggtttggcaaacaaactttatgtcggggttgctattgattcacagcagggacagtctgacgcatcgccgcaggcatattactcaatggcgaaattcagtaatttaaagcttgaaaaccagtcgaattttgacccgggcgctacagatgagccggttcctactcctgacgcaggtctcaccgattatcctgattggaatgttggtcaggttagtgcagctggaactgacggagacgctgtacaaattgagtatgaaggtaaaacggctgtaaaaattaacagcagaaatatctacacagctctcagcgaagtgaaaaattctgatgtagtaacttttaatactgatatgtatctcagtccgtctgataaaaatggattcagaatatatcttgaaaatgataaagcaaagaattatcaggatagttcaaatagtttaggcggagtgtttgcagaggttttaaattcctcaaatggttctttgtgcgtaggtcctgctatgggagccgcaaatgctgtctatgacttttcaaatgaacaggcagggtggttcaatattgacatcactttggattatactaaagaaagcacatctgataattttattacagttataatcaaaaatgcggcgggagaggaagtagtaaatacttcaatgcccgctatagacggaattgattccggtttaaagcagattcgtctgattgccagaagtgctcagccttattttgcaaatatgacagtagagacaaaaccggcaggagacgtaattgtaaatgggtatcagaaaattgctgccggaaccgggtcggttactttaaagaataatactgatgaaccgaagtctgttcaggtgtttgtcgctcagtatgaaccgaatggtaaaattattaaaaatgctaagacgaaaaccgcagtgttagatggcggagcagaacaaacaattacttttgacggattattacaggatggagcaaaagtgtttgtatgggacgaaaatttaaatccttattgttctgtgtttaatcttacagcagaataagagtttagttatattttaaattgtttataagtcaaaagtcacctattggtgacttttggcttttttatataatgtatattaagatactatcttgactaaataaaaataagactggactcgttactatcacgaatccagtctttaattatatagcaatagcaattatttaattacaaagcagtaataatttaagcaaatgggttttcgccctcgtaataacatcctgcaggacggttccattctatatcagtaacgcccaaatattttactacttcaaacaagtctttagcggcgtgcttgaatgctatacctgcgtgatgaggatactgtttattgattaaaacgttgcggtagaatctacccatctcatttacagcaaatactgcaatgcttccgaatgatttcgggtcaacgtctattatctcagcattggcaatgtagcttctgagctgaccgccggctgtgctttgaagtctgaataaagttacgtctccgggacgaatattaccctctaatgttcctcttgaaacattaggctcaggaagttcaggctctagatttctcttttgtatcaactgatattttaaagcataatcggtcaataaatcacaagcagtatttccgcagtggaagcccatgaatgtgtcctttaatgtataattgctgaatttatctgaattagcttcaaacatatcttttggaacagagttgttaatatcaagcaaagtaggagctatgccggttgtgcaggcaataataaattcagttaatgctccatatatatctgtttcacaagcaacaggaataccttttgatgtaagacgggaattaacgtaacaaggacagaatccaaactgagtttggaatgcaggccagcacttgttagcaaacgcaacatatttagaagctcctttgttagcttcagcccaatcgagcaaggtaatttcatattgagcaagtctagtaagcagtgaaggatagttgtttcctgacccaagttcgtctgccatttctttagcaacagcttctatcctaggatcgccttcatgttcattaaatgaagccagtaaatcaagttcagaattttcctgaacattaacaccaaggtcaaacaatggtttaattggagcgttacatgcaaggaagtcataaggacgcggaccaaatccaattatttttaagctctttacaccaataatggcacgagcaatattttcaaactccgcaatcatatctgcaacttcatcaggcagaccaacaggatattcaggtatgtatgcttttaagttctttaggcctaagttgtaggaagcgttaagaactccacagtatgcgtcgcctctgccgtctattaaatcttcctgtgtttcttcagcggctgcaacatacatgcagggaccgtcaaaattcttgcaaagataagtttcaggaccctcaggaccaaagttgccgagatatacaacaagagcgttaactcctgccttatttacttcgtcaatagcttcaagcatgtctgtttcattttcaacaatagtctgtgcttcatatatgtcaatattcttgtccgcacaagcttttaccacatttatacgtcttttcttgctaagctcaatagggaaacagtcacggctcaccgcaacgatacccagcttaacttccgggatgttgttaaacatttataatacctccacatttataatataaaattcaatttccatagactattttaatataaaaacacggcgccgtcaacataaaaattatttattttgcaatattttcacttttatcttagctacacgccggttttccatttctatgacataaatatgatgtccgttatattcaaaagtgtccccgagttccggcattttcccgagtttctccataacccagcccgaaacagtatttgggtcgtcgtcaccaggtttttcgtccatcagtttaaggaagtcatccaaatcagtacctccgagtatttcataaatcccgtcagacagttcagaaatgttttctacaaccttgtcatgttcatcccatatttctcctacaagctcttcaagtatatcttccaaggtaagaattccgtctgttccgccatactcgtcaattactacagcaaaatgactttttgaattctgcagaaccctgattaattcggaaatgcttatagaaggggaaacatatataaccggtgaaattatttcttcaatatttccgccgctgtttttttgtattagatgaaacaggtctttttgatgaacaacacctataatattatctattgtatcccggtaaacaggaagtcttgaaaatccggattccaaaaacgtttcaataatctcttcagttgacgtatttagttcaagcgcgcacacatcaatacgcggggttaaaatatccccggcttccaaatcgttaaattcaatagcgctttttataaggtcgctttcatcagcgtcaatttcaccgccgctttgggcttcgtcaactatagtcaaaagttcttcctcggtaataccgctgtcgttttttgatttaaaaagcttgccaagaagttttttccacaatccaaacaaataatttattggagttagaataaactgcagaatcacaactattttggaaacagcaatcgcgtagccttcaggctgttcttttgcaaggctttttggtgatatttcgccaaatataaggactagtattgtcataacaatagtggatatagtaactccggcgtttccgaaatattggacgaaaagaactgtcgccaaagaagacgcgagtatattaacaatattatttcctattagaattgtagataaaagtttgtcataatccagggataaacgttcgactaaaagagcttttttattgccctcttttgcaagatttttgattcggatacggttcagagaagaataggctgtttcagtggcagagaaaaaagccgagcagccaataagtagtacaagaataataacaagtccaaaagaactgtccataatttttttgtgcgcggaggtttttgccttcggcacaactcctttccttgataaaaaatataataattgttacataagaataatcctaaatagtatatcataattggcaataaaaagcaatagcaaaatggggaataaatctttaataagtgtaggattacaatagatgtgttacaaatagaaaaaaagaatacggaaaactcataaattgtgttatagttatatcaccataatatcacagttataaaatactattaagtgtttatgtgtgtgttttcggtagttatatttctttttaatacatctattccattatatttatttattttaaaacgagaaagtcccacaatcgtcccatgaattttctctcatatacaaattgattgccaaattagtacatataatatacacaaaaagacaccaaactaggtgtctttttttaactcacctaaacgattacgcgagtttaactctgacacagaattaggaacacgaaccaacaactcgcttaaatcataatttaaagcttcacatattaagtcaatctgttctaaacttactcgttctgccatttcatgataaaggtcatttatagtattaggtcttatccctgttttccgtgcaaggtcagcttgtgtccatcgaagttcgcctaacttcctagacaataaaattctaatcattgtattgctcctcttgatatattataccaagtagtgaagcaatttatctgtgtttgttattttatatcgatatttgttattaatatatttattgacattcaagcacggcttttgaagctgtgcttttttattaatgataaattttaatataaattattaatcacattttataagaatatctgaaaaacagagtttatacgcaatatgtaacatatagtttaaaatatattattgatagaatattcacatattttatagattggaagtgaaatgctgaacatattaaaaatatgctttggaaaaacattatactttagaaaaattgaactaaaattaaatcaagagaaaatggcagagagatgttgtctgtcaccacgtcaatacacagatttagaaaatggaaaaagactaccatcatttaggagtttaattaatatcataataaatggtggcataaacataaatttatttattgaagaaattatcaaagctggatacgtacctgaggattatgttggaaaatagatattatatttttaaataaatataaataggcttcttcaattatttaagaagcctattccacttaaaacttttatatattggagttaatttatataaatatcaattttacttaaattattctcccattcaattataaaattagtaacatcagctaaaatctcatttaatattaatcttttattttttatattatacactccacaatactttatatccaaatgattttaatattgtcttattgccacttaagaagattttacttttattaaatgatagatcgacatagcaattatcacaatagtagtcggaactcctaataataaaccatatataccacttgggacatctcctataaattctccgtattgtattttgtgaaacactaacatcataccaacacttatagttattacccccaacatacacaatattcccactggaaatataatttttttctattgataaaaattatattaataatcaatagatatatttgtcttacaattaatatccataaccacataagattattttccatcgcattataccttataggtatatatagcgcatatatttctattgatagttcaattatcaaaggtaaacaattcaaaaaccaatacatatatttatacctcctaatattaaattatgtagccaacaacagaattagataatttgccttataccaactttgtgcccactgatttcctaaactatatagcaaaacataatttataagttaataagatacttttttcaaaagtaaattcattattcataaacatttaagtaaataatgatatttggttgtttagtataactccgaccacataatttaattcagttaaataactatttactgatcctccgttagctagaatccctgcacctaattatgctacagtacattgcaaacaattgttattataaaaattatatagcgaattttttctttaaaaactttactatttaacgttaacgtgcaacaactgaacttgcataatttgcttttactccgacttgcgcccatggacttccctgcatatatagtattgtataatttaataatcttgcaaatgcaaattgacgaataaacgaattattcataaacatctcactaaacttttcagaagcgtattttggaataattccccaggtgtatccacatgattccatgtaatctgagaccaacatatcgtttgccaaggttccctcaccaaatgaatcaatagtgctctgtaaacaattatttgtaaatacattatatgacccgttatctccttgatatattacactatcatcatcaagctcatgcaattctgcatttccttgaattggctctatattataaattttacgatactctgctcttaatgaatccaaaaaatctccaaacacataggtagcacaatcatagtttgatgtaatattagaaaaaccattatcggttaaaaattggtttaaaccagcattgaaatcttccagtgaattcatgtactcatctggaatgcgtattattgccgctgccttatctccccaatatgtataaaaccaatttccattatcatcttgatatatagcagatgtatgtccttgttttcctaaaggtcctaaattaacagcattgctatttgttaatattattgcatctaaaccatttggatcagttaaattgatagggtcattttcacaatatacataccaattaacgccatcttttgctgggtcttcctgagtgaatctccctatacttgggtcataatatctgtttcttaggtatatcaatccagtctcttcatcggtatattgtccgttgtatctgaattcgttgctgtctgcttctcctcctgttcctgatactaaacctccgaatgcgtcatattcatcgctgccgttactgcaaatgatgtactttccgcattcttttctattatgtttattgtgtctccgtggacgttatatgagaagtatctgctgttgcttgcgctgtctttggtctttactatttctcctccggctcctcggatatacgtctttgttccttttgttccgtattcggctattacgtttccgttgttccagatttgtcctgtgcttaatccgtttactgtctttcctattctcgttcctgttccatatttgttattaatatttctaaattttaatttataggattcataatgcatttattgacattgatatatagtattattagttactatctttgctcataataataccaaccattatttttttcatcaagtgctcgaatagcagttattaattcatgtgttggttcatttgtagcaaaataatatttaaaataagctatcccatatgctctaatacctacataatttttatttaaattgcctcgataaaataaaatagaatttcctcttttagtaattgatttaaatttatttttaaaaattatgttaattttttcaagtgataaatttattccatatttatcatttaacacttttcctatatcacttacattatctttgtctatataaatatcctcagtataattcattagttcatttgctacactttcaaaattgtcacgatttgtttcatatgcttttgcaatatttttataattatccaaattactatgtaaaaataacaataacactaaaaccaaaagtgcaccaaaaataaacgagataacatttttcataataattaccctttcttcttgttatataaattaaatcctttttgtatagcagctttatcttctggagtatcagcagagtttttaataccgttccatcctcctgcagcatagtctccaccccaatataaaacagtttcactaaatccaatacatcttcctaaatatgcatacataatattgcccatctcctccgggcttgaatattctccatataatattactgtagaattaaatgagccaggatatgatcctccaaaagttcgatcccatgattcttgacgttttatatcccaatctcctttatgatttactttattataaaatgtaatttgtttatctccttgccatttttcatctagcatttgttcagaataccacaactgatcattaaacattttagtaacatcaaaatattgtgctcctgttgcttcagtaaaaatggttactcccctgtctatatctccctgtgttctatatattaatcctaaactttgccatgtagttaacccaaccactccgctaaaagctccatcattccataaacccctatcatttttatatgcatttactgcatttaaagttttttgtccaaaatatccatctctatcattggtatttaaatatcctaaatatgccaactcattttgtaaagcaattacatcttcactatatcccatgccataatataaagatgtattataatcaaataatcccaatggatcaattaaattaacaggatcatttccacaatatacataccaattcataccatcttgaacggggtcttcctgagtaaatctacctatacttgggtcatagtaacgattacgcaaatatatcaatccagtctcttcatcggtatattgtccattgtatctgaatgcgttgctttctgcttctccgcctgttcctgataccaacctccgaatgcgtcatattcatacgctgctgttactgcaaatgatgtgctttccgctttcttttctattatgtttgttgtgtctccgtgggcgttatatgagaaatatctgttgttatttgtgctgtcttttgtctttactatttctgctccggctccccggatatacgtctttgttccttttgttccgtattcggctattacgtttccattgttccagatttgtcctgtgcttactccgtttactgtttttcctattctcgttcctgttccatcatatgcgtatataaaatgtactctagggcaagtaattacttgccctaggttaatttattaatcaaaatcctccatatataaaatgccaccaatatggccatattacatcagatgcacttcctgtacttgaccatactgtttgttcccatttattaaacttccactcattattttctttaacaaaagacacaatattaccaccggctctatgttttgatacatagtatacctctgcatattcatttgaataattcaatacctttaaataatccagttctcctatcatcgtcttttctttatatatttctccaaactctgaaccatgcattattgttaatacttcgcatcttattaatgcacttccccaatttatcagaaaatatataattggtaataatataattattgtcactgctattttaacatactttttcatagtttctccttttttatattcctaataaatcacgcatataataatattcatttcttgcatttattccaaaaggattaggagatggatttgaatgtggaggatttatttctccttgattattgagtgtagccaacattgctgtgtcttcatctataaccgaattcagagtaactatttagaaaatagatatttttatgtaaaaacaataaaacttaccatacttttattatttctgcattactcttgcgtattaaagttgtatattctttttttgcaaaatccaaatttatttttttgtttaatttaaataacttgtcaatgttaattttactacattgtctaatctggaaaaactcatcttcattttcaccttcaattgcaacaccttttgcatcacttatatatgtatatgtgccattttcgtaatcatttttatgccaatattccattatattatttttattagatctttctatataacaattaataaaaatacttaatgcgattttagaagcgcaattttcatcgacataaggtgaaacctcttttttatttaatatgcacttatatatctttccattatcattatcaataaaaattgataaaccttcttctcttaacaaattatttaaattgtaatttaatactttagataaaccaaaagaaaaaaatttacttttactttttgcgtttattttatatactttttttccatcaagttcttcattatttacataaaaagttaaattatcaaaaatatcttcgtttgtcatatattctccacgcattttcacttctttttttattgttgaaattataattgattttccaatttctaaagcggtttttttatttattttataatctatatttttacttccctcgtaatcaactatcttctgaaaatcataatatggagttatatttataatcgttttacctttaacataatcaactgttttatgcttatcatttaagtataaattgtttatagcgaatatatttattattaaaacgctaataaacaacaacattacaaatattatatattttttcattttaatacccccttattgattttaagtaataattgtattcaatctcatcataaaaccaattccatttatttctaaaatatacatctgcatttctttgttcactatatgttagatgcctaaaaccataatctgaacctacagcctctaattgatagcctcgaccatcatcataatcctgaattttactgatatcaacaccatcactatattgtgattccccaacaacatataatatagaataattttgatcaatagctaaatctaaatcttgattagataaacggttagttacagtatgagaatgcactgcaccaacaatatattgcccttcattaatatgagtatttaataatgttgtttgaacataatttggttgaccatcaacacattcagtataagaatagtaaggagtattatattcatcatatgccaaatatataagcgaagcatgttcaatcattgagtactgagttatcccataataattccaagcccagtcaattgctgcttcatctggagtagcaaaacggtcacctgctacagtaccaaatatatcatttaaattaacggggtcattagcacaatacacatataaattagcactttgaactatagcatggtaatccggtatctttacttctccttcttcaaattgttggtctccatatatcatatttcctggattccaatatgggtcttcttgagtaaatctacctatacttgggtcatagtaacgattacgcaaatatattaatccagtctcttcatcggtatattgtccgttgtatctgaatacgttgctttctgcttctccgcctgttcctgatactaagcctccgaatgcgtcatattcatatgcttccgttactgcaaacgatgtactttctgcattcttctctattatgttcgttgtgtctccgtgggcgttatatgagaaatatctactgttgcttgcgctgtctttggtatttactatttctcctccggctcctcgtatatacgtctttgttccttttgttccgtattcggctattacgtttccgttataatttttttatatcctatttaagacaccatatgatatcgcctcattttgatgttttggtttgtgcgcaatgagcgacagcaacatttttatatcgtcacagccgctcattatttctttctttatttaaacatatcttctatggctcttcaattatgtttactacctcccattttccatttattttttctattttccattttgataaaatgttccatgctccatatgttcgattgttatccttatcatatccttcataagtatataacatccacatatatcctttattaaagttatgaagtacaaataatctatttaattttacatcaacttttacagtaccaaaatctccttttctattgtattgatccaatggcgtattctgagtaattgatttttcaacatttccgctcataatattttcaacattgttcacaacagaatttgtattcaaaaaaatagtaagatacattattagaattataacaaacgctatacataagctatatctaaaattcatttttgcgcattccttctcaattattaattaatatatcctctaacagcttcatctcgaattctaataatatatactaattcaccgcccaatctatttgaaattgcttcatcaaccttttcatttgtatgagctgagtaatatatctcaccattctcaacttttgttacaatagctgcatgatgtggattagctccatcttctccggcccaatatatcaaatcaccaggttgtactccacattttgcaacatcactgacaccctcaggagtccaaattgttaatacatcaccattaatataaccattatatggattgctgaaaaattcaaactgagctcttgctagtcgccatggttccgaaacccaccattcatacttatcattatttgttggttgccaccaatcatctgtattatatctatatgaaaaccattgagaatttttcaatattccaccagcaagcaaacattgagatacaaaattagcacaatctgttcgataattataaaattcctcatttcttccaccaaaatatcctgcatttccatattcacgagcataattaacagctgcccatctattatatagacctgtaggatcaactccattaacagggtcattagaacaatagacatataaattagcactttggactatcgcataataatccggtatctttacttctccttcttcaaattgttgatctccataaatcatattacctggattccaatatgtatcttcctgagtgaatctacctatacttgggtcataatatctgtttcttaggtatatcaatccagtctcttcatcggtatattgtccgttatatctgaatgcgttactgtctgcttctccgcctgttcctgttactaaacctccgaatgcgtcgtattcatatgctgctgttactgcaaatgatgtactttccgcattcttttctattatgttcgttgtgtctccgtggacgttatatgataagtatctgttgttatttgctctatcctttgtctttactatttctcctccagctcctcggatatacgtctttgttccttttgttccgtaatcggctattacgtttccattgttccatatttgtcctgtgcttactccggttactgtcttccctattctcgttcccgttccgtcatatgcgtatgatgccgtcttattcgtatctgtataactctttagcctattaaatccgttatattcgaaactttcatacttttcttcatatatttcatatgatgaaccttcgggtggataatcatcgtaaaatactactgtatctcttgtgatcatatttccatttttgtcatatgtgaatgttttatcttcattcatatattcctcataatcataagaacttcctgtcaacctgttattattatcataataatactgcgtataaccttctccttcttcatacgccggtcttggtcccgtccaaatcattagtgacacttcatcctttgtttgttctttgcttattcgatttcccctttcatcataactatatattgttgttattttttcatcttcattgcttttcttatttagctcatttacttccgttttcaacctgccggcgctgtcgtaggtatagccttttgtctttccgaatatgtccgtcactgacgactggttcccgtccaggtagtagctgtagttatactccgagtatgttccctttatgttttgcagcgggtctgccactgtttgattgcttacctttttcggcaggttgctctcattgtactcgtagctcgttaccattgtgtttccgttggttttcttttctgtcaggttcccgttttcatcataactatacactgccaccagctcgttttccaggttatcccttacctctttcatctttcccagatagtcatagctatagcttatgttttgacttactccgttggttgagttcagtatcagtcctgtttggtttccgtctttatcgtatgaatagctcagcgtttctcctgttgtgcggctttctcccgtcacttgtccttttctatcatagctgtaggttattgtggccgcttcgtttgctatgctcagcagcgctgtgcttgtgtctgcgtatgtgtaggttgttgtctccgtttctccgtctctttcgcttgttgctgacagagggttgtttattccgttatacacatttgttgtcactgttccgtttttgtctgttttgcttacaatatttccgttattatcgtatgtataactttcactgtatcccattgggtctgtgctcgaaatcagtctgttttggctatcatactcatatgttgtgcttactcctccttctccgttcactgaccctgttatcatctttgttatgtttccgtttccgtcatactcatacaatgtctctcccggctcgtctgtgtatgtttttaccagtctgttcatattgtcgtattcataatacacatttctgtacgtcaacgcttctcccggcttattgcttgttatgctttcttttattacgtttccgttattgtcataactgtagctttttatgctgtctcctccgtctattctgctctttacttctgtctgtcttccaaagtcgtcatactttgccgaactctcatttttctttggatctattgtctttacttcctgacccagcatgttcttttccactctggtagaattatttgtatgtgatattatggtgatataactataacacaatttatgagttttccgtattctttttttctatttgtaacacatctattgtaatcctacatcaaatagattattggacataattgtttattgattttaatgcaaactgagtgtataatggtatttgaattgaataagaataaaaaatttttttgaaagcaggatgtttatatggtcaatgctgataacaatctttacaatgagtttttggaaattgttgaggatttgatttatacacccgagtttagaaaattagacgagtgcagtcatcattacggcgtgagcaggatgcagcactgtataaatgtagcatattatagttttgttgtttgcaagaagttaaagcttgattacgttgccgctgccagggcaggattgcttcatgatttgttttactacgattggcaggggtcagggctaggagttgcaaagcatgcgtttctgcactccagtatcgctcttgaaaatgctgagcagttaacagaattatcaccgcttgaacgtgatataattaaaaatcacatgtggctgtgcggcaagatgtggccccgtcacagagagagttatattgtttcggtagctgacaaggtttgcgcagtatgggaagccggatatggagttaagtgcaaggtagcctgcgttatggctgagtaaggaatatggttaaggaagatttaaatcaaaagagacatgaaattcagaaagaagaacttgagatttataacttaaatgaaaagatagttgataaaatgtcgggctcggattctgaaaaagttaaaaagaaatttttggtttaccaaatattattttgtctgatggcaattttcagctttttgatattaataaatcagtttcttggaaatataagttacataaagcagccagtgtggctgataattgaagcggctttatggctgatttttctcgctgattatattgttcggctggcggtttccgatgacaaaaagcagttttttacacggaatatattagattttttggctgttctgcctttgcccgggtttagagtttttaggatttttactctgttcaggatgatgtttgccgtgaaaagggtgcttagagcagtacacatagttatgaattcaaacggatttttatatcttttaggggcagttgtggtgtggatgctgataggctccgcatttttgtatcattttgaaaacggtataacgatgaattcatactttgacgcgttatggtgcagtattgtgacggtatgtactgtcggatacggcgacgtggcgcccataactgcaggaggaagagttgttgcagtgctgttgatgatgacaggtataggaagtataggaatggtgaccagcaacattacagcatattttgttgtcagggcaaagaaacgccgtgtagtgattgacaaaaatcaaattttagatttaagcatggtatcaaaggaaaaatatgaaaagattgccgattacgcaaaatatgttctgcagcaggataataaagatatagattagaaaaatataaaattaagttatgagaggagaaaaacttatgaaaaagttaatggcaatagtgctgacaggagttttagcggtgagcgttttggctgcctgtggaaacacggataaggataatgctgaaccaaccaaagcgcctgtatcaaactctgtaaaatctgaagaggataaggcaactgcaaagcccgacactgataagaaaacagattcagacaaggacagcagttcggaggaaggaaatacttccggtgacaaagatgatgttaaggcaaaagccggagacaaagaagatgcggacgcaacagccccccctaaacttcagacagcagatgaagccgctaacgacactactactattgataaagagatagcggatattgaacagctgattattgacggaaactatgacgacgcgttaatgcagattaaggctcttaacacaaaaaatctaactgacgcggaaaaagagaaagttcaggagtattacgagaaaatagaagattatatttcaaacggacttactgactagcaataaccaatgaggctgtaaaaaattataatccagccgtaatatagaataataaatcataaaaagaccattgtattagactataacaagcctcttacaatggtttttttgtaaggatttttatagcgcaattttaattataaacacaattggatttctataaaaagaataaaatatttaaaacattaagtttaagatttaggtagaaatttttatttaaattttaaaatagtttttggttgtaactttttattactagaacttttttaggttgtttttaataagaatatgtgaatgctgcaataaattggatagaaattttaaagtcataatatgataaaaaaatatttaaattatagaaaaatgcggttttgcaagcgtaggtaggtgcgattgtacccccgccttacaggagtgtgttatacaaactgccttgttttcattaactgaaaagtcaataaaagactagacaaaaatttataggtgtttcttggtgaacatcggcagggtgtgcgtaagcacacctcgttaggtgagctgtcatttcacgcgtagcgtgaacatacttataacaagtttgtcgtaatcctttttaataataaattttaaaatttctattcaatttatttcagactatccaaacatgattggatttctgaaaaaggaaagaaaatttataacactggatttcagatttaagcaagatatttagtttattatgttttaaatagaaattgttgggtatactctgattgttaattgaattattattagttatatttattctgtaaataaaataaattcataacaaaaattcagctgaaatatttctatttggctaattaagactaaagaaagaatgtatatgtataataagtatatcatacgtatgtataattaaaaatttgtaactaaatttagcgtaaaatagaatatatttaaattattaagtgatagtattttttgtcgaaattgattttttgggaaatttataaaattttccttgacaagtaacaatggttgtgatacaatctgtacataggtcatgattctcatcctgtgaatcaatgacagaaattttaggaggtattgtaatatgacaggaaaagttaaatggtttaatgcagaaaaaggattcggtttcatcgaaggcgaagacggaaaggacgtattcgttcatttctctgctataactatggatggttacaaaacacttgatgaaggtgttgcagttgagtttgacgttatcgaaggtgctaaaggtccgcaggctgttgacgtaaagcttgcgtagtcttttaatatattttgattgactgaaagattaactaagaaattatagctgctcctgccggggcggctattttttaagatttaaaacaaatgataaagtaaaataaattatagttggaggaatacttatggacaagctgattaaagcgattactaaagatggctttctaagagtacacgcggttgaaactactgaaactgttaacgcagctcaaaaatttcacacgctttccccggtctgctgtgccgctcttggcaggctgatgactgccgggctgatgatgggcgccatgcttaaaggaaaagaaccgtcgctgaccctgcaggttaaaggtgacggcccaatcggaatgatggcgtctgtatctgattctatgggcaatgtgaaaggttactgtgctaatccggttgtggatatttctttgagagaagacggaaagctggatgttggagctgctgttgggcaggggatgcttggggttataaaggatctcaaaatgagagagccgtatattggtcaggttccactccaaaccggagaaatcggggacgatattgctttttattatatgcagtcggagcagactccgagcgttgttgctcttggggtgcttgtggatcgtgattattccgtaaagtgcgccggagggtatattattcaggtgatgccggaatgtgatgacgcgacgcttacaaaacttgaaaattctattcaggggcttatgtctgtaaccgaaatgctggataagggtatgagcgtcgaagaaatgctgaaatatgttatgcttgggtttgatattgagatattggaaaccatggatgttgggtataagtgcgattgttcaaaagagagaatggaaagggcgattgtttctttgggcaaaggtcagattcagagtataattgatgagaccggtgaggctgaaatatgctgtcatttctgcgatagacggtacacattcggagaagaggatttgaaaaaatttcttgaaacggctaaataaatataccttaaatcatttgacaatgaaaaatccttgtgctataatttacctattaatatatgtgaatatatttgcaaatataattttaggaggtttttgaaatgggtatttcagagaagtttacattaaaagataaagttgctctggttacaggcgcttcttatggtattggctatgctattgccagcggatttgccgatatgggcgctaagattgttttctgtgatattaagcaggagttcgtggacaagggtctcgctgcatatagtgccgacgggattgacgctaagggttacgtttgcgacgtaactgacgaagctgctgttcaggaaatggtaaagaaaattgaagcagaagttggcgttattgatattcttgttaataatgctggtataatcaagcgtatccctatgtgcgatatgacagctgaggagttcagacaggttattgatgttgaccttaacgctcctttcattgtgtcaaaggctgttattccaagcatgattaaaaagggtgccggtaagattatcaatatctgttctatgatgagtgagctcggccgtgaaactgtatcagcttatgctgctgctaagggcggacttaagatgcttaccagaaacatttgttcagagtacggcgagtacaatatccagtgtaatggtattgggcccggatatattgctacacctcagactgctccgcttagagagaagcagccggacggttcaagacatccgtttgaccaattcattatctctaagacgcctgctgctcgttggggaaatcctgaagaccttcagggacctgccgctttcttggctagtgaagcttcagattttgttaacggacatattctttatgttgacggcggtatcttggcttacatcggcaaacagccgtaaaccgaaatttgaatattttttgagagacgtttatcgtctctctttttttatgtatggtaatatttcgtttgaaaataaagattgttaaaaaaatatttatttatctaatataaaaataaaaatttgaactcgactgatattataaaatgctgtatactaaaactcatagtgtgtatttttgaaattatgacggaggattgttttatgtttgtgggaaaattaaaaagacgtattgtgaaatcagttcttggattacttgccattatctgtgtggtgtcagttatggcaatgtctgttactgtttcagctgaggagaatttattggcgtttcccggcgctgtaggcggaggaaagtataccacaggagccagaggagatagcaatatttcagtataccatgttacaaatttgaataagagcggagcaggttcatttgctgacgctgtttcacagtcaggcagaattattgtttttgatgtcagcggaacgattgaaatcagcggaacgctgaaaattaagaaaagcaatctaactattttaggtcaaacagcgcccggagacggtgtgactatttcaggcggggatttacttcttgacagtggagttgaaaacgtaattataagatatctgcgcgttcgccctactgataaaaacggcggcgaacctgatggtctaggcggaagatataataaaaatataatctttgaccactgcagtctttcatggtcggttgacgagcttattactttatacgccggttcaaccgaggacacaaagaatcagacaggaagaaatattacagttcagaatattatagcttctgaaagcctggctatgtcaagccacgttaaaggcaaacatggatacggcggtatcatcggcggaacgaactatacattttataataacttaatggctcatcacgacagccgttcaccaaggttggacagagagctggggtctactgatattgccaataatataatttataactggggacagacaaattcactttatggagcggaatcatactctatacataataaaacgcaaacgccttcaaatgtaaatatagtcagcaattattatatgtatggaccgagtactaagagcaatctgagaacacgaatttttgacgtttctaatgacgcaaaggttaagccgtactctaatttttatgttaacggcaactatgttttcggaagccagcttgtgacagcagataataaaaaaggtttgaataatagttcgcttgcaactgtattagaatcaccggttgatatgggcgaatattctgtgccttactcaacttctgaggaagcatatgataagattttatctgacgcaggagcttctctgccaaaaagagacgctattgatgcaagaattgttgacgatgttaagcatcagacaggaagaattattaataatgcggatgagatagccgggttgataccgacagaagaaattcacagaacttttgagatacctgaggactggaaagctgaaaacaatatgggcagcgcttctgaaaccgatatagtggaaaatggggaatataagggatatacctggatagaagcatatgtaaatgactggacagccaaagcttctaagcctgctaatcctgagattgtcgttatgtcgccggctattgcgtctgtaaataagacggttaatgggcttactgtaaataatggaaattggactgttgttaaggatactgaaaccgttaattatcatgcggcagctacgccggttcaggggactgaaataacaaaatttgaactttacgataaaaatcaattgctgaaaacttataactcggctgaaattaatgatgatatatctttagagccgggtgtacatcacttgaccagccgtgcttataattctaatggagaaaagacacagagcacaacagctatagtatatgttgtcggaacagccgaacccggaagcttttcatatacgcagataggaaagaactgttctttcaataatctagccagcgcaactatggataataacggtgtttatactatttcgggttccgggcagataactacaaacagctcggataagtgcgcatatatgtataaagaagtcaagggagattttgatattattgtcaaagtaaaggagatacctaagtttgaaaataaacaggtttcgggaattatgcttcgtgagagtttggagccaaactccaggatgcttatgctggctgatggttgggaaaagtacggagaaaatgtaagtgtatttgtcagaaacaaagccggaagttcatcaaccagaagttatttcaaaaatgcttccggaagcgaacttgtaaacggtgataagtacgataccggtgcagccgagtatcacctgcctaagtatttgagaatgaaacgaagcggtgataaacttacaatgtcggtttcggacagcggaatagactttactgataatccgcggcagcctatgagttttacaattgacggtctatctgatactgtttatttaggaattgcgaatgattccactcagggaacaagtgttaaggaatattactcaatggcaaaatatagtgatatttctattaacggcgtcagcgatgttcagagtcaggagtctaaggttcctttccttgatgaagagtttgatttagatacttggtatggcgaatatgtttttaacgatgataaaaggtcagaaccaatatcaggaaacagcggttaccttttgtcaacttggtcaaacgccaacaggaattttactgctcagtcaaaaggtatagtaaccgcgtcatttgacttcttagaatatggagataacaataaaataggcagcgctgaatttattttgagaggaacaaatgcggataatgaacttaaagagatgataaaagttatagctgagagagaccaaacatttaaaataggcgataaatctatcggtgatttagttcttgatatggatgtttggtataatgtcagcattgaattgaatttctttaccgggaaggcaaaggtttctgtatatccttatacggagtatgacagcacagaaggaaaatatattctatctgaaaatggggctgaggccgagactgattttgataaatcttatttattgagaggaatacgctttgttagaaacggcggaacaatgaagtattatgataatgtttccgtcagcgctgaaaggaatgaatcgtacgttaaagagaataatggcaaaatggatgtatttgctatggaagatgcaaaaatgtatgtggcttggtatgataaggatggagttttgataaatgctgagacttatgatatacctcagaataaggaaatggagtttgacttgccaaaattgactaacggtgtttcagagaaagcggaagttttcctttggaataataatcaggagccgttatgtgagcagttgactgtagagtaagtaatataatatttatagaattgaagtgctgataatgaaaactaagttaaaaatttgtgctgctgcactgctggcgtcggttgcgataggcgcaacagtatatgctgctaatttgacaaagaaaatagacgtcctttatgatgatataagaatatcgtcaaataatattgagtttatgccggttgatgagcagggcagtcaggtggaaccttttatttatgagggaaccacatatctgccggttcgcgctgtttcggaagctttaggtaaaaatgtttcatgggacagtgagacaaaaactgttatggtaactgataatgaagatattgaatattctaaaatagcaatcagaaacttttttaaattgttttctgaaaaacggtatgatgaaatgaaaaattttacttcaggctcagttgccggatatgagttttcagaaggagttttcggaatgaaggaagcttctttggacggtataatttatgcaggaaataaagaacttgaaaatgaaaataaatttgcttttatttgtcattttaatatgacgcctgctgagaaatcagtatatggcagcagtgaaagggaaatcggattttttgtagaggtattaaaagacagagatgaatataaaataaatgatttttataccggtctgtaatttagaaagatataataaacaaagccgcgcggataagtttcgtgcggtttttttaatattttttgtttaaattattgagtattataagaaaagcgtacgtttaacaaatttaatacaggcgatgataatttattattgttatcgtgtccgtactgcagtttagttaatatatagttggtaatcaaaatttattcgaaccgattaatatgctgcagtctgtatcacagaataacatattttattatattgaatattaatgtttcttaaatcgttacaaatgaatcagaccattatttaaaattgcatagtataatcaagataaaacactaatatcttgatttattaatattttaataccaaacttaattattaatttatattttgaatttaagtaagattgttcaataataaatgaatcgaattttatataatacagggagccatttcttgtaaatattcttgttatattttcttttgcttgcattgtcaactaatagcaaatttatggttgacaataattcttgagtatgttataatttggaaaacatttaaggaggaagtaatatgaaaagtaacacattaactattagaaaaatgacgttttgcgcaatatttacagcgctgattgcggtaggagcttttataaaaattccggtgccgccaataccgtttacacttcaaacaatgttcgtagttcttgccggactaatgcttggcgggaatatgggcggcatcagtgctttgttatatatgattttaggtcttataggaatcccgatttttaccggtggcggtggaataggttatgttcttaaacctacgtttggctacataattggattttgtgttggcgcatatgcaattggaaaaatcagttataaaaatggtaagctgggcggatatgccagaatgttctgcggagttttagccggattgggaattatatatggctttggtataatctactattactttataacaaattttgttacttcaagttatccgggcttttggtttatgatactgcattgtttccttatgacaattcccggtgatttaattacttgtgctttagcttgtttgctggcaaagagagtgcatccggttaccggcagatacatatataaaaatgcttaacttaaaaattatcacaattaaataaaactaaggcttgtggaatataacccatgagccattttttaataattaaaaagcatataaaaatttatttattagaccgataaaatatacgttttttcggaagttttacaagtaaaaaaatggtagctataaattttttctttaatttttttattgtgattttacacagaaaatttgtcaattttttggttattttaacataagttaaaaaattatgtagaatgttaaaattttatcagtctgactcttgacattaaaaaatatcatgatattattatatttggatttcactggttgtttgaaatatattattaaattatatttttgatacaaactgtgaatgtaaaacatagaaaataactgaaaaacaattacttattataaagacattttaggaggtataatatgtctaacacaaaagagtgcgataagttcctttcacaagagtatttggaaaagatggacgcttattggcgcgcaacaaactatttggccgcaggtcagctttatcttcttgataaccctcttctccgcgagccgcttacaatggaacacataaagaaaaaaatagtaggtcactggggtactgttccgggtcaaaactttgtttatactcatttaaaccgagttattaaaaagtatgatcttgatatgatttatatttcaggacctggacacggcggtaactttatggttgccaatacatatcttgaaggttcttacagcgaaatttatccaaatatcagccgtgatactgaaggaatgcagaaattgtttaaacagttctctttcccgggcggtatatccagccatgttgctcctgaaactcctggatcaatcaatgagggcggagagcttggatattcactggctcatagctttggagctgtttttgataatcctgatttaattaccgcttgtgtagttggagacggtgaggccgaaacaggacctttggcaactgcatggcagtcaaataagttcttgaatcctgttacagacggtgcagttctgcctattatgcaccttaacggatataagatcagcaacccgactattttctcacgtatttcacatgaggaaatacaaaagttcttcgaaggctgcggttggaaaccgatttttgttgagggcgacgacccgatgacaatgcacaagcttatggctgaggctcttgattctgcaattgaagagataaaagaaatacaaaagaatgcaagagaaaataatgacagcacgcgtccgatttggcctatgatagttcttagaactcctaagggctggactggaccgaaagaggttgacggacagaagattgaaggttcgttccgtgcgcatcaggttccaatcactatggagaaacctgaacatcttgatcttcttaaagaatggcttctcagctataagccggaagaactctttgatgaaaacggacgtcttatacccgaactagaggaacttactccggacggtgacagacgtatgggagcaaacccgcatgctaacggcggtttattgctgcgtgaccttcgtatgcctgatttcagagaatatgcttttgatgttccaaaaccgggcgctgtagaagctcaggatatgatagaactcggaaagtttgttcgtgatatatttaaactcaatgaagatagtaaaaacttccgtatttttggccctgatgaaacaatgtcaaaccgtcttggcgctgtgtttgaggagacgaaccgtgactggaatgctgaaaagctggaatctgacgagttcctggcaagcaacggaagagttatggactcaatgctcagcgagcacatgtgcgaaggctggcttgaaggatatttgctcaccggacgtcatggattctttgcaagctatgaggcgtttataagaatagtcgattcgatgttctcacagcacgctaaatggctcaaggttacatctgagcttccgtggagacagaagattgcgtctcttaactatatcttgtcatcaaacgtttggcagcaggatcacaatggatttactcatcaggatccgggatttttggaccatgttacgaataaaaaggctgatgttgtacgcatgtatctcccgccggatacaaactgcttactttcatgttttgaccactgtatcagaagccgtaattatgtaaacgttatggtaacgtcaaagcatcctcgtccgcagtggctcactatggaccaggctgttaagcattgtacacagggtatcggtatttgggactgggcaagcaacgagcagggggacgaacctgacgttgttatcgcatgctgtggtgatacaccgactttggaagctttagccgcagtaacaatactccgtgagaatatgccggaaataaagattagatttattaatgttgttgacttgatgaagcttcagtcacatgataaacatcctcacggattgacagatacagagtttgatacattgtttacaaaggataaaccgataatattcgctttccatggatatccgactcttatccatgagctgctttatcatcgccgcaaccgtgacttatatgtttgcggatatcaggaggaaggaacaatcacaactccgtttgatatgcgcgttcaaaatgaaatcgacagattccatttggttcagcaggtaatttatcatctgcctcagcttggcaacagaggagcttacttggttcagaagatgaatgataaaattgttgaacacaagcagtacattgcagaatacggtgaagatttaccggaaatcagagactggaaatggtctgaataaaatttataagttgaaataaaggctggatattccggcctttatttttttgtaatcggaaataactctggcagcatatttgaagcttaatgagttttacaattataagaagataagttacttgtaagtataaaatattaagattattttgatgtttgaaaatattttgttttaagttattgaatttatagtataaatcaagtatactcatatcaagggaggaaaaatagatgacggacaataattttaagataaatattacttctgaaaaaggcgttaatattcaacccaacatgtatggattattttttgaagatattaactatgcggcagacggcggaatatatgccgaaatgatagaaaaccgttcttttgaacagataatgcacaacgactgtgatggaggtacaaaggaaacttatagaagcccaggatatgcctggagcgctgtcgacggcgttatgcattacaagacagagaatgggttaaatgaaataaaccctcattaccttgagttttccggacgcaagtttaagaataaggcctatgaaggtatgtatgttgaagccggaaaaagttataaagtatcattctacgccaaagcagacacatataatggaacggtatctgcttcggcggtaaataatggaattgttgctttcagtggaataatagcagagaacgtcacaggtgaatggaagaagtacgaatcaatattgactgcggaagtcagtatacgatacggtgactttgtgatttctttagaagatgtcggaacggtttgctttgacatgatttctgtaatcccttgtgacgctgtgtgcggagtgttcaggcgtgacctggcggaaatgcttaaagagatgaagccggggtttctcaggtttccaggaggctgtgttatagagggatgggatattgaaaatcggtatcaatggaaacatacagtaggtcctgctcaggagcgaactcaaaattggaataggtgggctgtatctaaacggccaaaatatttagattataatcaaacatatggtcttggattttatgaatattttctgctgtgtgagtatcttgagtgcgaccctttgcctgttttaaatgttgggctttcgtgtcaatatcagggaaaagaaacggttccggtttatgctgaggattctgagaaagatataggtgtggagataaacggtgttatatacacaacagaattttaccagtatatacaagacgctcttgaccttattgagttttgcaacggcgatgaaagcacgctatggggcggattgcgaagttcaatgggacacattgaaccgtttaaccttacattgctgggtgtgggaaatgaacagtgggaagctgacgggaatcagtggtatgagagatatgaggagtttgagaaagttatacattccgtgtatccggatataaaaattatatcaagtgcaggaccaagcccggatggagataattttgacagcgcatggaaacgtataaaaatgaatatggctgaaaataccggattcacatatgcggttgacgaacacttttacaaacccggggaatggtttttaaataatgatttaagatacgatggttatgataggtcaataaaagtttttgccggagagtatgcggcaaagcaagatgggaacacactatattctgctgtgacggaagcggcgtttatgacaggtctggagagaaatgcagacgttgtatatatggcaagctatgcgccgctgttttgccgcataaattatatgcagtgggaaacaaatatgatttggtttaatgacatgacttgttatggaacccccaattattatgttcaaagcatgtatatgaacaacagcggagattatactttgaaatacagtataaccggcagtaatgataaaaattatttatctgtatgttatgataaaaatagtaatgatataatagtaaaaattgcaaatccggctgaaagggatattagtgtggttttggatttaagttctttcaccgaaactacagaatttgaaaactacgctcatattgaaattctcaccggagaaagcgtcggttccgaaaactcaattgataatccccaaaatatagctccaaagcgttcagaaataatattgaatgataatataaaaattccatctttgtcatttgcagtaatacgaatacatattttaaatcaatatttataataaaaagttttttaactgtttcgttttatgctgaaaagataataaaaattttagactgaaaaaatatggatgttttaagattaaaatattctacaggtgttttatcaacgtatagagaattgaattatgaaaaatctgaatattctataacttttaataaaataatttatttgatttctgattaatatgtatattagatttaatcagtgcgtgttcagacgagagctcacctaacgcggcgcgttttacgcgccctgccgaagttcactgatgcaatatttaaatagtaaataaagtcacaggtttataattaaaaatattttttatactaatttaaatttgttgtacaaataatgatttgattctgtgacttttaactgaaatatgtaccggttatgtatattgcattatatataactagtataaaattgtaatatgtatttataaagtttgaccgcattatgagtatcccaaataatgacattattagtaatgataaaatgagctgatttgtataatacccatcttataggttggagaatagttacagcttagttaaagtttctaaaataatgacattaattaattcaatcataaagttatagcaatttaatttgaaagccatatataataggtttaataaattattgagtatatataaaataaggagaaaataaaatgcttaaagttaaaaaagctgttagagaagagattttcggtgatgaccgtgagtttgacagcccgcatgcgccgacggtactgccgcttaaaaataatgatgtgcttgcggcgtggtttggaggcaggtttgaaaaggacccggatactgctatttggactgcaaagagattaaacggcgtgtggcagaaacctaaaaagactgtggatgttatgaatattgctgcttggaatcctgtgctttttagactcaataatgatagaattattttatattttaaattaggctctgaaataccaaaatggcacactgaatacgtatattcagatgatgagggcaagacttggagcagcccgaaagaactcgtaaaaggagatataggcggacgaggtcctgttaaaaataagcctatatatttgtcagataacaagactattcttgcgcctgcttcgcttgagggggattcttggaactcgtttgcagacatttcggatgataatggtgaaacatgggaaaagagtgagtttgtccctatccgcagaataaatccaaatgagcggagaattcgtgacagggtatataacaagactttttgttttggaaaaggtattattcagccaaccatttgggaagatgacgaaaatattgtacatatgctctttaggagcacaagttcaaggatttttaaaagcgattcgtatgatatggggagaacatggaacttagcttatgacacggggcttcctaacaacaatagcggtattgacgctgttaaacttccgaatggaactttagttcttgcatataaccctagggaaaatataccgggaatgacaaaaggcgcaagaacgcctattatattatcatattcagacgataacggaagcagctggaaagaactttatattcttgaaaattgcgacggtgcatttgcgtatccgtcaattgtttgcgatggaaatgataaaatctatgttgtatatagtgaaaaccgggagaagattattttttggaatattgaatacgaagagacagtcaactaatcggaggcagctatgaaaaaggttgattttgataatgaatttaaaaatcccggttcagagtatcgttcaattccattctgggcttggaatgatgagcttgatactgatgaaatcagaagacagatacgtgaaatgaagtcctgcggtataggcggattttttattcattcgcgggacggtttggagactgaatatttaagcgataagtggtttgaatgtgtgtctgcagctgttgatgaggcaaaaaagaatggtatgttttcatggctttacgatgaagacagatggccgtcaggaacctgcggcggaagtataactgcaacggataaaaacggctgtaaggggcttacgcttgaagtatgtttttctgttcctgagaagatagaaggaaatgtactcgtattatataaagcagaagttcatgaaatggaaatttacagtcttgaaagaatatgtaatgctgacggcttaatacttagtgataaagaggctttgctgattgcgagacttgaagtcagcggaaagtctgaatggttcaacaactccgctcctcctgataacttgagttttgatacagtaagtgattttataaacaatacacataagatatataaaaaggcggtaggcagtgaatttggaaagacaattcccggaatatttacagatgagcccagcctcgctgacaggcacgcatcgtttaatccaaatcgaagctggataccgtggactgaggaatttgagaaatacttttttgaaaaacgcggttatgatgttttagatatgataccatacttttattttaatggtgaaaagagtgcaaagataagacatgattactggcgaacggtctcggaacggtttaaggaagcctattcggttcagattggagattggtgcagagaaaataatctattattcaccggtcattttttgcaggaggataagatgggattatcctgccgtgtgaatggttctgtcatgccccattatgctgctgaggatattcaggcgattgacatgctcactgaacgtacagaggagtatataacggttaagcagtgttcaagcgtctctaatcagctggggcgcggggcagtgctatcggaaatgtatggatgtaccggctgggatttcagttttgagggacagaaatgggtaggagactggcagtatgcgcttggagttaatcagaggtgtcagcacttggcgctttattcgcttagaggctgccgcaagcgggattatccgccgagtataaactgtaacaccagctggtggaaggaatataaaacggtagaggattattttgctcgtctgtcatatatgttaagatgcggagagccgataagaacggttctggttgttcatccaatgacaacggtgtggagccggctgggatgcagtccttatggcaatccaaagaggaatcaggagcgtgatatacctaagcttaatgaactcggagatacctttaattcaatcgtaaaaaatctttgtaaaaagcattatgaatgtgacctcggtgatgaggttataataagcgaatacggaagctgcagcgatgataaatttgttattgggaaatgtgagtacaatactgtgataatgccgttttgcgaaaacttgctttcagaaacttatacgaaagttatggagtttatggaaaacggcggaactgtgcttggacttgctccgtttccgagattaattgagggagaagtatctgaaaaattatctttgcttataaatcatcataattttgtgaaactgttttcagaaaatgagcttattaattatttggataaaaatgttaaacgcgaagtttcaataatttatgagaatgataaagaggaagaaaatattttatatcagctgagatatgacggaaacggatatatcctctttttatctaataatgacagggaaagcgctcatgaggtcaatataaagttagatgttttagagaacttggaacagaataatttatatgtatattctttaaatcttttaacaggaactttaacgtcctgtgatttcaaatatgcaaaaggcagggtatgttttgatgaatatatgcaaggctgccaaagctcaatgttttatattaccaataaatatgttgaatgcggcagcagagatgttcagatatggaatgcagaagacaaccggattaaaactgaagaaattccagtcgaatatatcgcatatgaagccgatacaaaaaatattttagctcttgatatgtgcagatattgtatggatgaaaagtggtcggaaaacatagaggtttggaaagcacaaaaagaaatcagagagaatcttgaaatgcgccaaatttatcataatggacttgagcaaagataccgctgggtaaacacgcgtcataaaaacgatggaaaagatgtttggctggaatttgagtttaaatctttaaccggcgtggatgatgcagagttggttattgaaagaccggaatgctttaaaattgaactggacggaaaaataattgataataattcggtcggctgttttttggataaatcttttaaatgtattcagcttccgaaaataactgaaggcgttcataaactgagactgcaatgtaattacacaaacgatatggagctggagtgctgttatatattaggcgattttggggtaagcgcaaaccgtgaaatcattaaaaagccggaatctattagtttgggcgatataacggggcagggatattttcattattgcggaggtatagcgtataagtttaaatgctgtttgcccgaattgcccaataaagaaatatatttaatctcaaaggattttgacggagtatcttcgtcagctgtgataaacggcagggagattaaaattccgtggaaagaagccgggactgtggctgtcggaaagtttttacatgagggagaaaatgagatagttataaacgtgtacggaagtcctaggaatatgctgggaccattgcatataacaaataagcctttggttaccaaagacagttgtttctgccctttaggtgataactactcgccgaattataatgtggtaagcgtaggattaatgaaaccgctgagattgatttattttaaagattagtttctttgatgtgatcccaaaaagttagactatatagcgcagcagtttgatgactgctgcgttttttatgctgctttagcttagtgcctgtgcaattctttgacaggcttcctttatttgagctgtggataatcttccggtaccaagtaaaaatgtgcgttttggaatcagaggcgacggcagaatgctgtattctttaatagacatgatttttactccggccgcactgattttgctttttatttcagaggatgacatgtcaagattaaaggttacgattacgtttgtgctgtctgaatttggggatattgttatttttttgcctaacgattcgataagttcacgttttaatagttcgcgcttgtctcggtatacccgtcgcatggttttataatgcttagtatagtatcccttttcaataaattcagccaaagcgtattggtctgtttttgacgcaaaagaagaataaaacttgtgtttttttctccattttgaaagcagttcgtccggcagtatcatatatgcggttttcaaaccgggacacagcgctctggaaaatgtgtttaaaaaaatcacctttccgtttttatccatgctgtagagagtgtcagatgaatcccacgtgagttcggaatcatagctatcctctattatatatctgccgggagattcagacgcccatttaagcaaatccattttaagctcttcgctcattttataacaggtcggataatggcagtggggcatacaataaaatatactgcaatttgatttatataaatcgtctatatttaatcctgacatagatataggtatattaataacgtccgtgccgctgtcagtgaaggcgcagtacgagcgtgaaaatcccgggacctccattccaattttcccaaaatctatcagaacatcggcaagctgcgtcaacagatactccgagcctgcacctatgattatctgacgcggagaacatttaatatcgcggaaggaatataagtattttgcgacagcggcgcgcagagaatgttcgccgttcttttcgggatgattaaaaatgtcaattccgtcattatagacaatattgcggacaattttagcataactgctgcgtttgaaataagtaatatcaacagcgttaggcgtaaaaacataggtttcgcctgcgtcaatatcccatggaatatcctcaaactcaccggagttaaatgagacaaaatgccctttttttggtattgaaattatatatcctgtgtctgccagcatattatatgcttcattgacggtgttttgtgatacagagagctgcttggctaatatacgtcttgccggaagtttaaatttgtcaggcagaaaaccatcggaaatatctcttactatagcgtcataaagctggatatacaggggctttgacaatgatttgtccaaagaaatatttttcattcagaatcccccaataaaatatatttatacttaaatttattatatcattacaattgatttttgacaatactttggtactgtaaaaaatataaactctggtactgtaatttgttattgttttttgttatatttaaacaaagagaaaaaacaactttaaggagggttaattatgatgaaaaaacagtttaaaagactggcaagtcttgctgcggctgtgactgtttttgccgggatgtttaccggtattacagtaaacgcaaaatcggaaaccgtcagcacagcggagacaagcaatctgtttgattcagaaaacgttatgtggacagaccaaaaaataattgatggattttgggaaatggatccagatgtaagtaacaaaactaaaacagatattcaaaatccgtatggtaacagcggcgacatgtatgacgcacatgcgtattatgaatttttgtggacgcacggttatccaataggaaacggacgtatggcggctatggttatgggtgcgattgacaaagaggttatccagattaatgaggataccatttggaatggttcgccatatgttggcgaggacggcaaatcaaccgccggaagtgtaaaggatacatggaagtattacagaggcgccaaagcggacggcacgcctgccgccttcggtgaggagggcgaccaggttctcacgggcgatgaggagttccgtcagaaattccctgcatttgcacataagactattacaaatatggcgcttaatatagataacagcgatacacaggaagctgtttcaaacagacttgaccttgcaaatcttacaaatgacaacttcctcggaaatccaataaaacagagagcatattcagaatttgttgagcttttcttggactttaatcaggagagcggaaaagcgtcaaattatactaaacgtcttgatatgagcaatgcggttgcgactgttgagtatgattatgagggaactcactacacgagagagagttttgcgagttatccggatcaggcaattgtgacaaaagtaaagtcggaaggcggaaatttagacttttcggcacagcttcacacttggctgaaaggaggacagcaatttgagaaaatttccgataatgagattaagataattgccagaccggcaaacttatcagagagtaatggtttggggaatatgtcgaaaattgtgggcgaggcaagaatgtatattgacgcaggaagcggggcgaaactcagcgtttctgatgattgttcaaccataaacgtcagcggcggcaatgaggccgttatctacatagtaagcgcttctaactacgttgattacttaactcttgatgacagtaagcctgctcgtgactgtgataaatatatttcaaagataaaaaacaagtcatatgaggaaattaaagaggcgcatattgctgattacaaagaactttacgagcgttctgagcttactcttggaaacagtgacggcacggacgaaagcggtactacgacagagaaacgtgtgcgtaaggatgttaaaggcaaatccggttatgaaatcggggcaggtaataagcttgaagctaaaacccctgttgattcaacttataatgacggtgataataagctggttacaatgatgtttaactacggaaagtatcttatgatttccggctcacgtcccggagatactgagaacgatattcctataagccagccgcttaatctgaccggtaagtggaatggaacaaacaatccgtcatgggcaggaaaatatacaattaatattaatactgaaatgaattattggccgtcacagccgcttaacctttctgaatgcgtatttccgctaacagaaatgcttcagcagttggccgaaaacggaagcataacagcagattatcagtatggtataaagaatcacagaaatgacgataagtatgttcccggcgacccgtgggtaatgcacaataatacagacctttggcgcggcacacagtttgttgataattccgacgtgctttggcctatgggcggagcatggcttatggactgcgtttggaagtattatcagtataatcttgatgagcagtatcttgcggaattattcccgattatgcgcggccttgcagacttttatactcagttcctggttgttgacccagtgaccggttatcttataactgctgcttcatcatcacctgagcagggaagtgttcagccgggttcagcaatagatacacagcttataagaaacctatatgatatggttctgaaatccgcacagatacttggcaaggagaccgaggaagctgagcttattgcaaaaatcaaagagcaaatgcctgaaaacggttatttctcatatgagcagggtaaacttgcaccggatattatcgaaaccgataagagccatagcggctatgggcttatcagagaatgggtcagaggagacgttaaatttgacttctcaacggcagattcaagcaataagttatggacctatacatacccatttgtaacaggcaacgctgatgaagacacgacaaaggagagcagggctaaatataagtccggtatgtatagaaagcatactgctgcgaatggctcagagtgcggacataggcacacatctcatctttgggaactgttcccgggaacacatataaacgcttacagcaccgacaagcatgaacaggaaatttacaaagcgttccgtcagagcgttcttgcaagaggcgccggcagcggacagggctggggcgttgcgtggagagttgcgctgagcgcaagagcgcacgacccggcgacagctgatacgcgtattgaacagcttatcagaacaagagtttcgccaaatctgtttgaccagcatcctaacttccagattgacggaaactatggtcttacagcaggcataaccgaaatgcttgtacagaagcagggagattcggttgagttcctgccggcaatttccgataaatggcagagcggaagcttcagcggatttaaaataattggtaatattgaagccggagcagactggaaagaaggaagccttactaaggcaacattaaaggccgcaaacagcggaatattaaaagcacgcaacagctcgcttgataaaaatgcggttgttgttgacagcaagtataacaaggtgccgttcacaactgaagaggacggaactgttatagcatttgacgctgcggcaggagagacatattcaatttatcctgctgattatgtacagaccacaggcgagagcacatgggaaaagtatggtgcggaaatttcatcaaattccagctgggcaattaaaaacaagtccggcatcgctccgaaatattattcagataacttgtatattggaaatttggccaatgataattcttatatcggttttgctgttaaagactgtgatgtgcaaaatttaaaaacattaggtgttaagatagcgctttattcctcgatgattgacaattcagaggtttcagttagagttggctcttcaagcggtaccgaaattgcgcacaaggtgtttgacactgcgaccggaggaaataagagctttgcatggatagacataccgctcaatgaggatgttgaccgttctctgcttgaaggcaaaaaaacgttgtgcttcttatttaagactgatttaaaaaatgatggtacaaataataagtatattgccaatgttgagggtgtttcgggtaccgtattggtagagaccggagagaagcagtatataaacttaaaacataatggagacgattattatacaactcttcttctcaatggaacctatacggctactatttcaaacgatgcaccggacggcactttgattattgcaaaatatcgcggtgacgaacttatagacacagtaacacaagagataaattccgaaaacagaagcgctgaaatgaatatttcagatatagaaagcggaataacgatgaaagtaatgtattgggacagcacggacggtatgcagccgctgtcaatgatgcgaatattagaaacgtccggcacttcggtgccggacgttccaacacctgaaccaactgaccctcctgttcctacaaaggaccctgtgccatctatgaccccaattccgtcgcctacagcaacgcctgcattgccggaagtgacaactgagcctacatctactcctgctcaagagagcggaactgtatttactgttgacaaaagcggtgagacggatatttcaaagaatcaatacaagactattcgcgaggcgcttgcctcagcggcagaaaaaagcccgtcaaatgaaagcgaacgtataacaatagaggtagtaccgggcacgtaccgggaacaactagtagttaatacaccgtatattactataaagaaaaaacccggtactgacggagaagtgctttgcacctggtattacggaaccggaacaatgtataaaaactgcggaagcgacggtttttacaaagagggatctttgggagaaacggcgaatgtcgcaaagaattggggagcaacgcttaccataaacagcagtgcaaacgacgtgtggattgagggggttaccctagaaaactcatacaatcagtattatactaaagaagaacttgaagccggaatggaacctgacccggcaacaagcaacagctgttttgacagagacaagtggattaaggctatgattgccaaaggaatgtctaataatgagataaatagctggcttcagtctagaacgtatataggaaatgaatataacctcgacccggagaagaatgggagaaaagattcaccaagagagcgtgcctgcgcattgtataccgcttctgacagagttataatacgcaattgcagagtggtttcaaagcaggacacaattggaataaataaaaaccgtatatattttgaaaattgcttcttagaaggaacaaccgattatatttgcggaggtgcagtagccgttatgaacaactgcaccctcaatgtcggttcggccaagcctatggattcaaatacaggcgcaacagattctgcctgcataacagcggcagggcagtcgtcaggcaatggatatttattctataactgcgaggttaccggaacagattgggccacaccgagcgagttaggaagaccatggaatgcaaatgcggaggtcacatatataaatacaaaaattaataaatgtaagcgcagcggatatacgaataagtatttgatttcagataagggctggacagatatgggcgataataaagcggaagacgcccgctttggtgaatatggttctgtggacgctgaaaccggtaaggccattacaagcagtgtgtcaatacgtaaaaagtttatgctgaacgaatggtcaatgcttgagtataacccatataattatctcagaggcagcgataactgggatccatccggtatgaaccggtattattcggagtttgatgagattgcctcttcaattaacattgacacttcaggtgaaggcgatattattctacctgaagcggcagatggttatggttatcagtgggaatcagacagcacatacgcaagtgttgacaaagataagaacacaatttctattattcggccattatatggagacgagcctgtagaaaccaaaatttcagtatatatacgcaagaacggaacacagtacggcgcgagaaaggttattccgcttacaattcagccgcacagcagcgcggaaaatacattcagtgtaaatggaaccgtaagcttgtcttctgcttctgaggatgaagtgaaggttacagtaatacttatgcaaggcgaatgccctgttaaaactctggatgtaacagttcctgccggtcaggagagtgcagactacacgataaataatcttcccgagggcagttatacagctcaaatatcaaccgatacgcgtgaatatactttgatgacagattcaagcgttgagctttcaggtagatctggcgagacaaaggaattaaatatctcactgagcgagtcaatggctacgccttaccctgcaaaattcactgttgacgatttaatcaaaacagaagatatgatgcgctggagcaacggcgtagatgtcacaacttcgtctgacagcacaaagcctcttaaaacggcttcaagcgcaagcgcaaccaaccttttggtaaaaactcctgaaaactatacagcggagtatgaaaaagcgtttggccctgcagatagtttgcgtacgaatttcaccaagaagctgggctatataaacttctgcgccgaaagtgaggaaagcaccccttcaattgatacatatatttcggtttacttctcagtatcagaggagcaggctgcaaagggaccgtacaaggtttatgtgcttaccaacagaaagcgtaatgattcacgcatatctattgagacgccgaaagttggatttgttgaaaatctttcggctgattttgtaaatatgtcaacagataccgacggcacaggagtacatgtaattgagcttcctgagtttaaagcgggcacatatgaattcaagtggtatccggtgaaaacggcagacggaggcacaaaagtcgcttcagatttctttgctttgagattccttccggtttccgagacagacggaaagtagaaaataataaattgaaaaaacaataatttcttcccaattaatattaagaccttaatctatcaaaaagatgattcttttttaagattaaggtctttcttatgtgtttattttaaattttataaaatagtattattattggaatacctataatgaatataaagtttaataagaaagaaaagcagatatacattaaccgttatttatcaggtgtattggtaaatctatggcatagtgcgcagtacgctgtattctttgattaacaaatataaaaataaaagtggacaaaccctttataataaagaatttgaccacttttataaaaatgcttggtggatcttcagggactcgaaccccggacctaccggttatgagccggttgctctaaccaactgagctaaagatcctcatttgttctgactaatttatagtctcgaacaagaacttttatattataatccatattattctatttgtcaatactatttttataaaaaatttttaaacttataagaaaaaattctctaaaaaattgttaaaattgcaaaaagtacttgcaaaatatagagttttagtatagaatgtaaaaaaactgatattattttttaggaggtacacaccaatgataactgctggtgattttagaaatggaatgacatttgaatatgacggaagcgtatgtcaggttgttgaattccaacatgttaaacctggaaaaggcgctgcttttgtcagaactaaatttaaaaatgtaataactggcgcggttgttgaaaaatcttttaacccgactgagaaatttgaaaaggctatggttgaaagaaaagatatggaatatctttatcaagatggagatttatattactttatggatcctgaaacatatgaacaggctcctctcagcgctgaccagttaggcgacgctcttaaatttgttaaagagaatatgcaggttaagttttgttctttcaaagggaaagttttttcagttgagcctccgacatttgttgagcttgctgttatgcatactgaacccggagttaaaggcaataccgctacaaacgtaacaaagccggctactcttgaaacaggtgctactgtgactgtcccgatgtttattaatgacggggatatgataagagtggatacgcgtaccggagagtatatggaaagagtataattataatataataggaggcattattatgtctgatttgacaaaagaagcggcatatatcaaaggtttgttcgatggtatgaagctggattcacagaaggatgaaacgaaaattttatcatctataattagttttttagagaaaactgctgatgagatagatatgcttgaccaagagcagggatttcttgcagaccaaattgacgatgttgaagaagttattgatgttttagcagaggaaatcagcgatgagtatgacgatgacgctgatgaatatcaaattaagtgtgacaattgtggaaacaatgttcattttaccggcgacgacattgatgatttggttgaaggtaatttcgactgtccatattgcggtgaaactgtacagttggacttgagcggtatggaagacggatgtgactgcggatgcagtcatgaccacagcgaagaatagtatttttgaataatatttaaaacagactgaaatttcagtctgtttttttgttatgtttaatttgatatgaaatttatttctataattttgttttctctcggttatagttttagcttattggtaaagtggcacgcgctgtcattcgaaataacctaaaatgaaataggataccacagaaaatattatagaaagaaggttagttaatggctttatggtatgattctaagaataatgagtatgcttcagatggcaaaaaaggctggataaaatcgtattgtgataaagctttgtctgaatttaataatttaatgtcagcacattttaaggggcagtctaaccgccatatggcatgtgatttggattttgacagcaatatgacagttgaagacaagctgaaaataattgaagatgaaagcaatgcggcagataacagattaaagactgagcttgagagcaaaattaataaaaaagctgacagtataacaaacggcggttttgtggcaggcggaggagtagtaagcgaagaagaaggagcggttgttattggaaacaaggccgagtcgtccaatggtatatctataggcggcggagccttaagcaaaggcggtatagctattggaagagatgctaaagtgtcttcaggtaatggcgtacagcttggcgcaggagaaaatataaaagaaaaaacattaaaagtatatgactatcagataacagatattgattctgaaaccggacaatcatatataaaagatattggaagactggcagatattaatttaaatatagttaatgttgctgacgctatcaatactttaattgatacagatgaagatactgtaaatttaataaccaatgaagtcagcgcccgaattgaggcggataaaaatattaaaaaggaaataccggtcaaaacaatagagaacataacgtcagagactacagataacagcagctatgttacaccgcttatggttaagaatgccgtaaataatttgattgaaagctctgaggagataaaaaacattaccgacggcttaaatcaaaaggcagataaggttacaaacgggggctttatagccggcggagcacaagcaggcggagctcaaaatatatcaataggcgacggtatagcctctaccggcgaacgcggagtagtaattggagcgggagcagagggagctggtcgctgcgttgcagtcggaagtgcgtctacggcggcagcggctaatgctgttgcgataggatacggtgcggaatgtttggcagataatgccgtacaaatcggggacggaagtaattctgataaagaaacattgaaatttcgggattataaaatagttgaatgcgagagtaactctaatgcgcattatttaaaagatataggaaggataataaatcttgagacaaaagataaaaacagcattgtgggagcggtcaatgagatttataagaatcttgaacttagtctgatagttcctaacgccatttcacagagcgttataatgacaaaagattctgatggaaagtacaaattttcttttactttcaataatgcgtatattacgtcaaacagattatttgataatgattttaaaagtcagattaataacacgtttgaaataaatatgttagatgcgccagagtttaataaaccatattatttatatcttgaatgggatttgattctggatgaatttacaatgtttagtacagccgataattttggaactaaccttaatactgaatgtttgcagttttatataggtacgtttactatagtggatgataaaacagttgattattacgatgagcaggagaaaatttctgtaaatcttataccgatgataggaaactatctgtcaagactggattataaatgttatgaactgcaaagagatacggccaaaaagaatacagctgtattattacagaaacttgataagacggaggaatttaacatttggcaaaacggtaattggatagtggaatataatataccgcccataaaaattacagacgagacatacggaagctttacactgccgtctcaaatgttggaagcggcgggagttaaagaggaagcaggcgaagagaaaaaatattgttatgcttcttacgtgcttgacactgataacttatcaggtgaaataagcggttctgatatgacggtgacatgcggcttaaaagaggcaaagggaaaaccaaacagctatatagagatagaagatgaaacgaagttagcaactataaatatatatctcggaactattatattaaatgcagaagattacatgacgcctgatggaacctcgagtactatatattcaggcagtgaaacaacaaatacggaaatgactattgatttattcagaatatttacagagtcaaccgatgtatcaggagagttagtagaaattacagcagatgaggtaagtgcattattttaattataaaaaattatattttgaaaaatagcagtgaaaataagccatgttaatataattattagttcggctcatgtttttagagtgagagtttcataaaattcgcaggcaaagcctgcatattaattaaggagaaaatattatggcaacaaaatttttaggaacggcggcattaacaaaattagtagaaaagattaagggcgtatcaacagcgataccgacaaagttaagtcagcttacaaacgacagcggttatcagacaggttcacaggtatctactacagttacgaatgcgacaaaaactttagctttaaagactgaggtaacagctgtagacaataaaatcggagatttagctgatttggatacagacaatacgagtatagttaatggaatcaatgacgcatggacaaattgtgaggaaataagggacaatataggaacaagagcaaatttaacaacgactgctaaaacagaccttgtatcagctataaatgaggtagacagcaatgtagataatttacaggaaactatgatgacaggatattatacaaaggctacagtggatacaaaaatagcagagtctaaagcaggactagcaacagaaacatatgtaaacaacaaagtgtcaagcgtttacaagtataagggcagtaaggatacatatgcgtccttgccgacaacaggaaacgcagttggagatgtatggaacgttgttgataagaacggtcaaaattttgcatggacaggctcagcgtgggacgctcttggcgagactatagacttaagcggatatatgaagaatgacgcactgcaggaaattacagcgacagaggttgaagctttatttaagtaaatttggagggatatagatggcgacaaagattttaggaatgacagcattgacaaagttagttgataagacgaaaaaatatgtaaacgataaaaagatgctaaatgtgatgaatgattcaagtgcaagtggaaactactctgttgttttaggaggacaggggacggtgcccggagtttgttcggtttcattgggcggttattctaatgctgtgaatggagaaagggcagtagcaataggcggctggtctttgctctgcaacggatataacactgtatgcggtaaaaataatttagaaccaactgccggatattattctcataataacggcgacggatttatagttggaaacgggacgttaagttcccgttctaatgctttccgtgcggcttacagcggtgatgtgtatgctatgaagtcaataaacggaaccggagccgactatgcggagctcagagaatggtcagacggaaatcctgataatgaggacaggtgcggactatttgtatgctttgacggcgagaagatacggcttgcaaattcagaagacccaaaagacttactcggagttatatcaggaaatccgtgcatagttggaaacaactatgatgaccagtggagtgggaaatataagaaggatgtatttggccggttgcttaccgaacatatgatatgggaagaggaaacagataatgaaggcaatattataacacctgcaggtgagggagatgtatatattttatctgaagactacgatccatcgcagaagtatatacctagaaaggaccgcccggaatggggatatatgggaacgcacggagaattggttgttatagatgacggcacatgtgaagcacaaggccgctgcaaaccgaatgacgaggcaaaagcaacggcggcagaagatggattttatgtgcttgaaaggatagatgataagcatattaaaatatttatgagataaaacggttatattctgccaaaattagttcggttaaaattttaaaaaggtcagcgtttgctgaccttttttatatgataatagcaaaataaaaatataaagtcaaagaagacttttaacggtgttacaaatatttcagcaattacactgtgatgtaatgaaaattatctgagtgggacgattactagctgtacaagacgcttagagcagttaactgaactaatttatacgccattgtcaacaatctcaagcggtttattagaccaaatattactaaattgttccatagaataatttgacataggataaacaatgttgtaatattgtattaatacagaaagggatgagcgttatgataaagaaaatattagaaaaaaccatggttttaattgcggtagttatatttataggaacggtaaatgtaatagcagctgataacaaccacattactgtttatgtaaatgattcaatattggacgctgatgttaatgcgcaaataattaacagcagaacaatggttccaatgcgcgctatttttgaagctctaggagctgaggtaaactggaatgaggaaaatcaaactgcagtcggcacaaaagatggcgttacaataagtctgacaataggaagcagaacaatgtatgtcggtgacagagttaagaaattagatagtccgcctttgatagtttctgatagaacattaatgccggtcagagctgtttcagaagcttttggatttgaagtgaactgggatgaaccaactaaatctgcttatataggaagccataacaggcttgacagtttaaagcagaaggtttcagaaatgggtattgatgataagatatatcaaatgatgattgtaactcctgaatcaataaccggggttgaaaaagctactgaagccggtgaggcaacaaaggcggcaatagaaaaatatcccgttggaggtttggtatatttttctaaaaatattgtcagcgagaatcaaataaaaaatatgattaataattctcagtcctattctaaaacccccttatttatatctgttgatgaggagggtggaagagtagcaaggctcgggaatgccggtattggttttcctaaaattccacctatgaaagagattggcgattctaaggatgttggaaaagcttcagaggcaggtgaaacgcttggaacagcgctgaaagaatatggttttaatcttaattttgctccggacgcggatgttgaaatcaattctaattcctcaataggcgaccgttcgtttggcagtgaccctcagcttgttggacaaatggcgtcagccgaaatcagagccatgcagtcaaaaggggttagttcctgtatgaaacatttccccgggattggtgcggctgaaggagatactcataacggttttgttgcaactgacaggtctttagaagaaatgaatttatgtgagtttgtaccgttttcatacggagccgcagcagactgtgattttgttatggtaggtcatatatcagcccgaaagattactgaaagtgatgttccgtcatctatgtcttcaagagtgatagctatgcttagaaacgatattggtttcagcggcgttgtaataactgacgccttagacatgggagcaataattaagacttatacgacgtcggaagcgtgtatagcagcagtaaatgcaggagccgatattttgcttatgccctctgatatagatgaagctcattttgccttagcgaatgctgctaaggaaggtattttaacagaagacaggattaattccagtgttatgagaatcttagataaaaaaatgtctagggggttaattaattattaaatatgtttttaataagagtttattgctatagaattgagtattaataaatatcaaagcggtgtttgtaacatggttgtaacacgtttgtaatattgttgaaataagacaagctaattgactaaaataaaaaataatttatacatgttgcacaaaaaatgtatgataatttagtgtttattccctcttgtaaaagtatttagataaggttataatttaactataagaaagttaatttataaaaattctgaaagggggagcaaaaatgaaattcagaaaggtgatagtcggagcggttactcttgcggttatgtttgtatcatgcagcggattaagttgttttgctttatcagatgccggttcagacaaaccggatgatattgaccaatctacgtttgagacagttgttaaaatagatgaaaatcttaatatgattatggataaaaatgagaattctgaagttgtttgccaatctgatattgacgaactcgctgcccttattgatagatttaatgatagcattattaagcaaaactccggtttgtcacaaattcattttgatatcatttggaaagttgattttgtgactagccagatacctgaaaaagataaacttgatatgagaaatattcaaaagagtattgaaagttttaataatatagtcagacttttgaaaccacgtacggaaagtgctgaagctgtcggataatctgtatctggttatatttatcaaagtataaaattgaaaataaaactccaaaccaaataatcaaaacaaaattttataaaaccctcattatttctttttataaaagaattttgagggtttttattcgttagtcagatgaaaattaacaaaataacccaacaaattctaaaaaagtcttgtgcagttgttttgttttgtgatataattactaaaatagaaagagttacagttctatattgatatgaactaagaaggtgacttaaaggtgacaagtaataaaaaacgaaagattcttgtagttgatgacgttgagcagaaccgtatgatattatctgaaattttaaaagatgactatactgttattgaggctgatgacggtgatgtttgccttaaaaaattgcgtgaagataaagatataatcttagtgttgcttgatattgtaatgccgaaaatggacggatttcaggttttaagagagatgtctaaagataaagaactacagcacaaatccgtaattattacaacggcagacagggccatagatgctgaaataagagccttgcgtgatggagctgtggattttcttgaaaagccttataattctgatatagtaaaatgcagagttgataatatcgtgactcgtatagttttggaaagcgaaattcttgaagaaaaacttgatttagccaatgagcgtttggctgcaatggtagatcttatacctgacggcatagctatatttgattactatgagtcgggcagggtggatttaggatattataatgaatattttgcgaatatatttaatattacgcgcagtatagctgatacggagaaaatatcttttgaaagtttaaatcaattatttgaattggacttaatttatccgggcgacagaagtcatcttgaagaaaaggttaaaaaatgtattgatgatagcggaactcttacatgtcagtttagaattaaaaggaatggagcgtttagctgggttcgtatgtctatgattacatttttgggcagcaatggagtttgccgctgtcatgttttattctctgatatttcttctgaaaaggatagagaagaacagataaccgacgcgcttaataagcttagatatgtaacgagacacgataaattaactcagatttataatagagaaactttctgcgcttccacagataagctgctcagtgtcaatccttctgtaaaatactcaattattatgtgggatataaaaaactttaaagtaattaatgaattgtttggcagcgataagggcgataaaattcttatattaatagctgatactttaaaaagtttggtaggaaacaatggaatttacggaagaatggagtctgataaatttgttgtttgtattcccgcaagcctatgtgatataaattcaataattaataaaatggatatgacgctcaatagcgccaatattgttgattataatttgaaaatttttgctgggatatataatatcatcaatgatgagaaaataccaatagaccagatgtgcgaccgtgccaatatggcgcttaaaagcgctaagcgtgattacgtgaacagatattcttattatgattctgaaatgcgtaaaatggttatggaagaagaactgatattgaacgatatggatactgctcttcaaaatcaacagtttaaggtatgctatcagccgattttcagcgtcaccagcggaaagccaatagctgcggaagctttggttaggtggatgcatcctgacaggggcgttatatcaccgcagaagtttataacagtttttgaaaataataagttcattacaaaattggactggtgcgttcttgaagaggtttgcaaatttcaaaaaaagcgtctcgacgccggaaaagttatgctgcctatttcggttaacttttccaggcttgattgttacaaacctatgatatgtgaaaatgttttggggttaattgaacaatatggactaagtcctgatatgataaagatagagattacagaaaccgcctatacaatggataaggaacagataatagatgttaccaataagtttaggagttatgggtttcaagtccttatggacgattttggaagtgggtattcatcgcttaacactttaaaagatgttaacatagatattttgaaaattgataaaagatttattgatgatattgaagattcagataaggccggtgctattgtttcgagtgttgttcgaatggcaagattgattggcatggatattattgcagagggtgtggagacgcagtatcagaaagactttcttagaggtatcggatgtgataccatacagggatatttttattctaagcctttgtttgagaatgaatttaatgaggttatagataaatatagtaagctgccaattgataaatgtgtatctgatattagagccaatgatttgaatgttgagagtatttggagcggaaataaagaagtggacgctttgtttggcggactcatcggcgctatgggaatgtatgaacttaatccaaatggagttcttgaaataatacgggttaatgacggatattatgatttgtttggctcgtcgccaggcagtgtgtattctgatttgggtctaagtttcagcagacttgaggatgaaagcaaagacttgttgctgaacgcttgcagcagagcaaaatatgaaaaccaaataataaatgttgagcttaaaaagtatcatgaagacggtcatttaatgtggctgtcatgcagggtaaaacatattggaaaaagcgacaacagagacttgttttatatattgataaatgatataacagaacaaaagatgcgtgatacttcacggcaaatttctgtttatgcggatatgtttaaatcattttttaatgaaatttttgaaataaatacaattaataaaaccgtaacggttatgtatactgatggcagaattggttttgagacaggtgtgaagtttgatattgatacatttatgaatttttgcaggtctaatttggctgatcctaaagattatagttcacttgataaaaatataaagcagtcttttgaaaatgcacctgtttttgtcgatacatataaggttttagatattgatggtaatgctagatggtatgaatgcagggtgctgaaggttaacggttcagatttaggcatatacctttgttgttcagcagatattactgaagagaaaaatattgctttatcaaaagaaaatatgagaatagccgagcatgtaaatgaggaaaagaagcgtttgtttgcggttttgagcaggcttaatatatgtgttttcgagttagatttgaaaaatgacgtttttattatggatgaacagacggaatatgaatttaataactttttcggtgatatttgtagtataagcggatttgttaataagacttttggagaagacaaaaatgcttttgatagctatttgtcaaaagttaaaaacggcatatttgattcaggaataactgtgagaattttaatgagctcaggtgaatatggctggtttaaattagatactgtgcgtcaaaccgaaaaaggcgaggttaaaaagattatcggcacgatacaaaaggtagatgaaagtctgacagacgatataggaatcataagagaaaaagaacagcttgtaagtatgctgaattctatgcagtttggagttggaatttttgagtatgattctgatagtttggtaccgaaattttataataaccgtctgagagaattgcttgaaatttttgacggcagtgtttatacgtcgtcgccttatgttaatgatttagtggtttatatttctaatgtatgcagcaaatatgttaatgataaaaatggtgttaatattaatttgtcagaggaacatgaatataaatgtagagacggttcaaaagcttatgcaaatcttagtataactataattagtttcagcaaaaataaaatggtagtttattgtgttatagatgatataacaaatagaattgaggcggaaaacaaatttaaagagcaaggatatgtaaactcaattttggttgagacatctgagtatataatattagattataatgctgtaactaaaagtcttactatatccatgccggtgcgtgatggaaaaagaaaagaatacgaatacaaagatattaactctctcagttcggtagggtgggtgtatcctgaatatttggaatcaattgatgaattgctgtttagagaaaattattctgaagacaaaaaggatgacagcatagaacttttagcgaatataggaggatgcggatacagatggcaccaagctgtttttcattatgttcctgacagtgagaataaaatagttagagttatcggcagaatttctgatatacaaattaaaaaagagagagaacttgccttgagcaacgctttaaacgaaagagaaaaattgttggaaaaatctgagatagacagtgttacgggacttctcaacagattaactacagaggagtgtattgaaaataaattgtccaaaataaaatctgagtgtgcgtttgtggtttatgatatagataactacgaagatataaacgcagacctgggacatataaaagcagaagattatttgaaaaaagttgcttcagtgtttgaggacagttttagacatggagatattatcggcagaatggattcggatgtgtttgtagcatttttaactgatgtaaaagcaaaggatggagtctataataaggtcggcaaaacaatggcaaaaatttgcttagtttctgaggagtttggatttggcaaaatgggcacagtaagcgcaggaatagcattttctccggataatggcgtggactttatgactctttataaaaaagctaatatggctttgtgcaaggctaaaaaatcaggaggcaattcttatacaatttatagtgaagtttaaatgagctgaaatttttagtgattttgattaaataattgattaagagttgtcgcgtggggatgagtatatgaaaaaattattgtacataattttgatattatttttattcactaatgtcataaatatttttattcctgtttttgctgaagaaagttcctctgcggaggtgtctttttgtgacagggatggatgggtgagcatggttgacggatactccggcgggcagtttaattttagcaggcttcaacagtatccccagccgtttgttaatgaaaacggcagaacgatgtttcctattctttattttgatgagatttttagggatggtttaagttatgatattaatgataatactataacgataacaagaaatattcttgatgttataacgactgtcagtgttactatagatagtaatgttttaattaaaaacggtgaagaaatcgttatggataccgtgccaatcagaataggagaaacgatttatattccgctgtggtgggttgctgattatcttggttatggcgttttatggagggattatcaaagtaaatggtggcctggaggaatggttgaatttggacaattgacatccatctttgtttatgtctggaatgaggataaggattcttcaccaaacggattaaggtattcatatacaattggcgaacggtctgatgatatgtctgaaatcaaggcaaatgctgcgtcagattttgaagatgtatttgctgttattaaaagacttcctcaaggagcaacagttttaactacagcgatttatgggcttgatggatataaagtcccatatgatatatataatggaataacaaatgctgtgtttaatggaggctataagggcggatatagtacatattgtctcgatgagattccaccgattattaatagtttgggtgattttacaaatgaatggtattcagaggagctttccgctttaggagaaccggcgctgtatgattcagtcggtcaaatatatcgtttttcatatattccttcattttggaatccgtttgttgttcggatagaaataaacgatgatggaacagcaaatgtgtgctataaatccggcaacggcgttgcgggtcctcacagcggcgggattttaaaatccgagagtgccgaattaagcagagaagaaactaaagagtttcttgatttattaaatgataaggattattggaatatgccaaaagaagttgagagattaggctgtgacgggtatgatgtagtaattgaaggagtaaagaacggtgtatatcatatagtaaacaggtggtgcccaatggaaaacgattcagctttttacattgaaaaatattttgaaaatttggtaaaagaaaaatttcctgaataaagtaaaaataagtatattttagttttatgatatcaaataaaaaatcagacaataaagagataaagctgtttggtaatttacttatataccatgattttatgagaaactattatatgtttttgataaatatattaattactgcatcgaataatcacgttcattataatgaatttgataaatagatagaatgttaagtatttagtttttttttatactttaataatatacagctataagtaaatgagcggtaaaattattaaattaagggtttaagtatgaaataagcatctgatggctaaatctttcattaatttagataatatatttattgaagacaaaccagataagaaataagagtaatttaaatcatattgattgaaatgaataaacataatttacagaatagaaataaaacctcttacagtatgaactgctaagttttttataatcttagtatccatattataagaggttttttgtgactttatatttcaaagctatacatcaaaactgatttgttcaattccccggtcttgctcacggacagttgctcctacagccggaactgtcttggttctgaatctttctatatttttcagtcctgaatctgaagcgggaacggcctttgacactatactgccctttctggaactcattatgttaacgccttgagttgttcgcgtagtttttaagggtatcctttctgtatttacggtaatcgccctgtctttgtctgaaaataaaacaatgtccatttcggtttcggccggaagataaaacatctcaacaagaggcgattttgaagaaaatccgttggcaagtttttttcggttagtttttgtttgatatgacttcagcggaactctggccgcctttccgttttcaaagaagaatactaaatctcctgaaaaatcatcggttgcggacatacccacaatctcttccttttcagttagtccgacaagattgggtataaattctcccagcaaacttgctttgctgtcaggtacgtcgtaggctttgattttataaacgtctcctgatcttgcaaagaatataatttcactgctgttctgagcttcaatctcctgaatcatagtatcatcgtccttgagccgctgttcaccgctggtgcggagtgatacgagtgagattttctttaaatagccgtgctgtgttctgaaaagtttgacgctgtaattatcaattatttcttcttcgactatgtctttaatctcatcagcagttataatttcagtttttctgtcgcttccatattttttcgctatttgtttcagctgtttttcaatcagtttgtttatttttgttttgctttcaagggtggatttcagttcctcaagttctttttttaaggtttctatctcagctatcctttttagaatataatctttattcaaattcctgagtttgatttcagccacatattctgcctgaacatctgttattttaaaacctttcataaggttcgggattaccatgctgtcgtcttctgtctcacggacaatttttattgccttgtctatatccaaaagtataagtgagagaccttcaagcagatgcagtttttcacttttcttttgaatatcaaacgctatggctcttttgatacagcttcttctgaatctaagccactcgcaaatcatatcgttaactcccaaaacaataggagaaccttccacaagaatgttaaagttacagccaaaactatcctgtaaaggcgtcattttaaagagtttcagcattagtttgtcagggtctactccacgttttaagtcgatagttattttcagacctttgaggtcggtttcgtcacggatatcagagatttctttgactttccctgacttaactaaatcaactattttgtctatgattacttcaactgtggttgtataaggtatttcttttatatcaatgcaattttggctcttgtcatactcatattttgctctgactttgaaagaacctcgaccggtgcggtaaatttccctgagttctgagcggttataaatcagttctccgcctgtcgggaagtcgggagccagcagtgtgtcaagtatatccgcgtccgggtcatgcataagcataatagtagcttcacaaagctcacgcagattaaaactgcaaatatttgaagccatacccactgcaattccttgatttggatttgccaaaatgcttggaaatgtggccggaagcagagtcggttctttcatagtgccatcgtagttatcaacaaagtcaacggtatttttgtctaaatcaccaaataattcactgcatacaggatttagttttacctcggtatatctcgaagcggcgtaggccatatctctcgagtaaacccgtccaaagtttcctttggatttgacaagcggcagcagtaaagcgccgttgccgtcagtaagtcgaaccatggtttcataaatagccgaatcaccgtgcggattcagcttcatggtttgtccgactacgtttgcggacttggtaagattgccgtttaaaagccccattttatacatagtataaaggagttttctgtgcgacggtttaagaccgtcaatttccggaatagcacgtgaaattattacgctcatcgcataaggcatatagttttcttccagcgtatctattatttgctgttcttggattatgggttttttcatttaatatattcactccagtattatgatacatctgccatttcgatgtattggtgtccgttttcggcaatgtgttcttttctgccggcaagattgtctccgagaagaaggtcaaatgtttcctgagtttttataacatcgcatggggtgactttgattaaccggcgggtttcaggattcatggtggtcagccacatcatatccggttggttttcaccaagtcctttgcttctttgaatagaatatttttgtccttcaagttttgaaagaatctctgatttttcctgctcgttgtaagcaaaatatgttttcttttttgaggttatctcatacaaaggggattcagctatataaacgaaacctttttcaataagcgtaggtactaaccggtaaatcatggtcaaaaccaatgttcttatctgatagccgtcaacgtcggcgtcggtacagattattactttgttccatctaagattgtttaaatcaaaagaacttaaatccttattatgttttgattttatctccactccgcagcccaataccctgagcaggtcaacaataacatcgctgttaaatattctgtcatactccgctttaagacagttaagtatttttcctcggagaggaattattgcctgaaattcgctgtctctgccaagcttacaggcgccgagagccgagtctccctcaactatatagacttcacgtttttcaggatctttgcttctgcagtcaacaaattttttaacgcggttagctacgtcaagattgccgcccagcttcttttttacgtttattcttgttttttctgcggtttcacggcttcgtttattaacaagaacttgattgcatattttgtcagcgtccatcttattctctataaaataaatagccagctgttccctcaaaaattctgtcattgcgtcctgaataaacttgttgtttatagcttttttagtttggttttcgtaactagtcatagtggagtaagagttagataccaataccaaactgtcctgaacatcgctgtattgaattttgccctcgcttttattgtatttgttgttggctttgagatactggtcaatagcatatacaaaagcgtttctaacagccttgtccggcgagccgccgtattcaagaaagctggaattatgatagtattcggttgtgctgaactcgttgtcaaaacagaatgcaaagctcatttttaacttatactcagggaggtcctccctgtctcttccgctgcgttcggtttctatataatgaacgctggtaaactctttttcttcagtcagctcttttatataatccactataccgttttcgtatagaaactcaaactcttcaaattcttctttggaaatctcgttttttaaaacaaatttaacgcctgaatttacaaccgcctgacgtctcagcgtttctttataaaagtccaacggtatgtcaatatcagtaaatacctttatgtccggcttccagcggattgtggttcctgtgtggcggtgtctgaattttgtctttttcattccgtcgatattttctccggcttcaaaatgaagctcatatttatatccgtctctgagaacttccacatccatatattcggagctgtattgggtagcgcaggcgcccagcccgttaagacccaaactatactcatagtcgccgccggtattgtttttgtattttccgccggcataaagctcacagaaaacaagttcccagttatattttttctcatgttcattgtagtcgaccgggattccgcggccgaaatcctcaacttcaattgagttatctaaaaatctggtaattattattgtgtcaccaaagccttcacgggcttcgtctatagagttagacaaaatctcaaacattgaatgttcacagccgtcaattccgtctgaaccgaatattacagccgggcgttttctaactctggcagcaccttttagggccctgatgctctcgttgtcatattttttagcgcacatattatattcctccaaacaattcgagttattataccataaaacgaaattattgtaaagcggtcaaatatccaaaaatccgacacaaaaatagaacgccggcagagcgttctatttaataaaattcagtttattttattcagtcatagttctgagagcggctgcttcaggggcatttgttacagatacgggatagcttgtatattaaacattccggcaactataattttaagagttagtttgctgagccagacccggttccgcccgccgggcccgggcggcgcagatatttactttagcagttgattccatataaagttgatgttattggttattcagtttataaacagtaagttaaaaaaatggtttacgcgctcggagctggcgagcgcactgggctaggccgcataccaatgaaagtatcaactgatatggaaaagaagacaatttaaaatataaataacttgtatattagacattccgtaaactataattctaacagtcagtttgctgagccaggcccggttccgcccgccgggcccgggcggcgcaaatagtaactttaattgctgattccatataaagttgatgttttggttattctgtttataaacagtaagttaaaaaaatggtttgcgcgctcgggtccggcgagcgcaactgggctaggctgcataccaatgaaagtatcaaattaaaaggggaaaagacaatttaaaatataaataactttatattagacatttcggtaactataattttaacagtcagtttgctgagccaggtccggttccgcccgccgagcccgggcggcgcagatatttactttaaaatatatagacttcctcaaaatattgacagctttaggtatgttttagaatttagaaataatattataactcgccgcgtctttttattcagacgcggcgtttttgtgtttaaaacaaaaatatttatggtatagttaccgaatttatgcagaataatattattaacaaatatgaagcgtgattaatttaggaaggaatgagatacatggaatatttaagcgaatggacagtatctcctgagaggtggctcaggcttggatatattttgggcgcgtcggaaaacggcggaagaataagcataagcagcgacgaggaggatttgtctaaacttgccgcagacacaatcaaaataggcgttaaatacgcaggctcaaaagtgtataattttggggaacaaaatttgcctataatgcgtcatgccgtcaggttttataaaaccggcttaggcatttttgtcaatacaattaagggcgataacggcaatgtgttaaacgtggatttgttagataaccgcggtattaaagtgccgctcaaaaatttagttaagcgtgaagagttagccaaagctgaaagtcttgtcacttctgatattactatgggaacggttgggcaagaggtaaccttatttgagtttaaaacgcattatatgagacatattatcaacagtatcaaaagtgatacgtttaatatgaatatatgtctttcaacaaaatcaaagactatttcagaaattttgaaggtcgttcttgatgacctatactcaaaaatagagcctgaggcgctggaaaagtatgagttcagcggtataataagcgaaaacggagagcagattaatttatataaatcagacggcacagaactttccagagaacaaattttatcagtaatgatttatgttttgctcagagacagttctataagaacctttgtggttccggacactatatcagaatatactgaaacagcgattttgaggcttggcggaaatgtgatcagggtatcgggcggcgattcggagataatggagaaaataatttccagcggaagcagcgaacaaatgctgatgcagtttgacggaatatatgcggcagtaaaaattttggattttctgaatagatacgatattagttttgacagtctgacaatgcatttgccgcagatttttaaagccgaggcagaggttgcctgcggcgacgaaaaacaaatggaaaatataataaaatctttaaaaagacagtttaagaataatgcaactatattgggcgatagtgacacagacgatgaaaaaggaagtgataataacaaaaaaagtgaaggaattaagattgaaagcaatggaactgtaactattgttttcccgggaagcggaaataatatattaaaaattatttctgagtccgaatctatggaaacggcggaagaaatatcaacgctgtttaaaaataaaataaaaacacttgcaaagagctgaacggtatgttataatgaacacgatttgtgagacaggcgctcgcttgtttcaccgtacggaaccttgcccggttattgccgggcgctttattatatgacagatttttgcatatcctaagattccgcgtctgtgtttcgctgtcaacggtcgatatttaatggctgcgaataagtttaaggcgtttgtatcttggattacgccgaatcgggtcaattttaaaaagtcaaaatcttttcattaagcctgcaggcggaacggatatggttgcattgcagcggaaaagttttgattcggaatggttttgattgcagatttgaatacaaatgactgaaatagtagtgtttcagggacttggtttatgtcttgagtattttatactgagaattttttagttttgataaaatatatagggtatattttttgtattgtattttagtttgtaacagctgttttggctttagattttctgtagggcgtaatgtgtgttaaaacctttgtctgtgcaggaatttgttgttatattatccggaacgaatcgaataaaagttattacaggaggaaaattttgaagaataataatgatacacgacagaacaacaataagcaagctcagaacgtcgctaacaagatggcgcataaggtcgtggataagatagctaaaatcagcggcgttaatgagaaaacaaacaacaataataatcgaaataaaaataataatagtaacggtaaaaacggaaacagaaacagcaatggaggaaacagaaagaataatacgccgaaacatacagataaaccaatccgtattatacctctcggcggactgaatgaaatcggcaaaaacttaactgtgtttgaatatgaggacgatgctttgatactggactgcggtatggcgtttcctgacgatgatatgctgggtgttgatattgttattcctgatataacgtatcttcataaaatcgcggataggattcgcggcatagttttgacgcatggtcatgaggaccatatcggagctttgccttatgttttaaaagaattttcagttccggtttacggaactagacttactctcggtattttaaaaaataagctcaaagaacatggtatactgaatcaggtaaagcttaacacgattaatgcaggagacaaagtgaagcttggagcatttacggctgaatttattcatacaaaccactcaatagccgacgcggtagcaatcgcgcttcatactcctacaggtataatactccacaccggcgattttaaaatagattcaactcctatagacagcgatatgattgacttggctcgtttcggcgagctgggaaaggaaggtgtgttagcattattgtctgacagtacaaatgctgacaggcccggagtgacatttagtgaaaagtcaatcggaaagacatttgacaatctgtttgaaaaaggcgagcagaacaagcagaggataatagtagctacgtttgcatccaatgtacatagggtgcagcagattattaattccgcggtcaagtataaccgtaaggtcgctgtgtcaggacgaagcatggaaaacgtaatatcggcggcaatagagcttgagtatatgcacgtgcctgaaaatacactgattggtttagatgagataaacaagtatcctaaagaacagcttgttgttataacgacaggaagtcagggagagtcaatggctgctctgacaagaatggcgtttaccagtcacaaaaagattaatatagaaccgaatgatttggttatcatttctgcaagccctatacctggaaatgaaaagtctgtagccaatgttgtgaacgagcttttaaagcagggagcagaggttatatatgaaaaacaggctgacgtccatgtttccgggcacgcctgccaggaagagctcaagatgatattgtctttagttaagccgaaatattttattcctgttcacggagagtaccgtcatctttgcaagcataaaggtcttgctgttcacacgggtatagaccctaaaaatatatttgttatggacttgggtaatgttttagaattgtcgcgctcatctgcaaagatagtgggttctgtgccgtcaggcaaagttttggttgacggattgggtgtgggcgacgttggcaatatcgttcttcgtgacagaaagcatttggctgaagacggtataattatagtggtaatgacaatagaaaaagagagcggcgagtgtgtttcaggacctgatataatatcaagaggttttgtttatgttcgggaatctgaagacttaatggaagagattaagaaacagacaacttctgttgttgaaaattgtttatcaggccacagttttgactggactactctgaaaacaagagtaaaaaatgatgtcggcaactatctatatgtcaaaacaaaacgcagaccgatgattcttccgataattatggaagtatagaatatttgatatgtaaagttttgcgtattagcccttgacttatttggactcatatagtacaatgaaaattgatgtataagaactatatgtcagacagttcattagtaccatcctgtctaaaaataaaactagggcgagttttgaatattacgtaaatctgtgcatattaacataaaattttaattgcattgtttcgtcaataaacaaaagacgctctgtcagagcgtcttttattattataaattatttaaataaaaaaggagattcggatatgtatacagtttcgtgtgaaacgcattttgattcagcacattttctattaggttataaaggcgggtgtaaaaacattcatggccacagatgggttgtcagcgcgtctgtcagcagtgaaaccctgatagaggaaggcggaaaccgaggcatggttatagactttaatgaagtaaagcctgttttaaatgaactcgtagaatgttttgaccacagacttgttgttgagagagatacgcttcgcagtacgactatgcttatgcttgaggaagaagagtttgaggttgcagaggttgatttcagacctacggttgaaaatttttctaagtatttttatgatgaattaaaaaagcgcggcgttcctgtatccaaagtaagagtttatgaaactccggaatcttatgccgaatactgtgaggactagtatgaatcatgacagccaggcgtttaaagtatgcgagaagtttgtaagtataaacggtgagggaattaaagccggacagctttctgtttttgtaaggtttaagggctgcaatcttgactgttcgtattgtgatactaagtgggcaaatgaaaaagacgcggattttgagtctatgtctacagacgagatagttaagtatgttgttgaaacctctgtacagaacgttacattgacaggcggcgagcctcttatacagcccggtatatccgggctgataaaaaacttgaaggaaaacgatcttaatgttgagattgaaacaaacggcgcggttaacttgaagccgttttgttctgacgaaacgcgtcccgattgttttacaatggattataaactcccctcgagcggtatggaagacagtatgctgactgataatttcttttatctgaaagacagtgactgtgttaagtttgtggccggttctgaaaatgatttagaaaaagctctcaaaattatacatgaatatgatttgacaaaccgctgtcatgtttatatcagtcctgtatttgggagtatagaacctgtcaggattgttgagtttatgatagaaaatgttttaaataatgtaaatttgcagattcagatgcataaggttatctggaatccggaagaaaggggagtataaatttggctgagaataagaaaattgacacaaaagccattgaggagcatatcagaggaattttgacggctttgggagacgacccaaaccgtgaaggtcttgccgatactccaaagcgtgtggctagaatgtatgccgaagtttttgacggtatgaattatactaaccatgagatagctcagatgtttaataaaacatttgaggacgatccggattcatatcataactcaaacgatattgttgtggttaaaaatattgaagttttcagtttttgcgagcatcatatggcgcttatgtatgacatgaatgtttcggtggcgtatattccaaacggcagagttataggtctgagcaaaatagccaggatagctgatatggtggcaaaaagactgcagctgcaggagcgtataggttctgatatcgctgaaattatgcaggagattacaggcagtgacgatgtggctgtaataattgaagccagccatagctgtatgaccgcgcgtgggattcaaaagccttcggcaaaaactagaacacgtactatgagaggaaagtttgagagtgacacgagcttagtcactcagcttatgggagagtagagtaggagacgataaaatggataacaaaaaagctttggtgcttttcagcggaggggttgacagcactacagcgcttgcaatggctgtgaaaaagtatggcgctgataagactgcggcgctttctgtttcgtatgggcaaaagcattcaaaagaaatagaagcggcgcgtaaaattgccgattattatggtacagaattactagagctggacctttcaaaaatgtttgaatacagcagctgttcgcttctaaagcagaatgaggatgctgatattcctaaagaaagttacgaagaacagctgaaagatgctgacggcgagccggtatcaacatatgtaccgtttagaaacggtctttttttagcatctgctgccagtatagcgctatcgctggaggctgagataatttattatggagcgcatagcgacgacgcggcgggaagcgcttatccggactgcagtaaagtgtttaatgacgctatgaatactgcaatatatgaaggcagcggacataaaataaagatattggcgccttttgtggaatggaataagaagcaagttgttgctgagggcgtgaaattgggagtgccgtacgaaatgacgtggagctgttacgagggcggaaatgagccgtgcggtgagtgcggaacctgccgtgacagaagagaagcatttttggctaacggtcttgatataaaatagaggtgatagatttggagaatattcaaagagagcaggaaggtttgactttgctgggaaatcagaaaacggtatataaagcagattatgctcctgaggttcttgaaactttcgagaataagcatagagataatgattattgggtaagattcaactgtcccgagtttacttcgctttgccctataacaggtcagccggactttgcggaaattattatttcctatgttcctgatgtaagaatggttgaaagtaagtctcttaaattatatttgtttagttttcgtaaccacggtgattttcatgaggactgcgttaacaaaataatgaaggatttgattgagctgatggaccctaaatatatagaagtatttggcaggttcacgccgagaggcggaatctcaattcatccatatgcaaactacggcagacccggaacaaaatgggaacaagtggcttttgaacggcttacacacagagaaatagtataagaaagttttcaatttgctgttgtggaaattgaattcagtattataatgtataatagtataagagtttattagataccgtttttaaaaagattttttcttgttatgcgggatatttgatatgagaataaaagtttgtgaggttacaatatgaatgaaatatatgattatcatattgttacagatagttctatggagaaaggtcagcatattattttcaatgatgttaattatagcggcgtttataaaagagtaaatgataaaattcaaattgtgaaagatatttatatatcccgaaaaatataatgcggatttttttgaatatcatacgaaggtagcaatgagagaattagcattagaaaaagtgcgtaaagatctttatcttgagtatccgtccagaatgagctgtttatatgtttcgaacagtatagaagaatctgaaaaatgagcggatctgtttattgacttaaatataccaacttattttattgttaaactgaaaataataggaaacatgtttgtaggcgatgccaataattgttttgaagcaactttatataaagacaaaaatttattgcttgcaaaacggtactggaacaactgtcctaatgaggatggtgttccttcaataaaggaaatattagtaaatggtgatattaaggttattgaaattataagagaaataaatgcaaatgtataattatagtttaaagctgagccatagtttccgttaataaaaaaattttccaagcttttttagtttgatgataggtatataagaataatatcgttattatttgatagcgaatccggattttttattattagtaaaaaagttaaaatatactaataatattgaagtgtcaaatgtcttaactagcgtgcgttttaataaaatataattatacttagtctttacgtgttgaaatcggcagttatatgtataacaacgaaaaaatcaagtttcagaacttttgatttttaagaatagattatattattgcatatatgaatattatgacggctttttaaagccgtttttattgtgcttaacttatagtcaaaaattttgaaaattaaagtcaaaaaccataacatcactattgtttaaattttatatcaatggtataattatcctaataattattaataaggagataaaaatggatactgtagaaacaaaaaattttattgaatccgggcaggcgattcttggaattgagtttggttcgacaagaataaaagcagttctgattaaccgtaatcatataccaatcgcttcaggcgcacatgactgggaaaacagattggaaaatggaatttggacgtatactcttgatgatatttggtccggggttcagaaatgctatgctgatatgtgtgatgatgtttataaaaaatatggcacgaaggttgaaaatctttctgctataggtataagcgccatgatgcacgggtatatggcgtttgataaaaatgatgaacttttggtgccattccgtacttggagaaacactatcaccgctgatgcggcaagccgtttgacagaactgtttaatttcaatattccccaaagatggagtattgctcatttgtatcgggcgattcttaatggagaggaacatgtaaatagtataaactacctcacaaccctggccggttatgttcactttgtgctgacaggtgaacgtgttattggtatcggagacgcgtcgggaattttccctgttaattctgaaactaaggattataattcagacatgattaatagttttgataaagtgatttctgaatataatttttcctggaagctgtcagatattttgcctaaagtattggttgccggtgaagaggccggagtattgaccgaaaagggagccggaatgcttgacccgacaggtgctctgaaacccggagctcgattctgtccgccggagggtgacgcaggaaccgggatgactgcgacaaacagtgttgcgaaacgtaccggaaatgtttccgcaggaacatctgtgtttgcgatggttgttcttgagaaagaattgtctaaagtatattctgaagttgaccttgttacaaccccgtcaggcgagccggtcggtatgattcactgcaataactgcacttctgatataaacgcctgggtaaatatgtttaaagagtttttgacggctatgggatttaatgcagatatgtccatgctttataaaacattctttgaggcggctttaaagggagagccggattgcggcggactgcttgcgtataactatttttcgggcgagcatataacaggatttgaagagggtagacctattcttgccagaactcctgaaagtaaattcagttttaacaattttgctcgggtttgtttatattctgcgttagctacattaaaaattggattggatataatgctgaacagagagggtgtgaagcttgaaaaaatgcttggtcatggcggattctttaaaactcctgaggtaggacagagaattatgggcgctgcgattgatgtgcctgtaacagtaatgtcgacagcgggagaaggaggagcatgggggatagctttgcttgcagcatatgtaatagagagaaaagataacgaaagtcttgatatgtacttggatgaaaaggtattcgggacagatgccggcactaccattgaaccacgagaagaagatgttttagggtttaataaatttattgaccgatataaaaaaggtatctctattgagaaaacagcagttgaaagtttaaattaattattgatataaatatatttttagtaaaaataatatactaaatattttgatttgttttataaatatagaaataagctgtctattgttggaccaacctcaaaaagttagattaaaagtctgacaattggaaggccggctaatatttgacagcttatttttattaatatataaagtaaataatagcggaaagtcagctgaaaaccggacggaaaaattaaaggtgtttttagtgaacatcggtaggcttgtgttaacaagcgcgttaggtgagctaccatctgaacacgcagtgttcaatatataaagtaaatatttattaaaatttactttgtatatgaccccatataaaaaaattttttattatataataatgtatttgaatcatttaattattacactaaaaaagcgcgtttttcagtgaacttcggtaggtgtatttgtgaccacactgaaggtaggggtcacagacatagaaggataatcaaaacaagtcactgtatattagcagacagagttttattctgttgcattttttataaatggaagacccttttggaaaagctgaataattacgttcaagtagtttttgttatattttatttaattaaaataagctgtccatttaggacagcttatttttaaaatttggagcggaagacgagattcgaactcgcgacgttcaccttggcaaggtgacgctctaccactgagccactcccgcatatatacactttttaatgcttaaatattataacatgaagtcagttatctgtcaataccttttacaattttttattatattttatttacgtaaaattattttatactaaaattatagttctaacgatgaaactgattataaatatttaaattaaaattttattaaaaagtctattgaaaacaagtcagtaaaaaatcagcggctccgtaaagagccgttggatgtgaatagtaattttaaccgccgaacaatccttttaccttatcaattatgccttcagcttgattttccaaattttctacaacgcttccgttagggtcaagctttgccttcaccatgtcagctatattttttaattgttcgtccggcaaatcaattccgataagaccttctattgttttgattgggtcggatttaaagttgtccatcaatccagcatcagattgaagtttctcaacggcttctttggctttgtccataatttctgcgatttccataattaaacctccttaaaatttaaataaactgcttataaatatattttaaataaaatgtataaaaatgtcaatataaaattgtatatttaattaaatatttttaatatattcaaaaactattgcagcgatattgatttattaggataaaaataaggattttatttttaatagtataaatggcctttatataaagatttggattttaatacagtatttttttaatatatgttatattaaaaatttttaaaaattatagaatatatgaagtgaaacattatgaaatgttcacgctgcgcggaatatgaccggtcactcagcgggttgtgtaaacacgcaatacgtcaaactaagtcttattatatgacaactaagttaattattggcgtttatagtttatataatatacatttttgtttaaaagtgtagtcacagacattgaaggcttaaggataagagatacgttggctcacacctacccacaggtaggggcatagtacacctgccgatattcactaaaaatactgtcgccgtataataaaaattaataaataaattattatacttgaatacacaaaattccattacatccgctgtacatacttagaaaagtttgttatacttttttcgattacaaacttttccgcagctgcgcgccttacgcggcagatttcatctgcattgagtattcatattattgacattgtaggtaaatcaaaacaagttattttgtattacatccaccttttcaggtggagtcacacctatcgaagcttgctatactgcatttttattcaatttttaatttctttatattgtaaacacacttaacgtttctgtatagttttctgtttacttttcagtttattcagaatatgaccggcagttctaactcgcattatattaattgattattgcggaacatggtttaaaatatgtaaatgaagtgaacctgtatggattatatagagaaggtaaattccttttatatagtaaagattgaaaatttattgattaagattaaaaagcaatttcattgaagatttcatgatatattaatttttataacaatgataaaagtacatataaataaaaggaatgaattaggtattgtacctaattcattcccattaaagctaataaaaatctgtctaaacttttgggttcatttcaaattgaatcctgttctgtaatattattttattttgtattctttttaattttgtcccaatattcttttgcggcctgttcgtttttattatttgcgtattcataatactttttatcttttatattgtcaggtaaatactgctgaacaacataatggtttggataatcatgcggatacagataattctgtcccttttcagcattcccctcaccgtcataatgcttgttttgcagctgtcttggtattgagccggtgtctattgtttctatatcacgaatagcgttgttgattgccatataggccgagttggatttgggggcggtcgccagcagtacagcggcttctgccaaaggaattcttgcctcaggaaagcccagcatgagcgcgctgtctacacaagcctttacaatcgtaatcgcctgcggataggccagtcctatatcttcacaggctataaccataagacggcggcaaatcgactggatatcatcggcctcaaccaaccgtgcaagatagtgtaccgctgcgtcagggtcgcttcctctgatagatttttgcagtgcgctcatgacatcgtattgactgtcgccttttttgtcaaacttaaatgactttttttgagtacattgctcagccagctccatggttattttcaggttgccctcgctgtcgggaggcgtatacataaccgccagctccaaagagtttaacgccttgcgaacatctccgccggctttttcggctaggtgacgcataacgccgtcttcgcatattatttttgtatccgggaaatcatcggtttgaattttttcaagcccgcgttctaaagccacagaaatatcatcaggggtcaaaggcttaaactcaaacactgtagagcggctgagtatcgcgttataaatatagaaataaggattttcggttgtgctggctatcaaggtgatttttccgttttcggtgtattcaagcaaagattgctgttgttttttattaaagttctgtatctcatcaagatacaaaagtattccgttctgtccaaacagcccgtcgctctctctaacaatattttttatatccgacacggacgcgtttgttgcgttaaggcgatacagcgccttgtttgatgatttagcggctatattggcaactgtagtcttgcctgtgccggacagtccgtaaaatatcatgttggggatatttccgctctcaataatatttctgagtatgcggttttttcccagtatatgctgctgacccacaacctcgtctaaggttgtgggtctgagtctgtccgctaacggtttattattaagcatagagtgggtgtttgtcacaaagagcctgaacacgttttttaacgtcctctttgtttccttcaaaatctttgataatcaacgaaataagttctgcaacttcaaccatgtcttcctctttaaaaccgcgggtagtaacagccggagttccgagcctgattccgcttgtaacaaacgggctcttagggtcgtttggtatggtgttcttattacaggttattccgacctcatccagcatcttttcaacttctttaccggtcaaatcctgctttatcaggctaaccagcatgagatgattgtcggttccgcctgaaacgatttcaagccctctctcctggagtgcttcagcgagagcggaagcgtttttcttaacctgcttttgatattctttaaagtcgtctgacagagcttctttaaagcatacagcttttgcggcgatcacgtgcataagaggtccgccttgatttcctgggaaaacagctttgtttatcatcggaccatatttttctttgcaaagaatcatgccgcctctaggacctctaagggttttgtgagttgtggtggtaacaaagtccgcataaggtactgggctttggtgtaaacctgccgcaaccaatcctgctatatgcgccatatcaaccatgagataagcgccaacctcgtcggcgatttcacggaagcgtttaaaatctatttctcttgcgtatgcgcttgcgcctgacaatataagtttgggcttgtgttccaaagcaagctcacgaaccttatcatagtcaatgcggtgcgttaccgggtcaactccgtatggcacaacgttaaaatattttcctgaaatatttaccggtgaaccgtggctgaggtgtccgccttcagcaaggctcatgccgagataagtgtctccgggctccatagctgcaaaaaagacagcaaggtttgcggttgctcctgagtgcggctgaacgttggcaaattcagcgccgaacagttcctttgcgcgctctctggcgaggtcttcaactatatccacatattcacagccgccgtagtaacgcttgcctggatagccttcagcgtacttgtttgtaagcggagtgcccattgcttcgataacggcttcgctgacgaagttttccgaggcaataagctcaattttattgcgttgtctgttgatttctttttcgattgcctcagtaacttcagggtcaaccgattttaggttttcaaattcaaacatcaaatagtcctccaaatatattatttttattatttacaaaataaatgttgaaaaaaacatacattcatattataatgttaaaaatagatttttgcaaggggtattttaaatatgagggaaaaaattgctgataaaaaagagagaatattaaaaataattgagatatttggaaaagtgtacagtgacgcggactgcaccctggaatatgacaatccgcttcagttactcatatccacccagcttgcggcgcagtgcactgacaagagggtcaatatagtaacaaaggatttatataagaagtatagggatgtatatgattttgccaatgctgacgagcttgagcttagagaggatattaagtctacaggctttttcaggaacaaggcgaagaatataataggctgctgcaagatgctgatatctgattataacggagaagttccacgtgaaatggaagacttgctgaagcttcccggcgttggtcgaaaaacggcgaacttagtcagaggagattattttgggataccggggatagttgttgacactcatgcgaccaggctttcgaacaggttagggctcacgacaaacaaggacccgaagaagattgaaatggatttattaaagctagtgccggaagaatatcagacgtctttctgtcaccagctagtgtatcatggaagggagtattgtcctgcggcaaggcctaaatgtgatatatgtcctataagcgaattgtgcccaaaagttggcgtatgattttttattcattaaaaaaattatatatctactatgtatatgaccccatataatatatattattttacttataataggtgtttgaaccatttctttttctggcaagaaaaagaaacgcttcacctgtgaccacacctgaaaggtgtgtgtaataaaaagttacttgttttgaataacctacgatgtcaataatatgaatactcaaataaaagaaaaagtgcttgctcgcttaggtcgcctgcggctccaaggggcgctcgcccccgctaatttcatcttgaatctgcgcttcaagatgaaaaagccttgtaactttcccgttgactatgtgtactgccgtgaataaagatattccgagttcttatttctttaattcacaaaaatgctgagggtcagcgagcatcggtagggcgcatttatgcgcctcgttaggtgagctatcatctgaacacgtagtgttcaatatacaattatctttattataactatatacatagtaaataaaaaagcacctgtcattcgtgtttacgtaataacaggtgctttagtcttttttaatatcatttagaatttcaaaaaaataatctaattgacgtggtgacaaggaaaataatatattcaatatcttttgtattttatcatcatctttaatataataattaaagaactcatatggtgtaacttctaaaaattcacaaatataaaagaatccacttaatgatggtaaagaatatccggattcaattttatttatatatccttcactttgaccgataaactcattcatccggatatgagttaatattattagtgcgatttaataagtaatcggttgaggtattgtaaaagtcggcaagtttcactagaaaatgtagaggtatagtttgaaaacctcgctcataacgagagtatacagtttgttgtattcctaaaatatcagcaatatctgtttgttttagtccagcatttatgcgcagaatttttaatcttttcaagtacattttaacatatcctccattaaacttctgagttttaatcttgttcatcaatattaaaataggacgagggcaaattaagattaagcaagtcgccgggtttaacctctaaaatatcggcaatattaaagaaaacttctaaagagaaggaagaagatatattaggagcttcaatagagctaagatgtgaacggctaatatgtgctttctcagcaagttcatgttgtgtatatcccttagcttttctcaaagcagaaatcattaatcctaattcaacgaatcggtctctgttttcaaaaccaacttctttacgcatttttatatcctcctaaaaaattattaaatatgtttttgtatattgaacactgcgtgttcagatggttgctcacctaacgaggcgcataaatgcgcaatacatcacaactaagtaatttattggcgtttaaggctatggcaaaagaagtcactttgtatcacacccaccaaaggtggggtcacacctaccgatgttcactgaaaaaactgtctttttgtactttagtctaaattaaacacccaacttttctttaaattaaaataattggaactcggtaaatctttattcacggtagtacacaaagtcaacgggaaagttacagggctttttcatcttgaagcgcaggttcaagatgaaattagcgggggcgagcgcccattggagccgtaggcgacctaagcgagcaagcactttttcttttatttgagtattcatattattgacatcgtaggttattcaaaacaagtaactttttattacacactaatttcatcttgaatctgcgcttcaagatgaaaaagccttgttactttcccgttgactttttgaactaccgtgaataaagattttccgagttcctgttgatttactagtgatttactaattaaaaaaacaagtttccagtataaattaatacaaaaaaactaggttttgagtgaactacggtagggcgcatttatgcgcctcgttaggtgagccaacatctgaacacgcagtgttcaatatataattaacaatttataaataaaaaatattcttgacaaaaatagaaaaagagaatataataaaagcagataaaaggtaaccgttaaacggttgtcaagagaaatatttgtttataaatataactgtcctgaccagaggacagttatattgcttttatggacactattataaaaattattataatagatataattactttaagtaagtatttccacataagcgacacctcctttctgctgtaagtaacagcatacggagatgacaaccgtcctacaattcccttttacccacttgatataattatatacaatttatcgaataaagtcaaattaaaaatcctttacatatattcacatttattaaaaacattcttgacaaaaagaataaaagaacataaaaaatataaataaaaaataaccgtttaattattgccaaaagatttagataataaaatatagccgtccttttgtaacaagggcggctatatttcttttaatgaaaaaccaatcattacatattggcttcaatgcttatttcttttccggttaagtattcaagaccgcctgactgtgacttgaatccaaacaccagcttatatgcggaaaggctctgatattttcctccgccgtcagattttgccccatattttttatcaccaaccaacggatgcccgtaatgagccagcgttgccctgatttgatgggttctgccgcttagcagctccacttctaaaacagacgcgtttccctcatattttataactctatatttaagcgccgatggtttcgctccgtcaatccgattctcactgaattttaccctatcgtttccgcactttagtatatatccctcaagttttccgctctcaggcgtaactcttccctccacccggcagatgtaaaacttcttaatttccctggtcttaatcttttcggttattatcctatgcgcctttaaattttttgcgcctataactaatcccgaagtgtttctgtctatcctatggcagagcgacggaagataagtcccgtttaaatccagttcgccgcgcttatataaatacgcccgaaactcgctttcaagcgaatccgcatcatcgccgctgtcctgagacttcatacctgacggtttgttcattacaactatattttcatcagtatatacaacagaaatatttccgtcacagcctaaccacttatcgtcattatctgcgcctttttcaaaaaattcgtcgttaatataaagttccaatacgtctccgccgtcaagctgaacggtaccgtcagttgtccttttgccgtttacctttatccgctttttcctcagagacttataaataatgcccgaaggtgcatcgggcattatcttaaataaaaatttatcaagccttataccgctgtcggctttggatattttaactgttctcatattcttcctctttcgctctgagcgccaaatcttttattacctctcctgcaattatcagacctgcaaccgacggcacaaagctgacgcttcccggaaccggtttattattttcactgtcatacaactgtatttccggcttctttgccttttcctctgaatataccactttcagcgatttaatatcccggcttttcagttcccggcgcatcacttttgccagcggacacatcttagtcgaatatatatccgcaaccttaaaagctgtcgggtcaagtttatttccggctcccatggcgcttattataggaacacccatcttgttgcacctgcatatcagttcaattttggctgatacggtgtctatagcgtcaacaacatagtcatatttatcaagcggatagtcatcggcattctcgggcagataaaacaccttataggcattgacctcagcacaaccgtttatatcgagtatacgctcttttataacatcagccttgtattttcccacagtgctgtgaagcgccgctatttgacggtttatattgctcagcgacaccctgtcgctgtcatataaatctatgcttccaacgcctgaacgggccagcgcctcggctgtgtagcctccaactccgccaactccgaatacagccacttttgaatttttaagattctcaactccgtcatatccaagcagcatttcggttctttgcatctcttctctttgaatcctggttccttgaatctcgtttccttgattctcgatactttgattcttgatactttgattcttgatactttgattctcaattccttgattttcgttcccttgattctcagttccttgattctcggtgctttgcatctcttctgacattatactttcccacatctttcattgcctgataatatctttttaaactttagagcaaacatcagcgcggtaaacaccacggccaaaaagtctgaaatcggttccgctaaaaataccgcgaacactttcactatattccctccgctttccaaaagaggcggaatattatccggcgtaaatataccggcaaatccgggagttataatattcggcagtataaaaattaatggtataagcagaacgatttttctaagcagtgccaaaaatattgaaactccggcctggtttaatgctataaacgtctgctgacacgctatttgtataccaaaaatacatacagaagctatataaatcctgagcgcccattcagcaaacgtaacaagacttgggtcgttgctgaacattcctaccagaaattgaggggcaaacatacacaccgaccagaataacaatgaaaaaataaacgagaacaaaagcaataagccgaatgctttttcaaccctctttttgttgccggctccatagttatagctaattataggctgcgcgccctgcgtaagtccctgaagcggcatcatagcgaactgcattgcggttgctagaatagtcatagccccaaccgctatatctccgccgtactgagccagcgagaaattaaaactgaccgtcagaatactctcggtaaactgcattataaacggcgacagtcccagcgccagcactgggagcataatttttttatcaaagcccaggcaggatttccttattttcaaaacactctttttacctgacaagaactttattacccacaccgctgaaacggcctgggaaataactgtagcaatagctgctccgctgacgcccatattaaacccgaaaataaaaatcggatccagtattatattaataaccgctccgattactattgtcagcattgcctttgtagaaaagccctgtgttgtgataaacacattcattcccataacacattggacaaatatagttccaagcgcataaatcctgatataactcattccgtagcttaaagttgtgtcccggtttccgccgaacatcaaaataaaaggctccgcaaaaatcaaggtcagaactgttaatatcaccgctattattaccagcgttgtcaaacagttacccatgattttttcagctgttttattgtctccctgacccatgcttatagcggcgcgaggtgctccgcccattccgaccaaagctgaaaatgccgttatgataactattataggaaatgttacgccaactccggtcagcgctattccgcccacgtcgggaatatgacctatgtacattctgtcaaccacattatacagcatattaattatctgcgctataatagtcggtatcgccattttgagcataagctttcctatactgccggttcccaaatcatgtccgccttttgccggctctgtattttctgtattctcagtgttttcagtagtttcaacagactcagtatattcagtgctctcaatattctcagtgctattttctgtgttttcaatagattcgttatttttattttccattatttcaagtcctatcaattaatttatattcgtcttaaaacatcttttctatgaagcatttcatccaggcgctcaatatagtccttcgcttctttaacgttaaatatccgctctatacgttttgtctcaaggtcaacagttttggtcacaccgccgcagcccaaagagattatagtctgtatctcctccataatataaagattatagagagactcgaacccgggttttgaatacccgacattttccaggtttccaagctgatttttctgtcggtacatataatacggaaactttcctctctccgccagatactttctggcatatgacaccatttccgcaaccaactcgccttttgccaaatcgtactcgtccaaatactcattcagccttgacgaccgctttatactcattgtatgtaccgtggtatcctcgggttccagcttctcaacctcgcttaaggtatacttaaacatttccatatcctcacccggcagacctgcaatgacgtccatgtttatattatcaaatccgcagtgccttgccattttcatagcttcacgtatatcatcggcgctgtgtgccctgccgattattttaagtgtgctgtcattcatagactgtgggtttatgcttatcctgtccacattatacttctttaaaacctttagtttttcttccgttatggtatcaggacgacctgcctcaacagtgaattccttcatttttgaaaggtcacaattgtcatagagacagtctatcatctcttcaagcaacctgggcgtaagagttgtaggagttccgccgccgatatatacggtttcaaccggggttccgttatggcttattatatcagccgtatactttatctcctttttcagcgcctctatatactcaggcataagagccgccgcctgctttgtgccgttggtaacaaaagagcagtaaagacacctgctcgggcaaaacggtatacctatataaatgctcaccccgtcttgatacatatcatcacgtatcggccgcaatgctctcgccgcctctaaggcaagagacgctttttcatatgtggtaccgcactcatttataaaataacttattacctcatcatcgctcatgccctcgtcaaggagtttagtggcaattttagccggacgtatacccgtcaatattccccaaggggattttgtttcatctgtaatttctgacataaatatactcctaatcctatctcaagtatgggtttccgcggcgctcgtctccaactgtagtaggttccccatgacccggatacagacgaacactgtcgtcaaacggcattaactttgtcttaatcgactgaacctcctggctcatatcacctgtagggaaatcggttctgccaacgctgaatctaaatatggtatcgccgcagaaaactttcccgtctataaccaaacagattccgtctattgtatgacccggtgtgtaaataactttaaactcatcatttccgaacggaataacatccccgtcttttaacgcaatatccgccttaaaagtttcttcttttctgccaagctcaccggataggttaacgcgcggctcgcctagaacctcagcgcttttttcatgggcgtaaaccttagcctcaggctccgcttctaataacccggacagtcctcctatatggtcatagtgaccatgggtcaggaatatttttttaagcttgcagccattttcttttattaaattcaaaatcgacttatggtcggctgacggatctataaccgccgcttcaccgctgtcttcatccaagaaaatataacagtttgttgcaacaggtcctaaaatcaatctttttattatcatagcaccatatcctttataattatttactgtctgcttctgctgaccgatataactccgctgagcgctttaagctttctctttatagtgtcaagctggctcgtatttgaaatttcggtcgttatttctattatagccaaatcgtttctgccggttctagcgttaacattagttacaggcgcttttgcatcgtttataacagtcagtatatcaaccagcagattaaccctgtctgaagcggttatcgtaatcatcgactggaacgaagacggcggagtatcgcctgcccaatgaacagaaatcaatctgttccgctcctgctcagacgcagcggcatgtatcatattcagacagtccgctctatgaacggcaacgcctctgccgcgagtaacataaccgactattttatctcccggaaccgggttgcagcagtgtgaaaacctaaccatgcagttatctataccctcaaccacaacgccgcttgtattgggtttggctgtggtcttcaccttcagcggaacattgagctctgccggagtaagctccatttcctgaagctgtttatttttgcattcggtcagaaacctggttacaaatcgattagcgtttgtgcttccgtatcccacagccgcatacaaatccattataccgttaaatccgtatttctttagtaacgggctaataaaggattcatcattaatatatttgacaggaatactgtttttagacagttccttttctatagtctcttttcccttttctatattttcctcacggtttacctttttaaaccattggtttatcttgtttctagcctgagacgtcttgcagattttaagccagtcaattttcggtccatgcggaaccgaactggttatgacatcaataaaatcaccatttttaagctcgtgcgaaagcggcacaatctttccgttgacttttgcaccggtcattctattgccgactgcgctgtgtatcctataggcaaagtcaattggggttgagcctgcaggaagactgacaacgtcgccctttggtgtgaagacaaacacctcgtcgctgaacatatcaatttttaaggtgtgcataaagtcttcaggactggtgctgtccttttgaatttccagcagatttttaatccattccagcttgtcgtccatatcgctggaaccgcttttcccctctttatacttccagtgagcggcgataccgttttcagctatttggtgcatttcccatgttctgatttgaatttcaaacggggtgccattaggtccaataagcgttgaatgaagcgactgatacatattcggcttaggcatagctatataatctttaaaccttccgggcatcggcttgaacagttcatgaaccatacccagcaccgcgtaacagtctgaaactgtatcaactataacgcgaaccgcaaataagtcgtaaagctcgtcaatagttttattctgcataaacatcttgcggtatatactataaaaatgcttggctctgcctacaacatgagcttttatatgaagttcatccagcttcttttgaagtatttcgataatctcgccgatatacttttctctttcttcacgcttctgagctatattgtcaactatctcataatatcctatagggtctatatacctgagcgacaagtcctctagctccatttttatctttgacataccaagcctatgagccaaaggggcataaacttccaaagtctccctggatattgccctttgacgctcctcaggcatatatttcatcgttctcatattatgaagcctgtcggccagctttataactatcaccctgacgtcttccgccatagcgaaaaacatttttctcaaggtctcaatctgctgttcctctttagaagagtatggtattttatcaagctttgtaacaccgtcaaccaacagagccacagtctccccaaattctcggactatatcctctctggtggagtcggtatcctccacaacgtcatgaagcagcgcggcaactatagactccacatcaaactccatttcagcaattattgaagcgacttgaatcgggtggttaacaaaaggctcgccggattttcttgtctgcccgtcatgcttttcgacagcaaaattatacgccttttccaccatggacaaatcgcctgttttattatattttcttattaactctataagagtagaaagctcgttacctttcataattcatcactcgccatatagcagtttgaaccggtctcatcaaaaaggtatgctaaacgcgatacatctaagatacagccggttcattccatatttatttatataattagtatttcttttatcttgcgtctttaaactccgtttttctcatatctttcaaaataagctgaacattttggaagcctttatagtcgttaatatcaagagcaaaagcaacgtcaatatagtcgccttccctaaacatactataataatctcccattccaaaaccaacggtatccaaatactttccgtccttataaagggtcatgcgcagatgcttgccctcgctcatcacactgattctgtgaatctttatattgcgaacagaaaacgatggcgttgggttgtttactccaaaaggctgaagcttatttatatcatgaacagtatctatcgttatataaggaaccttgatttgagcgtccagagatatagtaggaacaagagtcatatcctcaatttttccctttgcatattcgttaatcttttttctgaaagcctcaatattctcagccttaatagtaagtcctgccgccagctcatgaccgccgaacttttctaaaagaccgctgcagttttccaaagcgccaaacagattaaatcccgcaatacttctgccgctgccctttgctgaatctccatcaaccgcaaacaaaatagacggtttataatatttttcggtaatcttagatgaaactataccgacaataccatggtgccagttctcatgaggaataaccaaaatatcatcatccttaatttcaggatgctgttcaatatattccagcgcctctttaaacatcttctgctcggtctgctgtctcagcgtattttcgtgacagagagaatcagccagcttagccgcctcctcttcatcttctgtaaggaacaattccacacttgtggaagcacagcccaaacgtccgctcgcattgattctaggagctatagtatatccgatagttgaggttgtgattgccttgccatttgtagacacgtcaatcagtgcttttaagcctatatttttagtggtcttaaatctctttaatccttcggttacaatcacacggttctcgtctataagcggtgaaatatcagcaaccgtgccgagacacattaagtccgcatattcatccatcagattttcgattggttcagaactgtcaagcgcctgtatcagcttaaacacaacgccaacgccggcaagacttttaaacggatactcacagtctttcctcttagggtcgatagccgcatatacgtcaggaatactttccttacactcatgatggtcggttattataaagtcaataccaatagacttagcataatcggcttcctcaatggcggttataccggtatccacggttataataacagcggtgccgtcagcctttatcttgtcaagagcgtccctgtttacgccgtatccttcaaccattctgtccggaacataaaatcccacttccaaacccatgtttttaagatacttataaagaatcgctatagatgtgattccatcaacatcataatcaccataaatagtgattttctcattattctttttagctaaaagaattctttcaacagccttatccatatccttcatcaggaatgggtcgtgcataccgctcaggtcacgggcaagaaaatcttttatctgcccatcttcacggataccacggttataaaggataatcgcggttaaaggtgaaatattgaaattcttagaaatttcaaccacccttgccttatcaaattctttaagtatccatttcttctttaacatacaaatttatctcctaaataaaattagtttactaatttaaacagtcatttcaatattttatcattactttcgaaaaaatacaacaatttttttacaaaaaacaaaaattttaggaatttggtcaatataatacttttatatcactgttttacagataatcggctatttgagttccactatcgtaacgccgatatcgccctcgccgaacctgcctaagcggtattttctgacatgcggatgatgccgcagatattcatgaatccctgccctcagcgcgcctgtgccctttccgtgaataaggctgacttcactgaggccgctcaatacagactcatccaaaaacttatcaacttcaagctccgcttcgcctattgtcatacctcttaaatcaacttcggtctttccgctcattgcagtattgattcctgtcgacctctttggagccacatagctttcaggctttgaacccttttcatcttcaagcaccactagatttgaaatcttagcagtgattttcattatgccaacttgaattactgccgtctgattatctttatttatcgaaagaacagttcccttgtcatttaggtctataatcagaacattggagccaagtttcaaagtgtttaaattaacgttcgactttacgccgccgctcctgcgatttttggggcgtacattagatttttccttgagtttcagctctttgcgaacctcttccattgccctgacagcttccttattccgcttttccttttgaagctgttttatctcttcaagcattctctccgtatcttcctgagcctgctttattattttttctgctttcgctctcgcgttatcatatattttatcctttttcttatctatcttttcgcgctctctttgcagttcatctttgagctgctctatttcacggcgcatccgctcctgctcttctctagctttttgagcggaaaccctgttttcttcaatactgccgagaacatcttcaaactttatattctcatctgacaatttctcttttgaacgctcaattatactatccggcaaacccaattttttagatatggcaaacgcgttgctcttgccgggcacgccaatcaacaatttgtaagtagggctaagggtttcaacgtcaaactcgcaggaggcgttttctataccgtctgtcgaaagcgcgtatagcttcagttcactgtaatgagtagtagccacaatctttgcgccaataagcctgatactttcaataatcgctgtggcaagagcggctccctcaaccgggtcggttcccgctcccagctcgtcaaaaagcacaagcgaattcgagcctgcattctctactatatgaactatattcttcatatgtgacgaaaatgttgaaaggctctgctctatgctctgctcgtcgccgatatcagcgaaaacatcatcaaacacaggcatctcgctttcctcgttggccggtatgtgaagccccgcctgagtcataatacaaaataagcctatagttttaagcacaacagtcttaccgccggtattgggtcctgtaaccaccaaaacgtcaaaatcatcgcccagccgaacatctatcggaactatttttgacttgtctataagcggatgtcttcccttaacaatttttattttgccgtcagtattcaatttcggacagacagctttcatgtcaagagccagctttgccttggcaaaaataaagtctattaaaatcaaagtctcatagttatacttgacctgctctgatatttcagcaaccttgtttgacagctcatataataccttttctatctccgccttttcttttatctccagttcgtgcagttcgttattggcgtttacaacgctcgacggctctataaaaaccgtgctgcctgaggcggacatatcatgaactataccgggcacctcactgcggtgctcggctttaaccggaacaacataacggttattacgcatagttactatattatccatcaaaaacttttgatagtgaccggaacgaaccatgctgtcaaggctgtcctttattttggcacctgtatttttcatctttcttctgacattagctaaagcgggactggccgcgtccgcaatttcatcctcagaaacaatcgctctgtttatctcgtcctctataggtttagcggagacaagctcagaaaaatattcctcaagcgcccctgtctgttccttagtatatctctttaaatttctgatacattttaaaagcctggccacattaagaagttcggccgccgaaagtgcgccgcccacatcaagacgctttatcgctccgtcaaccggctctactcttaatatttcgggcgagccaaatttaagcgacatagtaaccgcagcatctgtctctgcaagcgccctttccacctcgcggaaatctgacgacggcttcaattcttctgccattgtttttgcgtcgtcatttttagcacactctgaaagcgactttaaaatttttgtatattcaagagttgataatgatttctcttccatctcatatctcccagatttaaattcaattttgaaaagttccgttacagcttattatcccggaaccaacaacttaatattatacacaaataacagcggatagtcaacacgcaccccgaatagtataaaattaatatattaaaagtaataaaaattgttgaaaattaataaaaatagtattataatagatttacagtgtgtcgaaaaagataaaaaacaaaaggcgtttaacttttaaattaattttataatttaaataaatctatttattataacataaaaacaaagttaacttctatatataataggagctacaatgcgtaaaaaagtggttttgagaaaaaaactgcataaacataataagctcctcagatgagtgaactgttatctaagctgagccgaaggatgaaaaacggctcgaaaacgctgtttactctccttgagaccactccgcagatgaagaggctaaaacattaacttttgtctatctgcaatatatacacagatatttgtgttgtaaatataattaattaaagaaaaacaggtcatataaaactagtcataattaaattaaaaaataataagcagtcttgtctataaattgaaattgtatcataaatataataaaaggagtgaattttatggcaaaatacaaatgtcccatatgcggatttatttttgatgaagaggctgagggaaaaacaattgatgaaatcgaattttgtccggtctgtaaacatccggcctcagattttgaactcattgaagaatcatcagatgagccaactgaagcaaacgaacctgacaaaattgaatcgtttaaaactgaacaggaaaacaaaattgacctttcataccccagagaatatgagcgacacgataaaacaataagatatatggacgagattcaccaaatggcggtgaccggaaaatccattatatcagctatgggtacaagccgtccaatgccgaattgggatgatatacttatactcggggcacagttcaatcctccgccgcttgacgaacacgcccatgtctataccacaacagtaataggtaaaaacgctaagcgcccaatggtcatagaaaacccggtatacatatcgcatatgtcttttggagcaatgtcaaaagagactaaagttgcgctggcaaaagggagcgcgctggcaaaaacggcaatgtgcagcggcgagggcggaattctgcctgaggaaatgcaatccgcctataaatacatatttgaatacgttcctaacctttacagcgttacggatgaaaacctaaaaaatgcagacgcaatagaaataaaaatcggacagggaacaaaacccggaatgggcggacatcttccgggagaaaaagtaacacctgaaattgccgaaatcagaaacaaaccgctgggtcaggatgttataagcccgtccaaatttccaaatatcaatactagagaagatttaaaaaatttggtttcagaacttcgggaacgcagtgacggtcgtccgatagggataaaaatagcggcaggtaaaatagaaaaagatttggaatactgcgtttttgccgaacccgactttataacgattgatggcaggggcggcgcaaccggagccagtcccgcaatagtcagggattcgaccagtgttccgaccgtatttgctttatatagggcaagaaaatatcttgattctgtcaaatcagatatttcattggtaataacaggcggactgagagtatcgtccgattttgcgaaagcgatagcaatgggcgctgacgcggttgctgtagcgagcgcaggcttgattgccgccgcctgtcagcagtatcggatatgcggaagcggtatgtgtcctatgggaatggcaacccaggacgaggaattgagaagccggtttaaagaggaaccggcagtattaagggttgctaatttcctcaactgttctttagaagagttaagaacgtttgcgcgcataacaggtcatgaaaatcttcacgatatgaatgtgtcagatctctgcaccaccagcagggagatttcagaatttacaaatattccgcactgctgatatgtattattatatttaaattttattaaaattgaaaagggcactgtttttcgagttacgaaaactgtgcccttaaattattttatttatatagttactaaactgctgcagttcggtatgacggcctagcccggttgcgctcgccggacccgagcgcgtaaactatttttttgacttactgtttgtaagttgaataaccaatatatataattatattattttgtttataaaaaaactatcctatatactttgtatatgaccccatgtaaaaaatttattattacataatagggtgtttgaaccatttctttttctcgtaagaaaaagaaacgcttcaccaaagaaaaagtactgctcgcttaggtcgcctgcggctccaatgggcgctcgcccccgctaatttcatcttgaatctgcgcttcaagatgaaaaagccttgttttttcccgttgactttgtgaactaccgtgaataaagatattccgcgttcctatttatttaattcataaaaaaagtcggtttttcagtgaacttcggtagggcggtataaccgccctacgccctcataaaataaaaaccgtcatatgcttgccattctcggtagctgtatgacggtttttattttttatttctcatttcttttattaattctaaaactaaatttttttgtttttgtgttaagaatttccattcatcatgtagttccataagctctggagaacactcaatcatatcatcttctgcaaaaaattctgaaagagaaatatttaaccccttacaaatcatttcaagtgttggaattgttggaatacttccacgcttaaaaatatttgtcaatgtttcctctggtattccgctgtttttagcaagcctataccgtgataaattttgtttttttagcagttcattaagtctatcctgtacattcaaaaaaatatcacctcttttgaactaatattttataacttctaatcattctcaacatctaaaaatttatatacactaacacctaatgccttgcctattcgtaaaagagtttttaaagaaggagcatagtgaaaattcgtaccttccaattgactaatatatacctgacttaaattagaggcctctgcgagttcttcttgtgtcatatttcttgaccggcgataatatccaattttcaagcccactcgaataacaaactcggcgtattccttttcaaaagctatactatcttttgtttgattattcttattgaccattggtatcacctcttttgagctaatattttataactaaatagactttctgtatactaagtaaattaaactatatacagtttaatttatttttcatttcttttacaaattgcagcattaattctttctgctttggtgttaaaaactttccctcactatatagctcattcaattctgatatgagttcaaccatatcattgtcagcaaaaaattgagatgaagtaatgttttaaccttttcataattctaaaagcaattcaatatttttctttaaatattctaattgcttgacatttaatttctcaatatttggtctaatactttctaaaaaaacatcaacgttatcatcagacaaatcctttgcaaatgcgtctgtcggaacatttaatgctttcgctatctggattaccatgtcaaaacgtggattgtgatatccttgttcaattcttgataaatgtttttgagatataccagttgtttcagcaacctgatcttgtgttagattcctttgtattctatatttttgtattcgttgccctatttttacaaatacaatattattttcctcttttttactatcatctttgttattcatcgttttattgcctttatatataatttaataatttcctctaagtcagcctgactttcagaatcaagttccgcaattagattttggattggagtattatttgtttttttacgctcgccgaacaaaatataatcagcatctacatcaagaactgtacttagagccattaatgtgtccattgaaataccattttcgccacgctctattgaaccaaggttattttcatgaatatttatagcttctgcaagttgcaattgtgttaatttttttgctttccggagtgctataattctacgaccgatataatattttatatttttcatttggtcactccttaacactatttatacaaatttattataaaccaatttatatccaattcgaacaacgactaggattgtaacccagcctatacattgacttttttgaaaaaactgttataatatttaataagaccatttatatacaaagtacatagatagcttttttaataaacaaaataatataattatatatattgaacactatatgttcagatgatagctcccctaacacggcgcatagccgccctacgcccccataaaacaaaaaccgtcatatgcttgccattctcgacagctgtatgccggttttttaacttatctcatttactgattaaactttttaattgtggcaatattttcacgaagcattttaagctgtttgtgattcatacccctaatctcatctaaaataagcttcagattagcctcatcattactgttatcatagtcagctatcaatgtatcaatggaaatatgcaaagctgttgtaattgcatacattgtatcaagttttactctaagctgtcctgcttctatctttgaaatatgcttttgattagttccaatcaattcagctaattgtgcctgtgtcatattattttgagtacggtaatactgtattctgtttcctatttctataaagtctaattcacatttcatattatatccttatagttacctaaattacataacgaaaatacaaaaagtgtttctgattttcaaaacttgccaataacgaaaaataaaaaccataatactgtttaccatttctattaactgtatcacggtttttgggagtaactaaaatttatattttttaattgaaagaatcatatcttttactaacgatagttgatattgactcataccctctacatcaccttttatattttgcaaaaaaatatttatattatcagcagacaaatcctcaataaaaatatctgtagaaacatccaatgcttttgcaatttttattatcatatcaaaatgtggtgcatgtatgcctctttcaagtctcgatatatgtttctgagatataccagtcatttcagcaagttgttcttgagttaattttttctctagccggtatttttgtattcgctgtcctataccctttaacatattatttttttcatcttccatatttgctacctctaaattatttataatatctttgaataatattatataaaataactcactcaagaagaacggcgaagataacgaaaatcaacagtttaacgacgcatacggcgaatctacaatattttattagcccatacttgggatataactaattataatattacttttatggtgaaaataattcaaaatttatattttttgattgaaacaatagtatcttttactaaagatagttggttttgactcataccttctacatcaccttttatattttccaaaaaaatgtttatattattagcagataaatcttcaacaaaaacatctatagaaacgtctaatgcttttgcgatttttaccattatatcaaaattaggtatatgtatacctctttctactcttgatatatggttttccgatattcctgttatgtctgaaagctgacgttgagttagccccgccgcttttctacatttctgtattctactacctacattttttaaattattttcatcttcattgtctagtatttcaactttattcataataaatacctcatactttaacatttatgtatattatatataaataataatacaaatggaacgacgcaaacacctacttttaattaaaagtaggtgtttttgatgagttttctctttatttttaaccgtacatgtggtataataagatttattattacttatacagcgataaaaattatatattgacaaggtttaataaatgaaaaaaatcctatctctattcttaatatttataatagtatttagtttctccgcttgtggtacgataacgcaaactgacgtaataactaatcctgctacagataccacgtacgcaacagttatgccggaaataaatgaatcagtaatgattccggaaaattctacctttgcagttcatttcatagatgtaggacaaggtgacgcagcattagtattatgcgacggaaaatcaatgctgattgacggcggtaaaccaaaatccagtgatgtaatatatacctatctcaaaaatcaaggaattaactgtttggactatattatctgcacccaccctgacgaggaccacataggcggactttctgctccgctttccacaatcacagtcaataacgtgtatgcacccaatattgaagctgatacaaaatcatatcaaagtttcaagcaaaaaacagaggagcagggcttaatcataaaacaccctgtctgcggcgagagctttcagtttggcagaagcaccgttaattttttcggcccggtcacagaatcggaagatgataaaaataacagctctattgttatgaaaattatatacggtgaaacatcatttttatttaccggagacgcggagcgcgaggaagaacagcagattttagacaaaggctatgatttatccgcgacggtgcttaaagtaggacatcacggcagtcgtaactctactacctatccgtttctgcgtgagataatgccggaatatgcgattatttctgtcgtcaaagacaatacctacggacaccctacggaggacgtgttgagccggcttggggacgccggagcaaaagtttacaggacggatattcaaggagatataattgctgtaagcgacggtcataccgtaactataacaccaaccaaaaatgcggacgctgatacactatcagcgcaaagagatgttacaacgccaaagccaaaagcttcggcaaatgctgtcggttacatcggcaacagtaaaactaaaaaatttcatctgccgtcatgtaaaactctcccggcagaacataacagaatgtattttgatacccgtgacaatgcaatacaagcagggtataccccttgcggcaactgtcacccataattttaaatttggaggtttatatatgctttattggattagttttattattttatttgttagctcattagctgtcttattctgccttttacatatgttgaaaaataaaagaaaacatgattatatggaaaaagagacttttgtagtgtttataattattttttgcgttatactgtttttcttgatttatatgagtacagatatacccagcgcattaagcggcggtcaggatttatatgtaaatgaattgccgacacgcattgtccttggtccacatgtttcatatgtcgatacggacaataaagaactgaaacatctaaacggctgtgactggaatgcttacgaaaaatacgggaattatcatattcggtacactaaacatactaagtttgtacttgatatagaaaaactcgattaaaaataaaaaggacaataatttatgaaagtatcaatttaaatgggaaaaaagatagtataaatacttgatttattagatattccggtaactataattctaagagatagtttgctgagccagtcccagttgcgctcgccggacccgagcgcgtaaactatttttatgtaataataaaatttttgtatatgtggtcatatacatagttaattttaataagtaaattgtatattgaacactgcgtgttcagatggtagctcacctaacgaggcggctatgccgccctaccgatgttcactgaaaccctgttttttttgtgttaaattaaattgaaccccaccttttttgataagtaaatgaataaagaactcgaaatatctttattcacggcagcacacaaagtcaacgggaaagtaacaaggctttttcttttgtgcgtggagcgcaaaagaaattagcgggggcgagcgccccttggagccgcaggcgacctaagcgaacaagcactttttcttttatttgagtattcatattattgacattgtaggttattcaaaacaagtaaccttgtattacacacaccttgcaggtgtggtcacaggtgaagcgtttctttttcttgccagaaaaagaaatggttcaaacaccttattatgtaataataaatttttttatatggggtcatatacatagtatatagatagtttttttatatattgaacactgcgtgttcagatggcagttcacctaacgaggcggctatgccgccctaccgaagttcactgaaaaaaccgcttttttagtgtaataataaatgattcaaacacctcattatgtaataataatatatattatatggggtcatatacaaagtacataaatggtcttattaaataatataacaatttttaaaaaagttaacgtataggcttggtcacaatcttagtcctcgttcgaaattacagattttattcttatatacttaaaaactttaaaagtcaagcagtaatatcctttaaattattacaagtatctcacattaaaaggtgctaaatattactaacaaactttttctcttattcctcttccttattatataaaaaaactattgactttataattgttatattctataatagttaaacgcttaactattaagcggtttaaacaagcttattatactaaagtatgtggctgaaagccaaatcaagctaaagtcaggaggtgaaatttatgattgattaccgtgaagttaatgggcgtatcgacaaatttcagattttaaaaagaagcaccctttttagtctgtttgaggacaacaaactgcatatccgtcagctcccggtgcttgaatacataatcaaaaacgacggatgcagtcagaacgaactcgctgaatttttgtgcgtttctcctgccagcatcgctgtttctaccaaacgtatgcaaaaagccggatatttagaaaaaaaggaagatgaaaacaacctcaggaaaaagaacctttatgtgactgaattaggaaaagaaacagttgcaaaatgcagaaaaatatttgactcatttgatgaaaaagtgtattcgggaatttcagatgatgacctgaatactttttgtaatgttattgacagaatgacaataaatataactggtgagagtcaaaacaatattgaccctgaggaactccttcgccttaaaccaagacaccaccactgcgaaaagttcaacgactgtatagatttttatgacaaggaggacaatgataaatgataaagaccctggtaaaacagatgtccaaaaaggatagaaaattttctataataactccatttttaattattggagaagtaactatggaaaccacaattcctatgcttatggcaactttggttgatgtcggaattcaaaattccgatataggctatgttgttaaaatgggattattaatggtgcttatggcaatgctttcactcgcgttcggagcaggagccgccagaaccgcttctgtcgcttcagcaggatttgcggcgaatataagaaaagcattattttataaaattcaggacttttctttcggaaacatagataagttcagcacctcatcattggttacaagaatgactactgatgttacaaacatacaaaactctactatgatgatacttcgaatgtgcgtcagagcccctgttatgtttataatggcgcttataatgtctatctccataaacgcaagactagcgtctatctttttagtcgctattcctataatcggaataatggttgttattgtctctaaattcgctatgccgaagttcagaataatgctcaaaaagatggaccaattaaaccgagttgttcaggaaaacttatccggaatacgtgttgtaaaggcttttgtccgcggagaatatgaagacggcaagtttgaaaccacaacgcgtgaagtaagagacacccaaaaagccgctgaaaaacttattgttgtgaatatgccgataatgcagcttgttgtatactgctgtatagtagctatactgtggttcggcggaaacatgataatggtcggcgatatgcagaccggtcagcttattagttttatttcatacgtaacccaaatacttatgtcgcttatgatgatttctatggcttttattatgcttgtaaactcaaaagccagcggcgacagaattgttgaaataatagacgaaaaaattgatattactgatgaaaaggctaatgataaaattctgctagaagacgggtcaattaaatttgaagatgttgcgttcagttaccacaatgatattatgaactgcgccgttcgtcacataaacttggatataaaatccggtgagacggttggtattataggcggaaccggttcttccaaaacatcactggtacagcttatcccccgtctttatgacgtaatccaaggcagggtgatagtcggggggcacgacgtccgcgaatataaactggaccatctgcgtgaagaggttgctatggttctgcaaaaaaatgttctgttcagcggaaccattattgaaaacttacgctggggcgacgaacatgcgtctgatgaagtaataaagcaggcctgtatagatgcttgtgcagatgacttcataatgtctctccctgacggctatgaaaccaatttgggtcaaggcggcgttaatgtttcgggcggacaaaaacagagactttgtatagcgagagctctgcttaaaaaaccgaaaattattattttggatgacagcaccagtgcggtagataccgctacagacgctcagatacgtgaaactttcagaaccaagctcaaggataccactactataattatagcccagcgtatcagttctatagaagacgccgataaaatagtggtaatggataacggccgcataaacgccgttggaactcacagcgagcttcttgaaaacaatgaaatctaccgtgaagtatatgaatctcagaagaaaggagctgaataatatgccgccgatgggaaaaggaaaacaaggcgtaataagaaagcctaaaaacacaaaaaagacagccaaacgtctgtttagctattttaaagaatacaagttcatgctatttatagttgtgctggcggttatagtttccagcggagccaacgttttgggcacatatcttctgaaaccggtaatcaacgactatatagttccgtttattggaagtcagaacccagacttatcaggtttcatacaagtgatagtattcatgctggttatttatgttatcggagctctttcatcatgggtttataacaggattatggtaagcgtgtcgtgcggtgtgctgtataaggtaagaaaccaaatgtttgaacatatgcaaaggcttcctatcaaatattttgatactcactcgcacggagacgtaatgagccgctatacaaacgataccgactctctcaggatgatgatgtctcaaagcgtgccccagctgatatcgtctcttttaacagtcatatccgtctttattatgatgattattctaagtcctatgcttaccctgctggttgttggtatgctggttattatgctgatagttataaaatttatcggcaagcgttcagcccacttctttaaaagacagcagatatcgctcggagcagtaaacggatatgttgaagaaatgattgaagggcaaaaagttgtaaaggtattctgctatgaggacaaatcaaaacaaaaatttaccggcttaaacggttcacttgaacacgccgcctccaacgctaacacctttgccaacatactaatgcctataatgggaaacctctcatatattcactacgcgctcacagctatgataggcgcatatttgactataataagcggaaacagcgacgccggatttttggcgctcagtattggttcactagcagcctttctgcagtatacccgctcattctcacagcctatcacacaagtatcccagcaaatcaactccatacttaacgctatggctggagcggaaagaatttttgaacttcttgatgaaaacgttgaggttgacaacggaaaaacaacagttgtcagagccgaaattgacgacaatggaaatataaccgaagttaaccacagaaccggcagatgggcttggaaacaggttcactcaaacggtcagatttcatacacagaagttcgcggagcagtcgaatttgaaaacgtaacattcagttacgacggtaaaaagaccgttctaaacgatatttctctttatgccaaaccgggacaaaaaattgcgttcgtaggctctaccggagcaggaaagactactatcacaaatcttattaaccgattttatgacgttcctgacggaaaaatcagatttgataagattaatataaataaaattaataaagatgacctgcgccgggcgctgggaattgttcttcaggatacacatctgtttacaggcaccgtaatggacaatataagatacggtaacctcgaagcgagcgatgaagatgttataaaagccgcaaaaatagcaaatgcacactggtttattacgcatcttcctgatggatacaacaccatgctgaccgccgacggtgataatctcagccagggacagagacagcttctggcgattgccagagcagccgttgcagaccctccggtactgatactcgacgaggcaaccagctccatagataccagaacagaatctcatattgagaaaggtatggacgccctgatgaaaggcagaacggtattcgtaatagcacacaggctttcaacagtaaggaatgcagacgcgataatggtgcttgaaaacggtgagataatcgaaagaggaaatcatcaggatttgatagagaaaaagggcagatattatcagctgtatacaggagcctttgaattggaataaattaatttttaggaatacaacagacgggtggattataaatccacccgtaatgttttttataacgcctttatacaatatagtattctttcacaatacataatctaattgttttagaaattaataaaactaaaccgtaaagcttacaataaactagacagaaaaattaaggttgtttttaaagaccaacaatataatgtactagcatttctcgttagattagctgtcatataacgttttctgattgatatttcatacctgctaaaattcactgaaaaacaaccttaatttttctgtctaattttctgttgactttttaatacttccaatacattataaaacacatttatattaattctgcaaaacaattgcaatgttataacttcacaataaatctattaaaaactcaaattacttaattggctctggtatatttagttatattgctcctaaaatctctcggcgacatgccatagatatcatgaaataccctgttgaatgtacttacactttgaaatcctgagttttctgccaccgtaatgattttatcatctgtcatacgcagaagatttgctgcatattcagcgcggactattcctaaatattttctaaaattcatctttatcttctttgaaaacactctcgacacataggtctcagccacacataattcgtttgctatggattccaaggttataggctcagtaaaatgctcctcaatatacttcataattttaaagcttatatcctcaatcggtgcatgtatttcctgcgaaagatttaccgattctaaaattctgctcagaattattaccgtccaggcaatctgaagattttttgacagactgctagaaatactctcaaacgcatatttagcgtccggagataattcttcctttgctataatcggatttaatggaaaactgtcagtcatatcaggaaaaaatctgccgtaaaactttttggaacatattatcagcatctcatcaacaccggaaactgaaatattttccttataatactcatgtacaatatttgggaatataacggctgtctcaccctgcttaagcaaataagattttccgtcaatcctcaaatgctgagaaccttttctcatgtgcaatatttctatatccatatgtatatgagggctgtatgccacttcatataggttatttttcacagaaaattcactttttctaacttcatagaattgattcatgacttttcacctctatattatagagtatatcacatttgtaataaagtttcaacaactcagttcaatttttgggcagtttcagtctataaataaatagattattactgtctgtctgatataattaagctgatagttaaataaattaaggagatgaacagttatgaaaggattgtttaaacggcttatgggggtatttgttatagtttctcttgtatgcagcacttttgcagtgccgatagaagtaaacgcggtttccgatacacaacaagtcgatggaacaacaggaactccgctcggaggattcggaaccggcggagtaaaatttaacgcaaggctcggttcttttgccgcactgacaaaggcaccggctgacgcaaacgattacaccgcattaaaagacgctaaatttcagctttacacaaacagaaacggctcaataaaaacggttgatacaatgaaatcagcttcaagcaacggccgttcagaagatgacgcaatatggcctatgcacttcgcaaatatgggttcaacaaatgatgttcaagttaatttaaaggcgttttcacctttggacaatgtggactatgacaatatgagtatgccgtatgcgttctatgaaatgacgctcgagaaccttggtgatacaagcgttgacgcttcatgcgcattccagctcactacaaacgacataccagcccttgttgacggaaaaggttttaacggcaaaaaatgggctatatatggaaactctgaacaaaacggagcaatagtatcagttggaaacaattctgattttaacaccaccggcgtgcttgacaattctatcagcggaaagaccaataaggttgctgttaaagtaaatcttgacgctaaacagagcaccgtaatcagatttgttctcgcatggtatgacgattcagaacctgactggcattattatctgaatctttacaataatccgggagatatagcagcaagaggtttagagaagtttgacactttaaaaaacaatgctgaaattcttgttaccaaaatgagagactccaatctacctgattggtttagaaatcaaattcaaaacactcttgtaaacatatcaaacaactcgatgtataaaaaagatggcagagttgcatattccgaaggacaatggacctgtttcggaacaatggatcaaatgtggcaggcaaggcaggttattgctcagtttataccattctttgcttggcgtgaactggaatattgggcaagaacccaaagaaacgatggacagatacatcacgatttcaacacagcggtagaaaacaaagctgaccgcgccgagcttgttgactgggattatactgagcatcccgactatagaaacgttgataaatgggtagaccttaactgcggtcttattatttcagtttatgaaacaatgcaggttgcaggcaatccatcaacagacggcataatcttaggaaaagacccaattccggaaggaaccactatgctggattacttctggccctatctaaaaaaagccggagacagaattttaaaacaggttgaactctacggaaataaaacatatccgtatacatttgacaattctgaaaactcgtatgacgcaggcggaaatccaaacccgtataatgcaagtgtttcagcggtggcttataaaataatggcacgtttggctgatgagatgggtgaaactgaagaagctgcgaaatatactacagcatataataccgttactgattcttttgcaaaacgttatctttcaaacaacttcccggaagacaaacgtgtcagcgaatcattcttaacaggacaatggctctcacttcacttaaaattaggtcaaatctggacagatgaacaaacagactatgcactttcagaactcgacagtttctatcatccatactattggggtatgggaactttaaaaggtacctacaacgaatggacgccgtacactcttatgcactatggcggactgcttctgcaaacaagaagagaaaacatttttgaagcaatgcagcgtgattcatacaacagacagtatacagacagaaacaaggtattcaatcatccgcttgatattctgccggcagtaaacacaccgaactatgctgcaacaactatatccggtgataaacaatatatcagcatgccgggactatggagaaattataatgacgtagtcggatattacagagaccagcgcacaaaggatatttgggttcagcccagacttcttccggaaatgaacaacgtaatgacagacggaatgtttgtaatgcctgaaggatacggaacagtcagctgtgttgaaagcggcgaagcaaatcaaaatcagaatatgactgtgaaatcggataatccaattgctgtcaaaaacattcacctttctgacaacttcggcgaaaccaatccagtcgttcagataaacggtcagcctgttaacttcaccagaaccggaaccggatatgataaggaacttgttgttgaatggaacggaactctcgacagcacaggcattactatcgagacaagcggcgaagcaggatatactgttccggcacttcccgaaaaacctgaccatggtccggatgacaaaccatctggcgaagtaaaaaatccgtatgaatctatttcagctaccagtgctgaaggaaaagttaaggttgatgtggaaaccccaatgggacaggattggtttgttagaaatcaattcaactatgactcacatatcatttttgaaaatgttgatttcggagatgtgggttcaaatatgatttcagcaagagttgcaagtgtcgattcaggattcactctccaggttaagctggacgcggtcagcaacgacataataggaacaatagaggtacctaacacaggtaacgaacagacctggaaagaagcctcatgtacattgaatgaaacagttaaaggaaaacatgatgttattatagtttttgatgctgccggagcaagcggcgaggacgcaaagtttgtaaaccttaacagtataaaattcctgcaagcggacggcagacttgacagaagtgcatggaaaggctcggcttcaaacaattcttccagcacatttgcagcatgggacggagacttagaaacaaaatggcactgcagctggcaggaaatcggcaaatacatgactattaattttggtaaaactgaaaagtttaacaagatagttattgacaataacaccaagactactgatcatcctaaaggatacgcactatatgtatcaaatgacggcaaaaactttggagaccctattgttaccggaaatccggaacaggacacaaaactcgtaatcgagttccccgaacagcaggctcagtatattaagatagtaataactgaagctaactcttcaaaatattgggctgtaaacgagcttaacgtgtttatggaaaaagagcctgaaccggaagagacagacccagcacaagtaggagtattttcaggaacctcctctaaccacccaaccggaacaaaatatttcaatataacaaaaaatgatttaggttcaaagcctgcaagagttaattctaacactgaaagagccaaatttgttgacggaatcgacgctaaagtaaaagcaatatttgcagataaaactgatgaaacgttgctgagagaaaaattcactcaaactttcgtcaactatattggtaaaagcggagattatgatgtcaaaccaactattgcagacatttcactcccggccggcaagtattcaatctattacttcggaggtgaagatttgcctgtaatcgttgacctgcctgacgcggctccgggtatggttacagttgacgcctcaaagccttcatacgcttttgcaactattggaaccaagacccataacatgaaagaaatttctctaacagtcaatcaggactacaccggagatattacattctataacgagaacggatggctcccggacctttattctttggtaattatgaatgacaacgctcctcagcctcagcctgtaacagaaataacaggatattcaaaagataccggagttgtttctatcagcagaggagaagatttcccggagaatgctgtcgtagttgcggcgggatatacaaatgatgtattaactgatgtaaaatacgcagctgtaggatcaagcaacgaaattgaagttggaacagttgccggagacacagttaaagtttatctttgggattctcttgaaaatatgaacccgctttgtgaagcatattaaaaacaaatttatggagcagcatttttgctgctccataattattatataaactaaaataaaaataatattttataattacaaacccattttcttaaataccttccgctattacagcgcggctgtccacattatttttgcgcttggatactatcatgttatactcatcggaagcaaaacaagcttccaaattactcttatcttcaaaacgcactactataacgcgctgtggatttctctcaccggaaagagtttgaagattttcagtccgaactaaatattttccgccatagctttcaacaatcggttttacagcattaatatattcatcatactccccacgtcctttttcttcgttaatatatgtatctacaataaaataccatgccataacataacctccaaataataatttttgttagaatagcaataagtctgtgaatttcaattcatctataaatatcaaacacgggtttaacctaaaaataaatactaaattttaactcgaaatactttctgcataaatcaaaaacttttttctttcacttataattatcattcccctaaaaaacggaaagattatacccaaactaaaagtataaataaaacaagcataccaaaattggtatgcttttaaatctatttcatatgctgtcttgaaacctttaaccttgacagcgcgcggttaagcgccgcctgagtttgataatattcccgaatactctgtttctgtctcattctctcttcagcgcgttcttttgcttccttggcacgttttatgtcaatttcttcgggtctttctacggtatccgcgagcaaggttacatacgtcggcatgatttctactatccctttgcttacagcggcataataccactttccgtcaaccttatatttaagctcgccttcgctggtgcaggttacggttgcctcatgatgtggcaggactccttggaggccgtcaagagcaggaaatatcagcatctcgcatggaccgctgtaaaacgaacggtcgctggcaagaatatcaagtttaaaagttttttcatcagacatgtgaatcctcctcacaagttaaaaaaagttataatcttaattaacctttaaaattctttacatcatcaattgtccctgccatcataaaggcgttttcaggatagtcgtccatctcgccgtttataatcgccttaaagcctttgattgtctcgctcaaaggcacatatttgcctttaaatcctgagaacacttccgctaccgaaaacggctgtgacaagaacttttgtatcttccttgccctaaataccgtgactttatcattttcatccagttcttccatacccagtatagctataatatcctgaagttctttatatttttgaagaatctcctgggtctttctcgcaaccatataatgctcttcgccaactatagaaggttccaaaattctggatgtggactcaagagggtcgacagccggataaataccctgctcaacaatttttcttgaaagcactgttgttgcgtccaaatgcgcaaatgtattagccggagccggatctgtcaagtcatcggcaggaacataaacagcctggactgaagttattgaaccgtcctttgttgatgttatcctttcctgaagttcgcccagttcattggcaagcgtaggctgataaccaacggcgctcggcatacgtcccagcaatgctgaaacctccgaacctgcctgaacaaatctgaaaatattatcaataaacaacaaaacattctgctttttaacatccctgaaatattcggctatagtaagaccggtttgggcaactctcatacgcgaaccgggcggttcgttcatctgtccgaacaccaaagcggttttatcaattacccctgattccttcatctcatgccataggtcgtttccttcgcgggaacgctctccaaccccggtaaatattgagtatccgccctgctctgtcgctatattatgtatcaattcctgaataagaactgtttttccaactcctgctcctccgaacagtccaatctttccgccttttgcatatggagcaagcaagtcaataactttaattccagtctccaatatctcaacaaccgggctttggttttcaaaactcggagccgcgcggtgaatactccactgctcttccccctgaaccggctctccgccgtctatggtctcacctaaaacgttaaacatacgtcccagcgtctgttctccaacaggaactgtaataggtttgccctcagacacaacctccataccttttttaaggccttcactggcggcaagcataatgcatctaaccacattattgcccctgtcctgagccacttccataacacaggttttatcattattttggactgtcagtgcgtccctgatattgggaagctgatcggtgctctcaaaagccacgtcaactaccggtccggctaccgaaacaatttttcctatattcataactgctcttacctcctatttcccatctcatactgtcatagagttataccgcgctcattttttatgctgacttttcgcaccgctgacaatctctgttatctcctgagttattgcggcctgtctcgccctgttatacgcaaggttaagttcctgaatcatatccttagcgctctttgtcgcggagtccattgccatcattctggcatgctgctcgctcgcaaacgcttccaccattgttccatatattaatcccttggcataattcgggacaaggttttccataactatttcaggagacgggtcaaatgtggcagtatggtgaatctcacgatgtttgccgctgtgcagattttcaaatctctcacgcctgaacggcagtatttgaagcagttttgcttcctctttcatagacgatatcatatctgtatacactacataaacatcgtccagctcctctgacagaaacttactcagtatcaactcagaaatttctctcgccctgtacatactgggattctgagcggtgtattgaaaatacgcttcatacggtatgccctttctggcaaaatacattctgccgacctgacctattataaagagcttaatttctccgcccttagcaatctcctgctcggtcagtttaagcacgttatgattataggctcctgccaaccccttatctcctgttatcacgatataaccttttttacgtttttcatttggtatctcatcgcggcggtgaaaatataaattgcttgtatgcggggtatgcttcaaaatatgagcaatagtattctgcaaagtataaaaatatggttcggtatcgtcaagtctttgcttagcgtgcttcatctttgatgaagatataagatacattgcgttggttatcttcattatatcattaacgctttttattctcgaacgtatttcacgcatattagccattatctcacccgctctcagtcttccttactattgttttcgtttaacacaacttccgcttcttctcccgggtcatcagccaatgctgatacatatcttccggtcttgaattccttgcacagctctatgattttttcttcgtcttcatcactcagcgccttagtttcgattattgtttttattattccaggagctttccgctcaacaaaatctataaagtctgacttaaagtttactatttcatttatcggtatatcaagcagcattctatttttgctcactgtgagcaaaagcacctgtgcataaagcggcaaaggattcagcaaaggctgttttaaaagctccattattctgtctccggtgtcaagcagctctttggtcgccgggtccaaatccgaactaaactgactgaacacttccatttcacgatactgcgccaaatcaatacgcagatttccggcaacttttttcattgctttggtttgcgctgctccgcctacacgagacactgaaagccccacgtttacagccggtcttatacctgcaaaaaacagctcgttttccagaaaaatctgaccgtctgttatagaaataacattcgtaggtatatacgccgaaacatctcctgcctgggtttctataataggcaatgcagtgatagaaccgccgccgtgagcctcgtcaagacggctggaacgctcaagcagacgagaatgcagatagaacacatcgcccggatacgcttctctgcccggcggtctctccagcagcaaagacatcgccctgtatgcaaccgcatgcttagacaaatcatcatatacaatcaatacgtcttttccgttgtgcataaaatattcggccatagcggttcccgaatatggggctatatattgaagcggcgccatatcgctggcggacgctgaaacaactatagtataatccatggctcccatattcttgaagtcgctgacaagttttgcaaccgtagaagctttctgtccaacagccacatagatacatataacgtctttgcctttttgattaattattgtatcagtcgctattgaggtttttccagtctgtctgtccccgattataagctcacgctgtcccctgccgataggaaacatgctgtctatcgcaagtattccggtttccagcggaaccgttacaggctgtctttcaataactccaggcgccgggctttcaattggatagaaatcgtcttgctttatctcaccctgtccgtctatcgggtttcctatagcgtcaacaaccctgccgattaaattatttcccacaggaactccggcgcgtcttcctgaacatctaacctttgagccctcatgaagtccatggtcgcttcccaaaagcacacagctgacagtctgttcctccagcccctgaaccatgccttttactccggtctcaaatataaccaactcgccgtacatagcgttgcttaagccatacactgtcacaatgccgtcgcccatgctgataatactgccctcgtcaacagccgtcatttttacgtcaaaatcagatatttcttctttcagcactgaaataacatcacttgtgttaatactgctcaaatctatcacctccgcaaaagtgttctgcgcattctgtctaaagctcccaaaacacttttatcatataccttatcatttacataaagtctgaaaccgcctattaaatctctattttcaaccaagcttaactcaacagactttacgccatattttttaacaagcattgccttaatactggataccgatttttcactaaccggctctgcatattcaagagaagcttcaagcactgaattgtgcctgttccaaacctgcttataactctcctctatcaaagataaaacgctgtaatcaccgtttttacatactgttttcataaactttccaaagccgccgtcaaaaattctgtctataaccgcatatttctcttttaagcttattgttggattagccaatgcttgtctgagctcatccacagcaagcagtgcggtgaactccataacattttttatgtcactactgatttgataaagcgcctcagcataatttaaagcctctttggttattatctttgctctgctcattttgcttcacctacctcaagtataaagctgtcaacagcgctctcagaaacatcaccgttcttcgccgccttcagcgccgcgtccataacgagcgaggctatctcagacttagcttcagatattgagcgttctttttccagctcaatctgtttgttagcgtttaaaacaatatttccggcgtcttccttggctttgcttattatctcatcacgttttgctttggcttcctctttggcggactttattatatctccggcagccgcctcagcagttttaagcttatcggtgtaagccgcttttaaagcggcggcttcctgtttcgccgcagaagcgttgtcaagagacgattttatctcgccctcgcgcttctccatcattgcggttatcggaccaaaaagaaactttctaagtaaaatatacaatatgataagatttacaaaggtccagattatattccaatttaagttaagcattcaaaccgacctccgtcatccaaataataaaaatacctctcctatttcaagaacaggattatcatgattgcgataacgaatccaaaaatagcggttgcttccgcaagagcacatcccaaaagcagagccgtattgatgtcgcctttggcttcaggctgtcttgcaatagcttctgtcgcctttgaagttgctattcctataccaatacctgctcctatacctgtgagtgccgctatacctgcaccgattgctattaatgctcccataaatatacatctcctttaaaatttctgataaatttatatgtagtttaatcaattttctaatttaagactattccgtttcggttacttcctgaatataaagcgatgtcaggaaaacaaaaacatatgcctgcaataatccgtcaaatatatcaaaataaaaactgaatgcaagcggaacaaaaacaggaacaaccatttttataagctccataataacaaatgagcccaaaacgtttccaaaaagccgcatacaaagtgaaagcggttttattacgatttccaaaacattaagcggcgtcataaaagccatcggctgggcaaaaccctttatccagcctccggcgcctttcgcctttatcccggcagcctccaccaaaacaatactcattatggcaagccccgcggtaacatttaaatcctttgtcggcggcgtaagcccaaaaagaccaactatattagaacatccgatatataacaagacagttcccaaataagggatatacctctttcctccctcgcctaaaatcccggtaaagaagttatttatccagccgataaacgtttccaaatatacctgcactccgcttggcgcaagtttcaggtttcggacaaatatgatagaaaacaagacaagaacagccattatcccccaggttataaccacggattccggcaccggaatccctccgaaaatcggaattgtaaaagcaatggttgtttcattcagctttgtataaagttccgctgcaatatcattcacagtctgtcaccgccttgttaaaaatttctcaaactcaaagggtaaaataaaaaagaaatacaccagatgcctctttgcatgctgatattaatttcttttttatcttaaattacttttcaaattatctctcatatattaacaattcaaaagtcatcactaaaaaagtcaaattttataaagcaacagcttgtttgaaaacaaacaaaactgttcgaattcaaactctttacttgaagatagtatattcccatttttttgaattgtcaatcttaaaattaacaaatatgtatatagaatacaaaagaaaattgtcacaaattcctttaaggaattattttatatcgcattgatatgattttattattttatcaaaacagccagttccggaacgttctttttgatttcctcagtaacccaaaaggctattttgtccgctccgaagatattcaggtgagtatcatcatcatcgccgttttcgtagaactgtgaatttaagaactcagggttatacataaacctctcatcatgaggctttatgattttatataagctctttgcttcctcaagaccgacctcgtttatccagtcatttgtcctcttatagacatccagcaccggaatattcaactcttttcccagttctttagcggcattgacgtattcttcaaggctctcgtctgaaagcttccgtctgctcactgaggttgccaatatcggaattgctccggcatctctcgcaatatttatatatacgctcatataatttttatatgagcctttttcatcaattttaccaaacgccggagcatatcttgacggatcctgtattttagaatcattatgaccaaactgtaatatcagaaaatcgccctcgctgatattatccttaaagaccttaaaattatcttcttctgtgtaactctttgcgctcctgccgctcatggctatatccgcaaccacggctttatcgcttataaaatacttatcaaaatactgagcccagccagtttggggaaacctgttgttttctccgctgtgtggatatatgcttgcagtggagtcgccaataacaaaaatgacccgtcttccccttctgtcgattatattagagtttttctcctgcctttttccgctgcctttcagaacgttaagcacaaaactcttgtcaatgtttatttcaggataatcctgatacgaaaaatgagccgttatagtcacattcttctcctcgggcaggcaaattacctcgcccgatgtggatacagaatccgggtctgaacttgaccacgaaacatcggcataaccaaatttagtatttctgccatcccacaggttaaggtcgctgcaaaccctctcctcacactcattctcaagcttgacctcggcaaaatcaatgttttcaatctctgtcaataacgctttgtattcctcattactatactttttcacatctttcacctctaaaaattttttcagtgttacactctatgattaacattatatatcaaatattttatttactcaagtcataacttaaatctattaaattatacagctcatctattgaaacagaaccgtccagcaaaaccgtaatccaatgttctttattcatatgataagccggaaaataacctttttctttaattaaagagcctattaaaacagggtcgcattttacgtttataatattcacaatttcagagttattcagccctaaactggttttcgccactgtcattaacaaagcgaaccactttgcattgtccttatgccttaaaacagcgctttcaggtgatttaacccacggatagtcaggctccgcgtcatatttttgtttagcatacttaaaaatatcctgcttgtatctttcagcagtatcttcgcttcctcttatcattttactccccttcttctgataaagactgataacttccgtaaaattcaggtatataacacaaatcggacgagccttcttcctgaacatagacattttccattcccagggacgcgcagtaatctaccaaagtttcataatatcctttcggcaagttcctgttaagctcatccatacctctcactccgggcataatggtatactggctcatcaggcttagccaaattttgtcttcatatttttcaaacaaatagtcaactatttttttagcctcaaaaatcagaccgggcaataacatatgacgtactatgacacctttttttataagaccgctgttgtcaaattcccacttgcccacctgcctgtacatctccgaaacagcttcggaagccgttttaaaataatcttttgcgccggaataacgtttggcgtatttgtctgagtaatatttcatatcaggcagatagacgtctacatacccatcaagaagtttcagtgtttcagctttctcataaccgccgcagttatatacaacaggcagattcagaccgcgttttttcgcattgtccagagcggaaaccagttggggaatataatgggtcggagtgaccaaattgatattgttggctcccttatcctgaagctccaaaaaacaatcggcaagttcttcatccgtcttttcaagcccttttccttttgagcttacatcataattctgacaatacacacatcttaacgtgcagtttgaaaagaataccgcaccggaaccgttttcacccgatatacacggctcctcccaaaaatgcaaatcagccctggcgattctggctttgtctcccgcgccgcaaaaacctgtttcgccgctgagcctatccacaccgcactctctcggacacagcctgcattcgctcaaaattttatataaatccatttgtacacatctccaaaataccgccgctaaagcacgctgagcgcatatctgaacccctgactttctacagaggccggataatttatgattaccaaatcatcaaactctgtatagcggtaaaactcgtctattttaaactctcctccgccgaaaccatataagccgttaacatgccgcgggtcgattatataaacaacgctgtagttattaagcgcccaggcagaaaacgcgttgccgtacgagtccttaataatacaaatttttctgccgttatcaacattcgttttaaatacggtgaccggattgtctccgccaataaatgcagaataagagtttatattctggtctaccggcacaacgttcatcaaataatcacgcatatgtccgtcacgatacaccgtcccctcggcgtttactttaggcataaaacgctccagcgtttcaaagttgcctgaaattttcgccagctttcccttttcatcatctaactctgtcaaatacttctgccaatatccaataaaataatcaaacttcatattctgaaaactattaatatcgtcagccatttcatttttgcattccaaaaacgacttataggcgtagtacgcccctctttgcgtccaatggttatccgtcataaaatacagcttttctccgccatgctcaaataaagctgtaacagcgtctataggtgtgacccagcttttcaagctgtcataaaccatagacagcccctcaatttggctcctataaatttctttcggcgcataaaactcgctcatagacggcacaagcaacgaatacgtgtcagcaagcggaaccttttcagctatgtgatttattatttccgcatattcttttgcatttttctcggaaatacttatatcctcaaaaccaacgttgcctacaacatgcagtcccggaaaactttccacatcattatacgccatgcggtatcgtccgtcaatccaaacaccgccggacttcagcggattaacagccggtctgttattaaactgcgttctctcttccaacgcagtctccccaaaattcaataagatttttgccgcgcttgaagtttgactgccgtcggtaacacgaacaattttataagcgtcaaagtattccaccttgaaaccgaaactctcggcaaagaatcttagcggcagcattaatttttcatcgtttatatagcagtttacagcgtctttgaccgctgttccgttcacgtaaacaggtgttgctgctcccggaaggattgttattattatatcccccttactgagggttgcgccgaacactgtttcgtcccaaaagatttccgcccccacgctctccgccaactcacggacaggaatataagtaacgccgccgagtatttctgcaggagcggcaagcctgtcatcgtttacgactatcataacatagtcggtttttaccgcataagcggagaaggacatacaaagcgaaataaacactattattaatacgccaaaacagaatttatttttcatataatcaccgatataacaattttacaaattatgattaaattcacacaataactttatcacaccggtcataaaaagtcaacgcactatcatattaactaaacggattttagcgatgggatttattctttttgcgcggttattaagatattgagtccgtcgttttccataataaaatcgcagctgtttgacttctatataactttctgaaaatttatcagtttatctaaatataagtacaaaaaacttgttaaaattaatttaaacaattccggttaagcaatttttaaatcttgacaatttacatcgataagagagtatattaattaataatagaaatatttctgaatatctacacaactaagaaatttaatatttatctataaaatatttttaacagacatgtttactaatgactttatagtaaatggggtagtttcgcttagttttgcgagaccttttacattactgactgctatattaaaattatgtgatggatttttcatattagaggaagtataaatttttaaatcatttgttctaattaattctgctatacaaaaatttaaaatatcagaaacagaagcatcgtaagttaaagaagcttcttctaaaaagttatataaatcatcctcaatttcataagttttacgtattcttttttctcttttagagaatttgttatttaaaaatttattattcatcattcgttatagcccttttatgacctaatattacaataatttataagatgtcttttttcatccttaccgtattatataatatgttgtgatataagtcagaacaaactagataatttatatctaaagcagataaagtaataaaaattttttataaatattcaatttaatttaactattccaggcaaaactcacttaatattgagttcttactcctaccaaaggtgttaaacgtttcaatagaatggttataaagtaattgattgtttattactctcttatttttacaataacatatttattactataacattcactaatttggtgggtttagcaagcctcggcagggaggacaaagtcctcctcgtgaggtgcgcagccgcggtgatacttcataattataaataccattttatataaatccatttaattattctataattgcttactttgatgcgccagaccctgtttcgcccgccgagcccgggcgagatcgtcatccccttcagagacgattaagtcaaaccaataatacctatataataaaaattatattaaaagaacttgttatttagcaagcatcggaagggaggactttgtcctcctcgttaggtgcgcagccgcggtgatacttcataattataaatatcattttatataaatccatttaattattttataattgcttactttgatgcgccagaccctgtttcgcccgccgagcccgggcgagatcgtcttccccttcagagacgattaagtcaaacctatataataacatttataacaaaaaatgacgctatagcagttttagctgctataagcgtcattttaaaatatattaaaatattatcccgattatctgtatgagtatccgccttttatcattactataacatcattactggctgtgaaacctctgccgtcattcaccggaacaatcagcatatgattcgacggcaactctgttccgtccggcaagtcataaccataagtcgtgtcggctattccgcccttctctgtcccgattaccacaccgtttccttttctcagaataaattctgccccagcgtcaaatataaccgtttgtcctgcatccacatttacaacagaaaacttctcagaatatgaatctgaagtcccgcctgacatcttctgctcaacgtatgctttaagctgcggcaccaccacatcaactatatagctctttgtaaccacagggtcgtctgtgtcccccggttcagccaataccagcgttgcgcccaaaactgagagaatcgccgcaaccgcaataatcatctttaaccacttatttttcatttccacgcctccttttcatatgtgtatataaccgccgttcattttttattaatcctccaaaccaaagctgatgcttatggcatggttaacacggttcatcagtccatcgtctagatgaccaattttctctttaagacgttttttatctatagtcctaatctgctcagccaaaacaaccgagtcctttgacagcccgtagccgcctgcgtccagttctatatgcgtgggcattttagctttattaagctgcgacgttatagccgttgcaataacggttggactatacttgtttccgacatcgttttgaataatcaaaacaggccgtactcctccctgctctgaacctacaacagggcttaaatcagcataatatatatctcctctttttactaccaaatcaattcacactccgcaagttaaattcccgtttatgtctttggtaatattttatgctgagagacctgtttttgttctgtgctgcaaccggacaacttgcggtaatgaacggttgttttatgtacaggtcaatctttgaaaggactgtccaaaaggtaattatgaacgtctgcgaccttgccgcccctcatatataccctcggaattctcttaccaatgacacaaaggatttcataatttattgtccccataatgctcgctatattctcaatgggtatttctgcgccctctgagctttttccgaacaatatgacctcatcaccgatatttatattattaacatctgtgacgtcaatcatacattggtccatacaaatatttccgacctgcctgcattttttgccttttactatcatttctgtcttatctgaaaggattcttgagtacccgtctgcatatccaataggcacagtagcgatttttgtttcattattttttgttttaaattttctgccgtagcttacagacgttcccttttcaaccgtcttaatattggttatctgagccttcagcgacatagccggttttaagtttaaaatatcttttgatacaaaatcactcggcataagcccataaagtattatacccggtctgaccatatccatgtgaaattccggaaacctcatcagcgccgcgctgttacagcaatgacacagcggaacttttacccccgcttcccttatcctgctgcacaaagtgttaaaccggttatactgcagcattgtatactcgtcgtcatcgtcatctgcaatggcaaaatgggtaaacaaaccgtctatttccaaatacggcagttttgaaatctctataatttcatcaaccgtctgcttatttattttttcatcctctgtgtatctgaatccaacacgccccataccggtgtcaattttaatatgtattttgccggccttattcagcttggctccggcgtttgacatcgcgactgccagctctttggtataacaattcggcattatatcgttttctattaactcctcggcatatttagacggagtatttcccaaaatcaaaatcggagtatcaataccgcacagccgaagctgaatagcttcatccaaaaaagccactcccagcgaatcagcgccgttttcaagaagcgtttttgcaacctcaagatagccgtgtccgtatccgtctgctttgacaactcccataattttaggcttatcaccaacatgtctgcgtatctcttttatattattttcaattgcgtcaaggtctatctcagcccacgcgcgcttttcagtaaccataattttctccttcaaaaaacatctttcaaattaaactgccgtgttcaccagcctaaaagcctccggtaacatttcaaccaaatcagttgctataagcccgtgctcgcccttgtcacgtcttgccaaatccccggccgctccatgcagaaacacgccgagaacagccgcgttgtaaccgttaagcccttgacccattaacgagccgataactcccgacagcacatctccggtacccccggtcgccattccggcgttacctgagttgttaatatgtacgccgccgtcactgttggcaataacagtgtcctttcctttcagaactaccgttacgccgaactcctcagcaaaatcacgagcgattccaactctgtcattctgaaccgcctcaatgctcaaaccgcacagccgcgccatttctccaggatgcggcgttatcacgacctggcacgattttctgtttttatgctttcgcaaaatatccatatctcgtgaaatacagttcaaaccgtccgcgtcaatgacaaagtctgtgcttccgctcagaagcgaatctataagtttaggaatatcatcattatccgaaagcccgggaccaaaaacacaaacgtcacttttattcagtcttcgcttgatttcgcccagagcgtcgagacttattgtgccgctctcctccacctccggcaaaggaaccgtcattgcctcagtgagcttaaccgccataatctgctgctgtgattcgggaactcccaaagtaaccaaaccgcttccgcttctaagcgctcccatgcaggacaaatatgcggctcctgtcataccgcggcttcctgcaataataaacaacttgccgcagtcgcccttgttagagtcttcattacgaaccggaataaggcttttataatattccagtccggtataaaacggaatccccattcccgggatatcctcagatatatataccaccgccaccgcggtcttatttgaatgcgagatgcttaatgcagcgttaaccttcattcctccgaatttaataaacggctttccaagctcatcgtggcagacctctatatctgacagcgaaaatcccctgacgccgcttcccaaagcctttgaaaaagcctccttagccgcaaagtggccggctatagattcataaaaacctttagccgcagacccttttgagacaaaataatccgcctcgttttgggtaaacacccgccttataaacatttcaagatttttcatttcacgaaaccgtgagatttctataatatctattccaatcatattattccgcacctttgacaagcataatttttagtccagcacaaccttctgcggattaaactttttaaaaccatcacggattttctcgttagggttaaataacagcatctttccgcttccgttttcattatacactgcaaaatacaattcactgctgtttttatcaacacaggcatataccttttgataagactggttattcatatatctctcaaaatcaggatgagaacgcttcgccattatctcaacctctctggcgttgaactcggtcaaacgttttctctttctgacattaactatagcgtccacatcaaacgagccgttggtaaaacaatactcatactctaaatttactgatgttatcagcatgtataagagataaatcagaccgcacgcaactataaaaattataaatcccataagcggtatagaaaacatcagcgcccctaaaacatatataactaaaagagccccgatgatacctgccaaaatgattaaataatccttgctgtcacgttttttctttaccaattgttccacaaaaatatccattaaattgcctcctgtttgtgtttcatattttatcagacgaatgttctgatgtcaagccgcctattcggcaataggtatgttctcagcgcctataccgctcacgccgctcagtttcagtttaccatccgcatcgtcaccgacagcatatattgttccgtcatagttaagtcccagggtatggctgtttccgcaagctactgacataacatttgcccaaagcgaaacagaaccctgattcttatcgttaacacccttagaactcgtctttccgtcagcgtttacatagacaatatactgagaaccgactgccgccgacactatatttttaactcctgaggtatcacactggcggtagctgttatcaccgacagccacaacagagccgtcatattttaccaatacagtatttttttctccggtcgctataaatgcaacatcgctttggcctgcaacgtcacactgtccatggctgttccagccgacagcaagcacagtgccgtcgtttttcagacctatcgtgtgattgcctgacactgcaatctgaactatatcagtccattcctgaacatcacactgaccatacttattgttacctctggcaataactctgccgttagctttaagcgccacagtgtgtccctcacctgtggcaactgacacaatatcagtccagcccgacacatcgcactgaccatactcgttgttaccgactgcaataagatttccatcgtatgtaagtccaacagtatggtttccgctgaccgaaactcctataataccggaccaatccttagtttcgcactgaccgtagctattatccccgaacgacaaaacctcgccgtttttctgaacaactgcgctgtggttgtatccggccccaatcaatctgccatacatattcaatatttttctgacgttaacaacactttgcttatattttccgcttttatgaaaatattttaaggctttctgatattcatgtatattcatataagccattgccgttgaataatcaatctcatgtttctctgtgccgaaatagacaaaatcctgttccagcttttcaagagtgggcgcggcgttctgaaaatcacggtttatataataattcattgccgttttatagcaaagctgacgcgccgaaaaatatttctgaactcccattccaacgaacgccaatatacagcatccaacaatgaccgaagaccaaattataagttttttgttggcagacattcgctttttcagttccgttttttctttggtatccttgatagctttggtcagtctcagcctcagccagtcctcgcccaaagcatcctcggttactatatcattatcaagtttttgctctgaatttatccaaatgcttccgtcgtcaaacaatatttttgaaacctcaacaaaaacagaacaggttatatccggaacctcaaccgtttgagaattaccaaacacagcgttgggttttgcgtcaacatttatatacggaatatttctaagctgtacacaaagattaagctccgaatcaaaacaacctgcattaaaatataccgacttcaccgtttttccgcagttattatatagtttaagcttcatgacggtctttttgctgtcgcgcagtatctcgcttgtatcaatatataccggagctttgccgcggttttcatattctgtacgttttaccactttatatgttttttccgccatataatcacctttatcaacaatctatttatattgaaacaaaataacataattatacttagacattatactacaaacttcagcaaaatgtattacaacactgttaactctgttatacaaatcaaaaacaggcgtgcaaaatatatcctcagtttccattatattattagactggaaatattgagtaaataaaaataatatgatataatgatacaaaaataactgtaaaggatgagagaccatgaatataacagaagcgataaaaaacagaagaacaatcagaaagtttgaacaaaagccggtcagtaaagacgacttaataaaacttatcgatttaaccagatacgcggcatatggagcgaacctccagccgcttaaattcgcggtaatggataatccggatgaaatatatccgctgacacgctgggcggcatatatgacggaatgggaaccggcgccgaacgagaggccgcttcactatatagccatactcggggacacaagcattaagaaaaattttgaaaccgacgccggaacggcaataaccacaatgatgctggcggctgaagaaatggggctggcaacctgcttgctcggggccatagacagggacaaaattaaagaaatgctcaaaactgactatcaggtattatatttgcttgccataggctatcccgctcaaaaaagcaaagttattgatattgaagacggcaacataaaatattttgaggacgaaaacggagttataaatgtgccgaaacgttctcttgacgaaattattgttaatatatagttaaggttttgagattaaaacagctttcaattcggaaagccgttttacgttagtttaattaaaatattaggaaatgttacaataaatcaaacagaattattaatatcatatataataaaatatagtgcagcaagcatcggcagagctgtgaccacactttttttaagtgtgtgtgatacaaaatgacttgtattgataaaacttaataatcagacttagttgtgatgtgcgtacgaagtacgatgcgtgaggcgcgcagttgcagaaaagtatattataaaaatgtttattacaaaccattctaagtattcatgcttcgcgtgtggaaattcacctaacgcggcgtgcctgcaagcaatatatcacaactaagtaatttattatatgacaactaagttaattattagtgtttatagtttatagtttgtatgacacaatatagtttatataacatgcacttttaaataaaagtgtagctgcagacattgaaggtttagaataaagagatactgtggctcacacctattggcgttcacaaaaaacaccttgaatttttccgtctgtttatgttaacattccattttcttcatgaatataataatagttgctgacgtaaaaacatttctataataaacacaactatgataacaagattatggatagtcaacactaatttagacaacttatttaaggttagtaagtcggtattctttcggggtcaatatagcccagtgatgagtgaatcctgtgattgttaaaccagtttacataatccgataattcatattgcaattgttctaatgtttcatattttgacttttatgattttaaatgtggcttccgctgccgcattgtcatagggacagcctttcttgctcagtaagcagtcgatgtggaatgtctcaagcgttttatcagttgtcaaaccattttcttctattttttgttttactttataataataagtgcttcttggaatgtttaggactttacacattgctgatacagagtatttgtgggcatttgcctttatcacatttactttcgtcctaaaatcagcgctgcttgttttaaaatgtcgttctccatctttattgccgattacgtttggcagttctattattttctgctattctgcagaacggttatctttttcgtgaaaagagccgctagctttggtcatcgtagtttctctttctatactttctattttacataaccttaacttttttgtccagttttttgtagcctttccaaatgtatgtgccctcgcctgtagggtgagtgtgagccataaaggcttgttttgattggccttcaatacaataatataaatacataaaatgccaccgaaattagtatattaaattaaaataatctagtacgtgaacgttcatttttaaattttatttataatgctttttattatatagtcaaagaaaatttatttaccgttatttccgaatagaaaatttactttgcataaatctattgtataaatccttttaacgttttatacaatacatcggcgtctaccggctttgctatatgggcgtccatgccggattccagcgccgccgctacatcttcatcaaaagcatttgccgtcatcgctattatcggtatagtttcagcctgcggatgactgcttgatctaatagccctcgccgattcatatccgtccattattggcatctgaatatccattaaaatcgcgtcataatatcctttctcggatttcagaaaacattctaaggtttgatttccgtcaacagcagattctacctcagccccagtcatctttaaaatctcaaccgctatttctaagttcagaggattatcctcagccaaaagtaacctgtgtcctgaaaaatcgtaggcatttgttttcgcttccactttaggaatctcatttttgcttcccgtaacctcaagcaacgtattatataatgatgatgcaaaaaacggctttgacaaaaagctattgacgcctgcttcacgcgctttggcttcaattcctgcataatcatatgctgtaataataattatcagagtatcatgacctacaacagactttattttttcagcagtttcaaccccatccattcctggcattttcaagtcaatcaggcaaacattataatcctcgtttatatcatgtgattttttaatctcgcttaccgcttcagctccgctttgaacccattttgcagaaataccgaatttttctaaaagcattgaagcgtataagcaagctgctttatcattgtcgcacacaagaactttcatggcgttcatagacggatacttaacggacgcactatgcttatttgccagttcaaaaggaagttcaacagtgaacacagagccctcgtctaaacggctttttacagagattgttcctcctagtaatgtaacaagattttttgttatagccattccaagccctgtgcttcctaacctcggaacgctatccaggttctcctgctcaaacggaagatatatcttctttaaaaattcctcactcattcctcttcccgtatcgctgacagtaaatcttaactttattaacccctttttataaggcagctgaccaacgtcaaggcggattttcccatctcttggagtaaacttcagcgcatttgacaacaaattcagcaaaatctgattcacacgcatagagtctccaaaaagctcttcgtccaaaacccctctgagagattccgtaaattccaatcctctgtcagacgcctgcggatgaattatcgcagttaccgactccaaaagctgtctcagactaaatttttcatggctgacagtaagatttccgccttctatctttgacatatccaaaatatcattaataagagacagaagatgcttagacgaataacttatttttgccaaacaatcctgtattcggtcatcgtttccaatgtttgccgccgcaatagttgtcatgccaataattgcattcatcggagtacgtatttcatgcgacattcttgaaagaaaatcagactttgcactgttagcactctccgccgtcctcagagcatctttaagctgctgtgcctgaatctccagctttttctgcatttctctcaaatctgttaaatcggtaacgtcaatataaagcaaaagatatacaggatagccatctatccaatcaacacagtcgccgtttatctgcatccatgcagtttgaccgtcatagctctgaagcttggccagaaaatgtatatgttttcccttttttatattttcattctgagaattgataacatcgttattggtatccatattcatctgaagcaatctatctgaatcaacattggttccgacttcgccaaaaaaaccataaaaacggtcatttgcctccagaagcttcagttcaaaattatctttcacaagaaattttgccacaaaaccgggaatattattgtatgtaatagactgcgcttttttcatttcaacaaggtcgtttacatttgttataacagtataggatatgggataaccgtttacataagtatcagtatatatccagttcatccttacccaaacgtgtccgccgcccttaaccggcattctggttattgtgctgtactgagatagtcctttttcaattgtctccacaaccaaatctttaatcttttgaagttcatcctcatagtgatgatatttgtaatataagttagggcaattatgaaactttgcttcatattcttctttgcgataccctattaggtcataataaaaatcatttccccatatcatagtaaaatcatcatcaagcaaatgcttgctaacactgacctgcatagcgctcataagaagattataatccgaatcaaccgcaccgttcattaagatatcattcttgtttaactcgtttttttccatacgctttgcctcctttggttacacatatcactcgtccgaaacatcattagtatctaatttttatccgtttttaaatccgtaatattatgacaagctataaggcaagcgtctcgattaccccatcgtatacgggaggcgtccgccatagaccaaatatttgacgcagggttgtaaatctcaatagttttatttttatcctcttttattccgttcatagggcacatctcacatggaatatccctattataaaacgctctgtaacatttcatgcccaattttgcttcaggcgctatttgctgtatctttgcattaatatatttaagttcatagctgtgcgggtcaagaacatatatccatgagttttgactgtcaagtatcattctcaaatcccgggctgcgctaataactcggtcctgagcacgttttttcagaagaaaagttgataacagttccgagataaatatcaatgcgtctatttgatttttggtccacatacggagtataacacagtcgtcaaagccgacaaaaccaacaaacttttcaccgtctctcacggcgcattgaagcactgaccttattccctgcggaagcaaaatattataaagctcctttgacaggtctgatatatcctgacaatagaatattccgttctcatcaaagttatcacgataattcttacccattctctcatagctgatatgctgaagattatcaatctcaggctcaataccgtcgttgcaccactcaaatgtatttgaaacataatttccgtcttccgagtcctcaaaaatatatacccggctcacattataccgccgtccaaccaattccagtatagaattaaccgcttcatttatatcatcagactcataaagcttttggaaagcaagaggaacaatgctgtctatattataattatccgaatcatcagaatcaatctgagtcccggctgctgaaacttgtttctggtacaccccaaaacttttcatcatagagctgtcgtcatacactgcaaactggtttttgccgttatttttcgcatgatacagagccaaatcacaacgcttaaataatccctgaaagtctgttccatcattgggatatatagaaattccaatactggtagtcaaaccgaatttctgaaactcgcttaaatatatatttctaaaagtttcaacaactctctgtgctacttcctctatcattgtcaaaccgccggaacattcaataaataccaggaattcatcgcccccaaatcttgcaatgatatccccgttattaaacgtctccgtaagcctgaaagcgctttcagccaaaatagcgtcgccgaacatatgtccataataatcgtttatttgcttaaagttatcaatatcaataataagcatagcataacttttattctcattattacgttcaagtctgttctgaattatttgaaccgcagtctctttattatagagtttagtaagcgcgtctttttgagccctgtccgacagctcctgtatacggcgtttttcagaatctatatccagtataacccccaccgctttgactgcctttccggaatcatcaaactgagttgtcatacgtatgcggcaccatatatattttccctcggctccggctatacgaagctctgcttctgcgtacggaacgccttttatcactttttgcattatcttctgcaatgcaggaatatcatccgggaatatatgagacagcttttttatttgagtgaaaatatttcctgatattggttcatagccaaatttgttcttccaattattcgaaaacttaacttctccgctttctatatcaccctcaaaaataatatcattggtctggtcttgtattatacggtaacgctccatggttagcctgagttcttcctgagattgcttaatttgtgttatatccgttaaaacacagttaagatattcgtttccgtcttctcccactacccttttgcttttatctaaaatccaaactgttctgccgtctttagttttcaccctatattccagttcctgcgtgcttcctaacgaaagctgctcgttaaaccagtgccttaccgctatatgatcttctgggagaaccaaatcaatataccggttctgaaatttctctttaatttcttctttactgtaaccaaacaaagaaataaagccttcatttatatatgtcacagtaaaatattggtcattcatacactgaagtataccggcaggcaaattttttgaaaccgaagcgccggacttctcgggtttcatattctcaatattagaaggttcatcaatcaagcgccaaactatgagcgctttatgactttttgggttttctatattcacgcgaacagccgcagcttcataccacacatattttcctgaggctctgtgaaacactctgtatcgtgttgaagattttattaaaccatggctgaaaaaattatcaatttgattttttagtatatccaaaactaactcacggtcattgggatgaactgaactctcaacaaaattaataacggcttcctcaaaactgtttccagttttaagcgcctgaaaatcatcgttctgctgataaaccaaatgataaattccgctgtctaaatctatttcaaaaactgtcgaatcaacataacgaagcattgcgaaatattttatttgatcctgagcatacatattatcaatgccggaatgcagcggagacggtacagacaaagacttggcaaaatcaagcttcggcgaatgaccgtcagcatattcccgggcaagctcaaaaaaacttgccttaacattcttcaagcactctaacgtctttggtgaaaacacaccgcactcaccatttaaaatcatagtcatcgctttttcaggttctatagctctcttatacaccctgtcggtagtcaaagcgtcaaaagcgtccgctatgccgaccacctgagcacaaatcggagtattgtctcccttcaagccgtcaggataacctctgccgtcccagcgctcatgatgatatcggcatatattataagcatacctcaaatattcatcatcacctacacggtcaagacccgaaagtatttcacaccccttaactgtgtgggtcttcattatatcaaattcttcttttgtcagcctgccgggcttatttaaaatagtatcaggtattgatattttacctatatcatgaagagctgccgcctcagagataacacgtatggaatgctcattaagctcatattcaggacagcatttcataacctcttccagcaacaccttagtaaacatacgtatacgcaaaacatgctgtcctgtctcaacactgcggtgttctatgatagatgagagagtatccattattacgtccctggattccctaagctttgccgcctgttcttctaccatttcctcaagatgcattttatgccggttaagctctacagcattctgaaccctccgtctgacaacatgagactcaaacggtttgattataatatccgccgctccaaggtcaaaagctcgcacttcgttttccatcgagtcaaccgatgtaataactataacaggaatttttgtcatcaatccgttttgagtcatttctgacattacctgatatccgtctttaacgggcatcactaaatctaaaagaatagcagcaagcgagtccttatactggcgaatcatcataagagcctgctctccgttttcggcttcaagcagattatattcctgctcaaaaagattgcggagaattgctcggttgatttccatatcatcaactatcaaaatagtatctcgattcattatttttcctccatagaacctgcccaaaataacacaattgtgcatcatacgggaaaattcaattcattttttcaatataaataaacagcttaccgagtttcaggtataaaatacatatttctgccgtatttccgtttagtgtataaatacccttattttaatttttagattaaagaagtatatcacgcagcatcatttttgtcaagaaattagacctccgaatatacaatataatatatgaaaataaataaaatattttcactcattatttcataaattgtttttagtataaatatctcttattttgtattataaagtaattttaaaacctaacacttataaatttttttgaaaatttgtgaaatataaagacaaacatataaatataaaatttcatatttacaacatagaaatcaataccacgtgtaaaccggcagcatactcagcacccataaaggaaaaatacattcttaacctcaaaaatcgatcgaaatttataaaccattactatctcagacagccgctttcgtacatccgcttttttcctgctttttatttctatttaaacataaagattattccactggaatttttttatttcgccgagacttcttattttgaagcctcttcttttctggaactcctcttttgctggagtctcttcttttactggagccttttctttcaatggagcttcttctttttccgaagccttcttccttttccggcgttttctcttttactgaagttttttctccgttaaaatgtagagttatttccacaccttaaggtggaaatcataaaacccataagatcaatatcttatgggttttaataaaattagaaattattgggaagaaatctaataatttttattaaataaaagcgttaattgtttgccgtatactctactttatacacatttaatccgctttctttggaatagatgtatacaggagcacccgcggcaatatccaccgtcattgtctgagttgcgccgaccgcggcttcctgcagtatttctgtaccgttttgatttaccgccataaatctcggctcaccctgagatgacgcatgagcaaaagaaattgaaagctttcctgccgcgccgggtgtgaacgccaaatgctggtcgctgacagaacccgctccggcaagtttcagtctctcagtaaacttatcagtgccgatagtttttgaactgtaatctactacaattgcctttttgcttggattaatatataaattatcatatataaccaaaccttcagacattgtcaatgtatcatgctttccgtcatttccttttacgcctaaagcttccattggtacaactccaaatgtccaagtatgcgagccttcttgtgtctccataggataaggtgaagaagtcggagccgacgtcggagcgcttgtagcgtcagggtcgactgttggttcaactgtagggtcaggatttaccgacggttcagttgtagggtcaggtttatccgttggatccaaagacggcaatggtgaagatgaactcttttcaatagtctttgccacactgagcggtgcaatagaattataattattccatatcaaaactttaaccgtttcatttgcaggctcagtaaatccgtttatagtatacgtaccggttcctgatatgtttattgtctttacatttgtcataatacggtctgtgctgtaagaaacaaccatcatagaagcctctccgctgccgctgccgttatactgaacattaacgctcaaaccatcgtttgtatactcagttgaaattatctgatagtcaaacgacgccgggtcaactgtcggcacaggtctgtttgtcggttttgccgtaggattcggaccgtctgtcggcgccggtgcactggttgcaaagcctgctccaaagaattcagcctttgaaccgtctacaaatccataatatgttttacctgcttcaacagctcctgatgtgctcttatattcactcgacgctgaagcatttgtataagaagctaccgtgtttccgctttcatccataatatagaaagtctttcctgcatttaccttataataaactataaacgttccgtcgctctccggtgtgaatttcagtgaagctcctgtctttccgtccggtgaagctgctgtcagtccaacacacttacctgtaaatgctactccgccgattgtctgcttcttctcagtatatgtcatattgtctaccgggcttaatccaggtatacctatagtctcacctgctgtaatattcgctgccggcttccaatatgttgtcttaggcgctgctgttggaggcgctgttggcaatgctgtggcagtcggtgttggctgcgtcgggtcaagagttggtcccggtgtgtttgtcggtttcggtgtttctataggcttgatagttggttttgaggtcggtataggaccgtcagttgttgccggatatgtctttccgctgacaatatagttccaagccattgatgttgtgtattctttcagttttgcttccaatacagtatcaattgcatagctttcatcagctacagaatcatcgaaagtataaataaagtctccgccctgtgttctgccggcaaaagctgttacattgcccggaacattttcagggtcgtcaggtgtatatgtatacattgctgcagcagtgtcaaaattgttatactttgttccgccggctactgtaacatattgctcaggaaccttttcatcacggctatatgctatatatgcgtcaaaacctgtctcaatcggggttctcgcatcaactaccggaactgtacggtcaccggttatagtattattaaacatttttaccataccgccgtcttctcctgaaaacgttccttttccaagagcgtctgttccctgtcttgaagagagaacaggatgatagcagtttctgaaataattattttcaacaaatgctgaaccgccggttgtaataccaactccatactttgcgtttccatcaaaatagttattgtatatatgtattgttccaactcttattctgggatgacgtgaatccgagtggtcaaaccagttatgatgataagtaacaaagaattctcctgtgtttgaatcctgatgcataccgcaaagtgaacactttcctgaatcaaagaaatggttataagacactgttacatatgttgatttgcctttaacatcaacagaaccatctcccttttcctggtctccgcctttgttctgtccatagaaaatatcattgttatgtacccaaatattagtattagcagtatcaagtgagataccatcatcattgaatccctttactccaaaatttcttacctcaatgttatttgccatccttattaggaaactccagccattaagcatagtatcgtctccaataccttcaacagtcacattataacatcccttaacctgaatatatctatcaccgttaagtccgcttacatctgtagagtttatcataccaataaatctgataataagaggtgttttatcataacctttttcacggcctgccataatattggctaatcctacttcatgagtagtgccgcctttgctattggtaacaacatctaactcaactgtgtttattgtatccttatcaatataaagtattattgcgtcatctccgggagttccgttatctttataaccgcctgaagctgtcttgttcggtgaagccgggtcatgagcataaccgtctctgttgtgagccaaaacattaatcacttctgtctcaacagccccggtctcagatccatccattacagacgctattttaatggtatattgacctgcttccaatcctactgcgtctactctataatatgaaccatagtaacggactaattcgtcgtctaccttaatataatctgtatccccagcttttttggtatatacattatatttgtctacttctgccgtatttgtccatttaacaacagctgattcaagccatcctgcctgctcaataattttaatatccgacggcagcggctcaacaggtgaaacctgtaactcattcgaatctgtagaaccgtttttatttgaagctttcacaacatatttatatgctgttccgtttgtaagccttgtatcctgatacgttttatcagtaagccctgtagctatagctgttccgtcgcggtacacatcatatgaaaccgcatactgagccgctgtccagctaaggtttaccctctgatttccggcggttgccgtaagagtgaaagttcccggaggttcagtaggctctttaggagtggctgtcactgtgacgccggcgcttgaacctgccgagtttacagctttaaccacaaatgtgtgttcaacatcgtttgtcagttcgccaatagtataattagttgatgttgtttctataggaacacttgaaccatcaacaaatatataatatactgaagcaagacttgaagcttcccaatctaaatcaacctgactatcacctattgacgctgttaaattagtaacatcagcaggaggttcatttgattcaacagtgaataccgctgttgaaagataagcatgattagcgcttacatccactatggtacccgttccatcatccatcttagtaggcactgttacagccgttattttatatgtaccggcaggcatattagacaatgttaaaccgtcctcagcagattttcttccatacatctttccgtccggagctgttatcataaagccttttgcattattgctgtgtaaacttgagaatgttgcgctccatacgctgtcaacgacgaatgtcaaagcgtcagttgatgtttttgtaatctgaacatatgatttgctgtccgaggctgcggctgacaccgtgccagaaaatccttcaaatccctctgttccttctgcaagcgtcttagtggtcaattttgtaaaatcatacactgtagtgccaaccggaacgaccgtgccgcctaccgcgttaacttccatgaaaccaagtccggcaaacaatgttatcatcattgccaaactcaataccatagcaatagtttttcttgtaaaactacccattagaaattcctccttaaatttttatatcttttcaaatatatttggtgtatttatactaatacataatttttttaaattcaagtgttttttaacataccgcaaaataaccagtaaagtaaaacaagaattttagcctcctattttaattgtgcaatttgacgatgtttttttcattttatcacatccatattattaaaaacatcagtttttcggaatattcaagcacaaaaatatgcacaaagcatatcgcttcaccattatagttgtttagttttttggcatttctttatttttttgccatttctataaataccagcgaaagtgctttagaataccaaatgttaaaaaaactacaatatatactgataatttaaaatttattataactagatagtgtattagaaaaaagaataaaatatacccgcaaaatttataatataataaaaattttataaaatttacagacgaaaaatatcattaagtaaatttaaaatgtaaagtcaattcgactcttaacatattattatttgattcagcagaaattctgtaaaatccgattttaacaatttatctaaaataatagtttaaaataaacaaccatataacagtgttaaaattttaaacatctgccattaaatataacgtttgaaaattaacataaagccagacagaaaaaaattaagaatatttttagagaacatcaactgtaccgtaaaaaagctacaataaattggacagataaattaagtttatatattataaaaaagtcccataacagtgcttaaaatactaaacatctgctatgggatataatttttattcaatatactctctaagcctaaactttacaccgcagtcttcagctatctttctgcatatctcaatgtcactttccggtatagttttatctaccacactaaagacaacaagtttaacataatcttttgctcttttcgcaaaatcctgcaaagcctcaaaagactcttctccatatctgctcttgcatatatcctgatattctttagcgtttgaagcatttaaactgattcctataatatctatagcgccatcaagctccggagtgacatccctgccgttaataagatttgcctgaccgtttgtgtttattcttataacagaatcagttttttttgactttatccatcttgcaatctcaattaaatcgtcaaacctttcggttggttctccatatccgcagaatactatctcatcatattttgataaatctcttttctcaaaatcagcttttatctcctcgatactcggctccctatccagccaaaggtcatcctttccgttaacattatcatgttttgtcctgacgcagaaaacgcatgcattcgaacagcggtttgttatgtttacataaagtgaattatgatattcatatgttatagtcaatattctctcttcctttcaaattcaatctaaaattaaacaagcttctcattttttataatctgataaagcgccaaagctatcagttcaacatccacaagattgtcattattccccgctgaatcacgcagcctgagaaaatctccgctttcctctttggcggtcaaattcagcactactgtaaatactgagccgccttcttttatatttgagacaagaatttttccatccatatttccggccagtttctgacaaaccaaaaggccgtatcccttatatgacctaagcaaggtcttgctaccgtcaaaaacgtcattgatgttccgttccataattgcatgaatctttttcaaatcgacgcctataccataatccacaacagagattgcaatgaatttttcttttttaaaactatttaatataatatcaacttttctgttttcagagtgactgtgaactaaagcgttaacaagcagattgaccagtatatgagtaagccctgtctgattaatactggcgtataaatcatttcttacgttgttacgcaaagaaatatttctgcacattgaaacaggcagacagttatgcacagttttaacaaactcatttaaaaacgcactgatttcaaccgaatttcttgtttttaaatttatgccatatttcccctgggtaagctcacatagatttcttaggcgcaaataagttgttcccatagaagaacttgccttatatataatatcaatattatcaggtttaagatcctcagactcgaccaggagtttaagaagatttctgacataatatgtattatcttcaataagttttactatataatcaatatcgttttcaaatgttgaatcaaaggcgcctacacgtaaaaccaacttttcgttttttaaattatttgctaaaaatgctctgagatttttagcgcttaactttccgttttcgcctatacaaagctctttaacagaatcgttcatatcgggcacccccaaatctttagaatataataacacattttatataatttttcaacagtgatattatattattttaagctgaaaaattttatctactatccacttttcttagcggctgcttgatttaaatatactttcagcaaatagttcgatattataaacttcttaaaggatactattattctgttctcacttattccatatatattatcccattacttacttgcagcatattcaaataaactaaatatatccttaatgaatctaatattttgcatctatttatatattttcctgccgctgctaataaataaaaagttaaatcattttcaaactccagcattaaatatccaacatcaacacaaatcaacaaaacctgtaaaatgatattttatttttttatactatctcaattcatctcgcattatttataccgctctgcccggtccataatattccctgtttaagtctttcttatatggtcagcttgactcaatacatttggatatcaatagtatacagtactttaaactaaataaacataaaaaactaaaacggagctatataaatttctaaccatttaaaattaaagtgtatgatgaattttattttaaatagttatttctttatatattcaaaaactttctgatgtttttactccgtttcagttttttatgtgcacgcttgtatatatttacatcgcttcttagtttcctgaggatgatgtttatagctgcatccccaggaaacatttctaatttattagaacaataatagcagtgccaaatatattttatctatattataatttttttaaatccccattttcttgtctttcctctattattacacttccatccatagggtctattattacgactacattggatgtatttaatatagtaattaaatcatttttatcttcttcattcgcattgaacaaaagatgtacctcatatacacaatctgcccaatcagcagttggctgtaaatatgctgcatagtaaaaagaattttcatttatataatctgaataatattcctctgtaatagctttaccaatttctaaagcagtctctgaactttttattaattgttcatcttttcccgcttgttttaatgttatttccttactctcctcactccactctacatttttagaaataagtttcgccaaatcccttaccgaaatatatgtattattattatatgaaattataggattttgtaaataatcgcttatacgtccttttattgaatcaatctgtccaaatatagtataatcaactatattagcttctattgtttcagtagttagcgcaaatgtcaccatacttataaccataactactataaaactcaatacaataataaattttttcataaaatttctatctcctttcgttatataattctattgttgaagcaattatactttgtataaaatttgattaaatatcaaaccatttagcgaatcagaaaaaatattactgaataaaactatttgtaatttagtttaattaaaaagtcattaataaattatatcgtaaattattattatagtttcatacgcataaaaaactgaaacggagttatatgtattctctaactatttaaatttaaggtgtttaatggattttattttaaataattaaatatttttatatatacaaaaactttccggtgttttttactccgtttcagttttttatgcgcacgcttgtccagcttttgagggattaccggagtgtgtaaatcactttacacactccataacaattttagtttgtataaatatctactctctgtaattcttcatcacacttaccatatacactttaattgcaatttttatttgcatacttaacattttctatcttcacactctttaatagcatatattgcattatcaaaactcataacaattagtttaaatatccttagattacactaaaagttaaaattttaatccattatatcatgtatctcttcaaaatcaggtttcgttacgcttggtcgtcctattcgcctataattatacatttgagcataatcacctatttgtctcgtatgtatatataatgcttgattaaccaagtataaatattcatatgctgttatattttcttctaactgctctggatacacattcatttcatattcacttattgcatttttacaatttattattccggtatctatacaaaattgataatatggattagttacattcggataattttctgaataatatttttctatgtacaaatccgccaaaaagctagaacccccagaagtcgacagcattttacatattgttataaatgcttcattatatttcacgttatcatcaaaatttgcatataattttccatctcgctcttctcctgctaataaattataacgaaataaactagccgctaatttatagtcatatgataatggttcaatatcacaaaattcaaattttcgtgccgtcctgaattttccataatatccattcatcccatttgaccaagaaatctcttcgagttcactttttaatctttcactagaataactattaacccagcttataaaatctctacttgatgtattaaatacatatgctatttttaaagcatctctgcgagtgattaatgatgtctcatcccaacgtgtttgtacatctcgaacaatatctaatcgttcaaggttttcgattgcagctatctcattaccaagtttatactgttcttctaaattatactctgtatcatatatattttctgcaaaaacaaacgtatttgtcaacaatattattattagcacatatactacttttttcattattttatctcctttgctcttgaaataatgtcataccatataaaatatgtattaagtaatgtcacgccaggcatactttcagttaaatcgtcactaacttcccataaaactgtgtaaggcaaattttgtatccatgccccataatcgtttactcctcctatttcacctcttgatttatctcttttagaaaaacccatttcttgacggtatctttcttcaacagttattgctattgcttcaccatgctttttcttggtgtcaatatttccaaaatctttattcactgcaaatatatttgcagctttcatagcaccaaaaacctctgaatatgtatgagctgcttcgtgaattaatattgttgaatactcattcatcatattgacatctgcgttatctatatctatatttatcagatctatataatcaatccctgcagatgaatcatatatacttttttcatctgagtttgtaaaactaactttaatttccgaatcactacatattaaatcttttaatagcgctttccccgtctcacttccagtatctatatcatcatagtcccaattatctttatctataataattgaatcaccgttagttttataggctaaattaaaatcatcactgccaaaaacaatttttgctaaagcattcaacttaacatatgactcttgactcataacaaaatataatccccaagggtcaacaaagttcacaggattattaccgcagtacgcgtaccagttcaatccgtcttttgccgggtcttcctgcgtgaagcgtccttcgtttattttgtaatacctgtttctcagatataccattccgctttcgttgtcctggtattctccgcagtatttgaacggcgtatttatataactctttattgacgttctattcccatacgcactatagtcacatttggatactgtcgccccgtttgcgtccgtcagcgttactgtgttcccgtgtccgtcatatacatagtagttcactgcgtttttcttattctgcgctattatatttattcccctataatacgttaccgctcctgttccgctgtatcctactatgctgcttccatcccaacggtgcgttggtcgctccatcgacctttttgcttgctctccttcctatcgcatcatatgtatacgttgctgtttctactaatatattttaaaattctttttaactatatgctgtgtttctatttgcgttatatgaaaaatatcttttattgtttccatcttttatttttaattaaacaagctataatccaacccaaaatgataattattaatgatgtcgtaatctgcaacataataatatgtactgtctcgctgtcagggttccataagtttccggtggaaatcccccagttaaaataactaattatatgtcccaataatgtcaggctaatcatcaatagtaaaaaatataaaaacttgcctatgctaaccttattcaaatatttatagctaattattatcaagtatataggtataactaacgttcctaataatagctcaattaatgaaacaccagcactgctagcagaaggtatatccagaagccaaaacggtaaaaacattaaatgaacaataactggtattaaatatatcaaaatataatttcttctcattagtcatacaacctcgtaacagcatatgaatacatgcctttattgtaattctgtgcccaatcacttcctagtatttttatatacgcataaaaaactgaaacggagctatatgtactttttaactatttaaatttaaggtgtttaatggatttttttaaatagttaactaattttatatacacaaaaactttccggtgttttttactccgtttcagttttttatgcgcatgcttgtccaactttttggttaccggagagcgtaaataattacgccctccgtaacaattttactttgtataaatatcaactctctgcaattcttcgtcccattctacctgacagccaaatgcttctgataccgctcttaatggcactaatgttctgctgtcttccactaatcttgcaggaacatccagttctatttcttctccattctttagcatcctattactgtcaattgtcactgacactgttattccctcctttgttgctgttgccgtttgggtttcattttcccattctacttctgctcccaatgcttcgaatattgctctcattggtactaatgttctatcgttttccattactgattcatttaaaaataatgctttttctatattagtatgtaatattataacatttgatatgtttttattttctaaatataaatcaactcttttgttatctatattcacaattatatcgctttttttaaataatcttgtacaaattttattaaactcttttggataaatatacatatcatcatcaaatatttttaaagcagaccacgcacaacaaggttcgttatatttttcttcatcaattatttgaataccgccttgagttggaaaaaaagtttttaaacttttatcactatattttatattaaaattctcttcatattgactaatttcacatcctaaatcatttaatatatttatatatggaagccaaaaacaatttccctctatcttacagtttacgtttaataaaagcatattatttaaataaatctcaccgtttttaacttcataatgtttaatataagattcaatagtatatttattgtaagaataatctttataaacttttttatcactaagctcaggactaatatttgcattaacttcaaacatatactgtgctctatcagtatttaaccataatataatacttggattatcggtattagaatctatatcaaacaaacaataatctaatactttaccatctattccaaaataatttgaaaactcttcaaccgattctattttagaaaaagtctctatcaaatccggcttgaccattatcataaaacttccgcaacgaggataactatcatttaaatcataaagatgttcaaactttattttatccatactacttatacgttctaaaatcaaattctcctccaataatatatattctttaaatttgtttgaagattcttttaattgcttaacattaacattttttaaaaacgtatcaaacgaacttttatctatagaataaatttttattgattgctcatcgtactcctgagcttcacatataaaaaagtgtgtactaaaaacaaaaataaatattaatagtaaaatttttaatttcatacgaattatgcctccttattaataaacaaattcgacagtatatataccgaccaataatttatacgcttgtcccactttaattaatttctctaaggatgtaataaaaatacatccctagatttattaatctaatccatcttttaaatattaaacagaaaagcaagtttacacactatcaatatgatattatttttaatttatttttttcataaacataaaaccatttttataataatacagaaaatcatctagcaggtaacaacctacattttctccatatttgccattttctctaaagcttaaatcactgcattttaatcctagagatttagtttctaacgtattaatgttatatacatataagtttaaattgtctcccggaaaagtaataaagttatcatttatatttataaattgttctattgataaaataccatcattttttaatattttaaaatttccattttccatttcaataacctctattgctcctccatctctaatataatacattttattttgatttattaacaacccaaaatattcacttttagtacagtacaattcaacattgttttccccatctaaatcactttccattaatttatatccttctctatcttttgcaatcattgaatatattttatcatcgtatatccaaaattttaatatcttttcactttcgtcgcttaaaacttttatgccacttccatcataattcattgataagagttgaaacatacaactattattataattgtatgataataggtatagtttatttttatatgtatataaaaatgtgacgtcatcattaaatagcaacttttcgttttccccttctttattcatagaatagactcttttgttttcatccacataaaatatttgatctttagttatatttaaataataaaaaattccttttttaatcatttctttattacttaaatcataattgcttctatataaaacagattctccaccttttaattcattaaaatataaattttcttcatcataacaaaaaagtccataatttaaaagatttcctatagaattaccatcatttttattaatgtctatattaatagatttatcgcaagcagttaatataaaaaacaaaaacattataaaaatactatataacacaattcttaaaattttattcaacatgtcaacctccaaactaaaaatatattcctgaataaattatatattagttatattttgtatttctatatacgcataaaaaactgaaacggagctatatgtattctctaactatttaaatttaaggtgtttaatggattttattttaaatagttagtctaattttatatattcaaaaactttccggtgttttttactccgtttcagttttttatgcgtatgcttgtccagatttttgggggattcccggagagcgtaataatttacgctctccatgacaatttagtttttataaatatctactctttgtaattcttcgtcccattctacccgacagccaaatgcttctgatattgctctcaatggcactaatgttctgctgtctcctactaatcttgcaggtacatccaattttatttcttctccatttttttggatatgttattaaaggctccgtacagctctgatacatttagtctcagattcagctctgtttcacagtttattatttcttccctgcttccttcatatcctccgccgagtaacattacatatactgctattcctttattattcagttcttctatcttttcttccaatgcggtcttatctgttattttttggacgaataaagttatcactttgttcccatttgtggatatactttcctctgcatttaacgcttcctcgcatcgtgcaagcatagtttccgcatctgttgttcccgaatattccttggacatcattagtcccagtgaattctttgcgctttctgtgtcttttgcatatccatagtttgtatcgtccactaaaactatttctgttcctttatttgccgaatctttcagtccttcaactgaacttgcccatctctttgttgaaccctggtcaaacttcttttcctcttctgtatataccggcatacaacaaaagatactccgccactcaaataaactgagcagcggaataaatattcattcagttgttattattgcagtattagtagcttcgttccactctacattatatcctaagttttcggataagaatctaagcggtaccattgttttgtcatttagcagtcttgccggaacgtccatttcagctggatgtccgtttactgttgcatttgtgttgtctatagaaaatgtcacacttttttctgcctcattgctgaatgtgcgtattctctgatcagcacttgtcggcagcgttgctgttgctgtctctgcagactcattccatgttacattggctcccatctgttcaaacaaaaaacgcattggcactagtgttcggtcattttccactactggcggttgtgagaatcctagaattttgtcattaagttgaacataaggggttctggacatttcatcaagtactcggtttatatctgaaagagatatttttattttattttcataagcagattcaagtataagtgaattcttaacaaaataccatctttgtattgttaccggattagaacccatttgtcgttgtacatttaatatttcatcagcattaattggtatttcataaacaccatctttagaaaagtaaaaatatcctccaccattctttataatatatggaaagttagatttcgacacacctctttttccagaatagttttcatgaacaatatctataaatgtgtttccattgtcaaatgatatatcattatattttaaattccccctatatataatattttcgcaagtttctacatcattttcataatcataataacattcttcccaatttatcatgtcagttgatttacataacttatgacctttgtaacctggagatagagtgcaataaaatattccattattacacgaacaactaataatataactacccatcattgtttgagaaattaaattaaatttatcatcataaaaatatacataaaagttactccagcctttccaactatcaccaccggcaaatatagtagaatatggtgcaggatttttccataccatatatccagaatctatttttacataatcgtctgcatgcaattccttaataaaaaaattaaattcattttcattatatggtttagaaacagaagaattggctaaatcaatataatattgtactcccataaactcaaacatataataattacaacataaagaattctcgtagtaacgttcatataacttcactaatccattggtttgtgtatcattagattcaacaatataattaattcctaattgatttaaattaatttttgggtcatcatctactacatatgcgttatagttatcatagttatcatagttatcagaataaacactgctaccaaatatactgataataaaaattaatattataaatatttttgtaaatgtttttttcactattctcttctccttatttttgaattttatctaataaatttttatagtaaatatctgaatgctctgaaataatttcattattttcatctaatttatttatagtataatattttatatcaccgtcaataacaaaagcattatgtaatgttggattgcttcccgtcatcagtgtagtttcaatattaataatagctgtttctccagggcttatatcataattaaaacactctgttgataaccatacccaataaggaacattcttttctattaatccattaaccggtgttttaccaggaatagtgctattaattgaataattgacagtataacacattccttgtaggacatatgagaatttttttgtaacttctgatatatttgttatctttaatctatacttatgcgttacaccgaaaccattcattccttgaactacagctctagtcatattatcagttgaatttggatcaatggatgtatttttcccctgaaaagtttcgaaggcagtattatcttttcctacaatgctgtgcatccaattattatcgaacttctctcccggctttatatattctttttcactgtataaaccaactttaaattcatcaggcagggctgtatcaacggtttgtttggaatgttctgtatcaaatatccactttccttcagaattgttcggtataactgtactttcaattgcaccgttttcagaatttcttatcactcctccatatggcaaagcaatacttatttctgaactttccggcgttgtatatctattattagtagtaaacggtgacatatttgttgtaaagaattgctgccttgacatgccatttaattgattcttcacatatactggcaatagcgtctaaattatataaaatcaaaagatactccgccgctcagtttatttgagcggcggaataaatatctattcagttgttattattgcagtattagtagcctcgtcccactctacattatatcctaagttttcagataagaatctaagcggaaccattgttttgtcatttacaagtcttgccggtacatccattgttgcagtttcaccattcactgtagctattgtatcatctatagaaaatgttacacttttctctttttcgctgctaaatgtacgcatttgtgtatcagtatttattggaactgttgccgtagctgtctgagtttcttcgttccagttcacatcggctcccatctgctcaaacagaaaacgcatcggtacaagtgttcggtcattttctattaccggcggctgtgaaaagcctaggattttgtcgttaagttgaacatatattttattttttaattgcgatataggtagtctataaaaacaatccatatatagcggttcaaaataaatatatttttctgttgaccacgaataaaatgtttttcctccgtatcgacctttcgaaaaagttggcattactactccatatactccatcaatactaatatcagtagcaattaaacttttatcatccatattataaaaataacaatacgtcggatatccgttatgtaaagcagcaccattatttttggattcttctcttattatgctatattcatttaagttaaatttattgaccaatttatcaggataaataaaatatgaactaacagttttctgttcattaagatatgatttgctatagttttccttagataaagtataatcatcgctattaatttcaattctatttattaaatctgtacttttataatatgtatcgactctttcaccaactcttttatcatctatataagacacattactgtaatccctgtgtttcatataaaaataaccgtcataaaagaattcaatatcaaagcaaccttggtattcaataacattaattagatcataattatcatcaaatacttgtataggtgaattactatgttcaccaattttatatttttctaaatactgctcattattaccatttgtatctgtataatcttcaaatccaacaattacatttaatccgtttccagaaataaactgctcaacattagttatataattctctggcaaatatgattccggaaacttatacttaaattgcagcttttttaaatcatgtattccatctgacatagaaacatatgcagaaccgggttcagaatataaatatttattattaacaactgctctacggcatatatttatatctgtttttcctttactaataacttcaaaatatggcaaatcactttctaatatttctgttgcattttcacttatttctttttctgtggattcgaaatatacccattcattttcttcaagataatatcttataatattaaaacattttgaattatccattaaagataacaatgtatttgatgtctgtattttatctgtttgtccatatgtatattctaatggcaattttaataataaagtttgcttgcttccatcacttatgtcaaataaagcagcttctattctattattctgattactatctttatatattacataatgtgactgttgtacttggggcaattctggaatatattcatctgcagaagctatgtacgcaaataaatttgtcaaaattacaattgcaaatataattattatttttttatttattttattcatattttttcctttctattctactcgtagcatatttataaatccgcctgttccaatatttggtatttctgtttcaagcttaatgttttttgaattgttaggttcgattgtgacgttaaataactcatgtgccacaaaagaaccatctactattgatttttcagatgtgtcacatttaatgtttgtaattacggggtttccatcaattgtatattgataaaaaaatgggcttattgttcttaccataaatgatatttttcggttttgcgttgtattattgtttaacttaatattataacgttcaattacactaaaatttcccattgagcaagaatctggatcataatagtgtcctgtttgagctccgtaatctaatatttcttgtgttgtaattacaccgttccctttattaggacgtttatgaaatggatcaaagtaccactttttttgttgtccgtcagtgaatgtatatcccattatatcagaaatatcacccgaataaaaagctgtataatcatttgctggatttaatttggtagtccacgatattgaattttcagagttttctacaacagcattgtccataccactatagaaaatatattgattattcatatctttttgaatttttgaaccattaggatttcctaaattaaatacaattgggctataataattattgttaatagtgttattgtcaatattccacacaatatcagtctcagtttctgcaattgaatttgttttccctttagctttatccgccaagtctccttcaaattcatctctgttacctgtaattacatctggatcttgtggtaaattaaaattaccattagaatctattacgctgtttacgtcattaaaagcaatagaagttaattttatgcttccaacaccatttataggttctcctgtttgggttaatgtctcaatattcaacctagcaataacaaaaccagttgtgctactacttcctggcgaataaagagccctatatgcatcgaataaatcaatggtttgaccaggctttaatatagcagaaccattcatttttgaaagtctatatgccaaattttcatttatatcattttttttagtattagaaatatattcatcgtatttataactttcatttttaacactatttccattaaacttatatggttcggtcaaatcgcactccatataatcagcccatgccgaaaaagcagtgtaatctaaaactgtttgacttagccattgtgaattcaaatttgtatcaggtctgattccaacacgttcaacttctatactcacagaattttgactagtattagttaaaagatattcaaaagccactttactattaccatacgataaacaattccaatgtatcatatgcgatgtagctatatcaacaattccggttaaattatcttctacaattaatgaactatttccatacccctctttagcatctgctaaatcttccgatatcaacatttcaggtctattatcataaataaatgttccatacctatcaggggcaaacactaattcatctgtttttggattcgttattttaaaactatagtccgttttgcttgtatttacctttaaatatacattttcaccctttaatatattataccttccccctcctgataaatcatctagtccccgtacttctcttttgttcatatcacttacttttaccgtacaattttttatatcacttatatgataatatcctgtcttaggagccacaaagaaaaattcacctgagccgtttttgtccagtgacggctttactgtaaatgtatctatgtttgataaatctatgtagtttgcttctccttcattaatcacttttccttctctaatccttcatcaagcacaaacttacactttactattaacttcgatgcttcagctctgtttaatttttcattccaatttatatatcctgtatcggttccatccattgcgccatttaagtatagctgacctatctcatctttacaatacagtatctctccctgatccttaaacgctattccggctttccatcttgtatttctttcgcatgatacattttcatcatatttatatagattggatggtattctcaggtttggctgatttgtttcgtctataaacattctgtttatcatatacgctgcgtcacaccttggcacaaatgtatccggagtgttatctcccgttacattttctatggttattatatttttttctattccatagcatatatatttctttgcccagtgttcttttattaaagctggcatatgtgattcctgtttcgatactgcctcatttatttgctcttctgaaatatctgccaattctataagtatttttaaaaactcacttattgtcacctcgtcttccggaagaaaatttaaattttcatctccgcctatggctcctaaattggtcgctttaaacaagtattcatagtaccatgcatttttaacctgttcatctatatattgtttaactaaataatattttgtcgagttatatatttcaggaaccgaacctttatatattgttttaaccccggataagaattcattatttgttgatattcctgttaatgtgggcataccatttctaacatttaaattttcgttttcaaatgttgttccattatatccaacaaactttatatccccattttttaaactaaagtttttggtacattgaaacttatcttatcatagaatacgttattaccgatatattcatcttttattgaggtcccgttcgcaatttcaagcaaatatgaatatgtatcaattactccagcaattttactttcatcaaatttatcatcatacttatagaaattatatccattattagaacctattataattgcatatttgttcgcagaatcttttgcaacgactggaaaacgatatttcaagttatcctctattgttttgttaattgatggagagcttgtaatccatgcgaaatcgctttccatttctgtataaaatgcatacatattacttaaatcgcttccattcatcgcatgtgcatttccatttactaaattgtatacatcatccggttcagtgaataagtcatagtctttagtatctccctcgcttttactagcgatagccggcaaacatccataaatgtttaaaacagaagcaattgacacaccaaattggttggtagtaacattagcaaaatcatgttttcccgctctaaaattgcttagatattcagtaactgctctggattctccattctctgaaagactcataacctgtgatatgttattaaaggctccgtacagctctgatacatttagtctcagattcagctctgtttcacagtttattatttcttccctgcttccttcatatcctccgccgagtaacattacatatactgctattcctttattattcagttcttctatcttttcttccaatgcggtcttatctgttattttttggacgaataaagttatcactttgttcccatttgtggatatactttcctctgcatttaacgcttcctcgcatcgtgcaagcatagtttccgcatctgttgttcccgaatattccttggacatcattagtcccagtgaattctttgcgctttctgtgtcttttgcatatccatagtttgtatcgtccactaaaactatttctgttcctttatttgccgaatctttcagtccttcaactgaacttgcccatctctttgttgaaccctggtcaaacttcttttcctcttctgtatataccggcatacaacaaaagatactccgccgtgcgggttacaccgttctggatatatcttgtggcaacgttttggcaacacctgcaacataaattgtattgttccataaatatagagctaactgatttgatttatcagttagctctttttgttggggtctttagacgtggaaaaaaaccttcggttctaccggaggaagataaaaagctttagcataagaaaaatctccatgatataatagtaaatggtttggcgaccgcattacaaaaaatatatcatggaggtttttaataatgttaaagaagagcacaaatgaaataaagagcacagcacactcaaaatacaggtgtcaatatcacatagtatttgcaccgaaatatcggagaaaagaaatatatggtcagttgaaaagagatataggagaaatactccgaaagctttgtaaacaaaaaggagtagaaataatggaagcagaagcctgcctagaccatatacatatgcttgttagtatcccaccatatataagtatagcacagtttatgggatatctcaaggggaaaagttcattaatgatattcgatagacacgccaatttgaaatataagtatggttcaagaaatttttggtgtagaggatattatgttgatacagtggggagaaataaaaaaataatatccgaatatatcaggaatcaacttgaggaggattatgcatcggatcaaataagcatgaaagagtatttaaacccgtttacgggtagcaagaataagtaggcaaaaaatacagccgcacgtgagcggctgcctgtgatagtaatgcggtgtcaaacttctgtgctccttacaggggttaagcctgtattagccccttataggggctgtgcaagccaccagtttactggtggtcttgacttaccaaaataaggaggtggaacagcatggagaaaataatatttgattattactatggtaatcaggcggagcagtacagcttttaccgtataccaaaaattctttttaaggataagacgtttaaatcactatcaaccgatgcaaaggtattatacggatttatgcttgaccgaatgggattatcagttaaaaacagatggtttgacgatgaaaacaaggtatatataatctataccttaaaaaatattatggaggatttcgggtgtgccgataataaggcaacaaaattattgaatgagcttgataaggaaacaggaataggcttgatagaacggagacgtcagggattggggaagactgatattatatatgttaaaagctttgttataacgccggagaaccagcacgaatccggaatcgtgaaaatcacgagcaattaatactaatattaataatactgagtataacaatactgataataataaaactgagtatataaatcatcaatcttatctatcgtgtaatacagcaagtgaaactttttcaatggataggattgaggattatgaaaaatacagagagcttgtaaaaagaaatatagagtatgagggattaattctgcatgaggaaaaagaggtaattgacaacattgtggatattatggcggatgttctgacttttccggctgaaagctattatattaaccatgtacagtatacggctcctgtggtaaaaagtattttcatgaaaataaattacacacatatcagcaatatgcttttggcaatgaatgaaaactgtacgaagatacgaaatgtacgcagctatctgatagctgctatttttaattcatacagcacctcagatgtatatattgactggcgtgtgcgctatgatatgaaaaaatgagagagtaggtgatagctattatggagaataaaatattaaaaaccggaaatggagacaatacagaaataatacagactgtaaacatatcagaactaaagccgtatgagcagcagccgtttaaggtattgattgatgaaagtatggaggagattatggagagtataaaacaaaatggggtattatcgcctattattgcaagacctcatagagaaggcggatatgaaattctttcagggcacagacgtataaaagcatgtgagcttacgggaattacatagattccggttgtagtaaaaaatcttgacgatgatacagcggcaattttactggtagacagcaatttacaaagagaaaatatcctgccgagccaaaaggcttttgcgtatcggctgaagctggaagctatgaaacgtcaaggtgaaagaacagatttaacatctgcacaatttgtgccaaagttaacagcacgggaacaatttgctcaagaagctggagtaaatcttatggaaattacaagttacatacgccttacgaatctaattgacccgttacttgaaatggttgacgaaaagaaaatagccttaaatgcagctgttgggttatcctatttaggcaccaaaggaacaggcagaggttctaaattcaatcgaaaaggaggaggcttcaccatctattgcacaggctgcaaaaatgcggcgtttttcacagaatggtaagctaaatcccaatgttatagattctattatgcaggaacagaagccggaaaagattaaaataacattggcaggtgataaggttaaaaagtatttcccggaagattatactgaaaagcagatagaggatgttatgataaaactattagacgactggtataaaaagcggcagcgtaaaaaggaatatgaacgttaaagcggtatctcatgatattaagggataccgcttttatagtggaggattttatggatatccaaagaataaactcaggatatttaattataaatcaaattaaggttggcgaaatagaaattgtgctggatgttcaccccaaattgcctaatagctttgttacatggaaatgtaaaaacggtgactattactattgggggaactatcatacaagcctgttgtcggcccaaaaagatttctgtaagcgtgctctatcagaaataagaaacattgaacagatatataaaaaacaaaagcaaatagaaaacgagaggttaaggcatgattaatagacctgttagcattccgctgttcaattgtatatatcaataataacttaaatataagaaaatcacatttgtgtgcgattcttttgtgcgatagaacgatatacgttgacatttatggtgattattgatataatattttgtaagattaaacaatgtttcggaggtgtcttaaatgaggataagttataaaaagctctgggtactgctcgctgaaaaagaactgagcaaagcagagtttcgtgatgctcttgaactgtcaacaggtactatgacaaaattaaataaaggcgatgaagtatccttatctactctccttcgtatatgcggatatttcaaatgcaatatcggcgatatttgtgatgccgttgaaatttaatagaagatatgctcatagaaatttgttaaacatttagatgcaaagttaagagtttctctatttgcactaaatttgaaaggaagtttttttatgcttcaaacaccgtttcacgcatattatacagctatgaaactgaatatgctgcaagatgagaatacacttcttccggtatttgcggagggtaaaattgatgtgtatccttatcaggttgcagccgcgctgtttgctgttcgcaacccttatcaaaaaggcgtgattctgtgcgatgaagcaggtatgggaaaaagtcatgaagcaatgttgattatttctcagagttggtatgagggcaaaaataatattttaatagccatcccaaacccagatttgcttattcagtgggctgaaatgatttctgaaaaatacagtataccattttgtattgcatctgagaataattcctttgtctatgatggaattgtcattacaacatatgaatacttaacccagaatattgataatgctgataaaataaaatgggatattattatttttgaagaagcaaattctctttcatcagtctatcaagatgaaaatacatttataagaggcagcggaagcaaacaggcaaaactgttaaaggagttttcaaaaaacacttttaaaattcttcttacaggtacgcctatcgagaaaaatataatggacttatacggtcttatattttttattgatgatgaacttctgcctgatgctgatacgtatatgaaaacgtatttaagaagaccggaaaattatccggaacttgcagctaaagtgagcaaatactgtttcagaacgcttagaagtcaagcaaagcagtatgcaaagattcctgaaaggttacatataacacttgaatatgaagcaagcgaaaaagagaaagaattgtataaactgctttttgcgtatatagagaagccacacaaaatagctttcccgcaaatggaacaatatgatttggctcttatgcttttaggacttttatcctcctcaacagcggcgataaagatgagcttgaaaaacataattaaacgtctttatatatccgaggaaaaacaggaatttgaaaaaatgattgcgatagctgaaagtataacggaagattcaaaatcgaggctgctgctcgctgcattggaaaagctgtttccgcttttaaagagactgggagcaaaacaaaaagcagttatatttactgaaagtttggaaacgcaaaaatatctttatggtgtgctcaaggataaatacaaaacgcttgtatataacggtcaatccaatgtaaattataatgtaatcaaacaatttaaagaggatgcgcaaattcttatctctaccgacaacggagctaaaggctataatcttgaagaaagttcacttgttataaattatgatttgctttacaatacgctgaaaatggaacagcgaattgatagaatacacagaatcaatcagcaaaatgattgtatagtcctgtcttttataaataaagataattttgctgatgttagaaagcttgaacttgtgtcaaaaagacatattttatccgacggagtttttggcgtatcggatgcagttatgggcggcttctgcgataatttggataaggcaataaaaagtcttaacgtaagaacaaaagcccagattgaaaaagattatcagataacacttgcacaaaacgagaacaaaaataaacaggtcgttgagtcagccgaggatattctctttaccacatttacaaaggaactgtcggataaaataaagataacaccacggtatgcagaggaacaatcaaaagtaatcaacgatgaactgtgggagcttacaaagttttattttgaggaatataataaaacacatcaagattgctattttgaaataaacgaaaagaataggactataaaagctgataattatacaaagcttccgcacttgttttattatcctaccaataatgggaataaaccatataaagcaattaaagaattcaaaaagttctcactgctgtctccgctgtcaaaggggattacctttaatattagctgcgccgattacggcagtataaaggctgattgcgaaaaatgcacaatagctctttacctaataaaaatatattccggaagacgtgaaattaaaaatattccggtgcttgtgggtataacagaggatggtaagctgcttacacataatgaatgcgaagatatattaaatagtcctgtatatttctttgaggaacagggcgagagaagggcgtattggttaaagtcagaaaaaaacgacaatatggataggcttataaatcttgatgaatatgtaaaaaaagaagaagaaaaacttacgccaatgcagcaggaggagattaacagaatgaagcttgccgccgcgaataggaaaaatattcttcttcattctcttgacgatacagagcttgatatgaagcaggcagaaagagaaaaagaaagcgtaaagtcggacaggctgaagctgcttaaaattgaacgcaaaatatcatctttgaaaaacgagattcggaagaaaaaagaaggattgttctttgatgaaatgcggatagatgttgatttggaaaataaaataaatgaatttttaggcagagaaaaaattacagcaagagccgcaagacaatttgtgttagagataaactgattaacttggaaatgaggtttaaaatgaaaaagaagaaatacgaaataacaatacgctcatcagcagcggaatatttaacctttgtggcatcaacaggcgacagcaaagacagtattgaaatgcgatatgtggacgaaaatatttggctcactcaaaaaatgatggcaacactttatgatgtttctgtggcagctataaatcagcatataaaaagaatttataccgataacgagcttctgccggaagcaactattaagaaatacttaatagttcaacaagaaggggatagacaagtttcccgtaacgtcgatcattataatttacagatgattattgccgttggttttaaggtgaataatgacagggctgttcaattccgtaaatgggcaaattcaatcgttaaagactatacaatacaaggttgggttcttgataaagagagattgatgaacagcggttctatacttacaaaagaatattttgaccacttattggatcaaattcgcgaaatacgcatgtcggaacgtaaattctatcagaagataacggatatttatgcaaccgccttagattatgacaaaacctcaaaaactacaaaggaattttttacaaatgttcaaaataaattgcattgggctattcacaggcacaccgcagcagaaattatagtagagagagcaaatgccgaaaagccaaatatgggactgacttcgtgggaaaaatatcccgatggtaaaattcaaaaatacgatgtttcaattgcaaaaaactatttgaatttggacgagattgaaagtcttgaaagaattgttacgatgtatcttgattatgctgaatatcaagcaggacgtaatattccaatgacaatgcaggattgggtagtaagattgaatcgttttttagaatttaatgaacatgaaatccttcacgacaacggaaaagttacccacgagatagcaaaagcatttgcggaaagtgaatttgagaagtttagagtaattcaggatggtttgtatcaaagcgactttgataagtatatcgaaatagaggaagattcttttgaaaaattaaaacagaaagccaaagaaagcaagctgagacttgacgaataatttggagggatatgaaatggataaaaatattttagacggactttcaatggatttagaaaactcaaatatggagaaattaaagactgtgttcccggaatgtttttcggagggaaagcttgatatagacaagctgttgtcactgtgcggtgaatacatagataatgattttgaaaagtataaatttgagtggaagggcaaatcagagtgtttgcatcttgcacagaagcgttctacgggaacactaagaccttgccgtgaagaaagcgtaaattttgataataccaataatgtttatatagaaggcgataatcttgaggtgttaaagctgttgcaaacagcttattacaataaggtgaagatgatatatattgacccgccgtataacaccggcaatgattttgtgtaaatattatgattgaaacaattacttttaataagtacttccacataagcgacacctcctttcagctgtgagaaacagcatatggagatgacaaccgtccttcaatttcctcttacctgcttgacagtattatacaagaatatacataaaaaatcaagttaaaatagcattacggaatgtcatctaggggcattctttttttgttataatataatagattggaggaataagaatggcaaagatatacatagacccgggacataactgcagcggagcggatacaggagccgtggggtatggattgaaagaacaagatgtatctgtgcagattggagtgatactaagagaattactattggttagcggacaaactgttaagatgagccgtgatagtattaccgatacagtatcaagcagcttaaacggcagtcttgcatacagatataacagtgccaacagctggaatgcagatgtatttgtatcaatacattgcaatgcggcaaacacaaaagcgtatggctgtgagacatattattgcacaggcagcacgcagggcagggcgttagcggaatgtgtacagccgaatatggccgcggagacggaaaggtataacagaggtgttaaatctgctaactttgcggttataaaacacacaaatatgccggctatattggtagagacagcatttattgacaactatgacgataacagatttttagcaagcgaggacggaaaatataagtgcgcaacagcgatatacaaaggtatatgcgactatttggggatagaatataaattggaaagcgaggacgaattaatgagcagagaatatgaagaactaaaggcagaaaacgaccgtcagaatgacataattaaccaaatgggaacagaatttgaagaattgagaaacactgcaaaatctaaaatttatgattacgtggacgacaatatgcctgattgggctagaccgacaatacaaaagttggttgacaagggatttttaaaaggtgatgaggaaggcaagctggggcttactgaggatttaatgcgaatgtttatagtcaatgatagagctggggtatatagggaataaatgagatataacaagtattaaaatatttaattttcataattccacaccaaaatatttattaaaaaacaaaaatatgagactaatcacatatgtgtttatgagataaattgataaaatatttgtatattttatcaaagggtgtggaattatggaacctgttgacattttgaaaatgtgttttagtaatatcctgtattttaaaagaaaagaatttaatctcagtcagggaaagatggctgaaaaatgctgtatgtcattaagacaatatgcagatattgaaagcgggaagaggtttccatcttctattagcctaattaactttataataaatggcgagatagatataaataagtttgtttctgatattcaaaagttaggttatatgcctaaggacagagttacaaagtctaagaaataacacaataattatttgtaactaaataattttaaaatgaaaaaggatagtatacaagctatccttttttataatgtgaataatatgcttatatttctgactgacatttgactgacatttataatgaattttaattaattatactaaatttaaaaaagtgctgtatataataaaaacgccgcagaccacgcacctctcgtaatccacagcgtttccttatggtcggggtgacaggattcgaacctgggcatatttgtgtgttttataaccgcaaagttagcagatttaacacctctgttatacctttccgtctccgcggccatattcggctgtacacattccgctaacgccctgccctgcgtgctgcctgtgcaataatatgtctcacagccatacgcttttgtgtttgccgcattgcaatgtattgatacaaatacatctgcattccagctgttggcactgttatatctgtatgcaagactgccgtttaagctgcttgatactgtatcggtaatactatcacggctcatcttaacagtttgtccgctaaccaatagtaattctcttagtatcactccaatctgcacagatacatcttgttctttcaatccataccccacggctcctgtatccgctccgctgcagttatgtcccgggtctatgtatatctttgccattcttattcctccaatctattatattataacaaaaaaagaatgcccctagatgacattccgtaatgctattttaacttgattttttatgtatattcttgtataatactgtcaagcaggtaagaggaaattgaaggacggttgtcatctccatatgctgtttctcacagctgaaaggaggtgtcgcttatgtggaagtacttattaaaagtaattgtttcaatcataatattatttgtgattgtctccataaaagcagtgtaaccgcccctctggcaaggattgcggttacatatttaccaatatctttgacaaccgtttaacggttatctcttatctgctattattatatacttatgtaatcaatttgtcaaccgctaatttttgttttctttaagctctgccattactttatctgcctttaatgccgtctgcgaaaaactgttattcttccaccacgctacagcagacgcaccaattgtaaatactatactgacaacctggtatatatcatcatccgatatattaagcacctgcttaccgcacatagctaatacctgatttgccagtgccagcaataatactatggttcttgctattgttccagctgttacattattcatgctctttcacctcctcgctcagttcatcaagccgtttgtgcgctgacttagctgacgcttcaacagctaccattctctctattaaattattatgcttatttaccttttcttcaagttgtcctatcctatatgtagtgagcttattcgctgcaaatatccctgataatgagccaatgagcgtacctattaatgatagtaccccaactattattgtgctatccaaaaccatgtcactaacccccaacctatctcacaaatattttaatatggttatcatctatccgctcaagcacgtaaaaaccgtcttctgccgccgttgcttttgcctcatcattaggcttgcaacgaccttttgcttcacatgtgccgtcatctattaccaccagttctccgtgtgttcccatatatccccactccggacggtcttttcttggtatgtatttctgtgaagggtcatagtcttctgataaaatatatacatctccctcgcctgcaggagttataatattgccttcgttatctcttttttcttcccaggttatatgttcagtcaataaccgcccaaatacgtccttcttatatttcccgctccactggtcgtcatagttgtttccaactatacacggattgcctgatattactccgagtaagtcttttgggtctcctgaatttgcaagccgtatcttctcaccgtcaaaacatacaaataatccgcacctgtcttcattattgggatttccgtcagaccattctctaagctccgcataatcggctccggttccgttgattgacttcatcgcatacacatcaccgctgtaagccgcacgaaaggcgttggaacgggaacttaacgtcccgtttccaactataaacccgtcgccgttattatgagaataatatccggcggttggttccaaattatttttaccgcacacagtgttataaccgttgcagagcaaagaccagccgcctattgctaccgccctctcaccattcacagcattagcatagccgcctaatgacacagaacaaactccgggcaccgctccttgtcctcctatgacagcagagtaacttccttctgcgctggccccctccatcacatttatcatctttttatcgttgacatacttttttgtcttatctactaactttgtcagcgctgtcattcctaaaatctttgtcgccatctatatccctccaggtttagttaaataaggcctctacctctgccgccgtgatttcctgcaatgcgtcgttcttcatatatccgcttaagtctatagtctcgccaagagcgtcccacgctgagcctgtccacgcaaagttttgaccgttcttgtcaacaacgttccatacatctccaacggtatttcccgttgtcggaagcgaagcatatgtatccttacttcccttatacttgtatacgcttgacactttgttgtttacatatgtttctgttgctagtcctgcctttgcagccgtaatttttgaatcaacctgagccgatgtcattttcccgtctgcactcgtcttaacttcattaatcgccgcaactatagttccttttgctgttgtgttcaggtctgacaatgcaccaatatttgtttttattccattaatatcatttccctgtccctgtatcatcgaatcagctgaatcttgatgcccgtctacttcgtttatggctgccacaaggttattctttgccgttgttgtcaaggttgtcaatgttcctacatcagtctttgccgcaaaatcctttgtcgcattcgtaactgtagtagatacctgtgaacttgtctgatagccgctgtcgtttgtaagctggctgagtttggttggtatcgctgttgttaccgccttaatcttttctactaactttgttaatgcttccattcctaaaatttttgttgccatgatattacctccataattttatataatatatttattttattttttacttatttaaaataatgcgtttacttcatctgcagtgacctcaacaaattcacctgttatgataccggatgtattaaaaatcctaagcagtttaatttctacatcttcattagttatttcactccctgaatatatcacgctgttacttccgtcaggcagtaaatcattctctgcgtttaatgtaatggtcccgagatagatatttatagttgtcagtttcgtttcgtcctctatctccatatagctgtttggctttccctttgcttctttaagactgtatgttacggtcacatctgacgcgctcaattccccggataaattatccgtgttgagtatgtatgaagcataacagtattttttctcttctccggttttgtcctttacccctgaaatttctaagatttgagacggcagggtaaaagttccgtatgtgtcatctgtaattgttataggcgatatattatatcccactatccaattgccgttttgccatatattaaattcttctgattttgataacgcttctcccatcactgccttactggagttattccctttatccatgctcaattcgttaatagcatctacaatgcttgattgattatttgtatataatctctccaactgacccacatctttaagataatatctatcgtctgtagaatcatatctaactatcttatattttctaaattgcagactttcactttcgctgttactgccttcgcatatttgcacagcattttgagccaaactttccgcaacatctccaattgccacagaatcaagtcctgaagctatagacccatgtccaatcgctacactgtcatttgtcccctctgctcctgcgccaattgctattccatattctccggtggagcctataccgcttccaattgatatactgccgacttctccggcttccgctcctccggctataaatcccccgtttgtaaccttatccgccttttgggataagttgtcagtgacacttgtcatattttgattgacttcattcacagcttcaaccacgttttctttagtcgcggtagtcaaattctgcgtatttcctattagatttattgtgtcctcgtctgtgtcaaccagtgtgtttattgcttctgctatactggttacattaaggttaatatcttctatgctcccaatctcacttttatctgcctttaaatttatttggttaataacctcagttcttaatgcagtaacatcagatattttcgccaatattatccattcggtgaactgcggagcggaactttccaagcctgaaacatttctataatacgttgtccactcgccattaacattttggtgaagcacctgcaagagatttgtaaaaactggatatacctctatcgcaaaccaatatgtgccgccgccccctaatgttccgtcaatagcgcctcccccataataaaagcccggtgttaatatttcatcgggcaatttcgctgtcttcttaaacagagacatatctattttatttattttatccttaactgtgctgtcgtcgtagtctatatcctccgctctgtgtctgtctgccgttccgtctatatggctgttgtaccaccccatcagatttgacagattatctcttataaccgtccaccagtagcgcaatttcgtttgaccgttatagttttcgtttatactatgctttgccattttatcaccctttctttttcgcaacaaaaaaacaccctattgggtgtcttgacaaatattatttgtgtgatataatatagccaatggaacaactgtaggggtacggttattccgctgcaatttagagttgagggaataccgtccgctatgggcggttatttctttttaaatttaaatccacacactccatgtggagtgcgaccatgtacataatacttctaaccttagtagtcattaatttatttaaatccacacacccctgtagggtgcgacataaccgccaatcgtccattggctttttttattatatcaaatgtgcctttttatgtcaattttttacctcctttcatattttattatgtgtgtttagtctgagcagatgggataatctgtcttatctcgctttatctcaacttcacccggtgttacatttttcaacgcctgtgatacaagttctaataccgtatgtgttctgccgtatggtatttttgcttccaaaattgcgtcaaaaacttctctgcaatatggatataagccctccggtatctcatcatcacaaacgaacggaacacgctcatttttttgtaacataattatcatcctttctattttaatatatataaaaagaacgccctttcggacgctcttgtttttccatccacgcaccccgtaaggggtgcgactggaactggacagcagtatttgacggcggcaaagtcatttaaatccacgcaccccatgtggggtgcgacgttgtgaacttatagctcataaaatgacaggtaaaatttaaatccacacaccccttacggggtgcgactcaaagcaactgcatatttcccgtcgtccgatacatttaaatccacgcaccccttgtggggtgcgacagcaaaaatatataagagttatatacttttattcctataattgttatattgttacataatacttaaatgtttaatataaaatgtgtttataagaatgtttcttattatatatttttgtaaaaaagtggtgcgaacctcccagggaaatcatgtgagcatatgattcgcaccactatattatatcattgattaattattatgtaaagtcttatgttagttgtttttgtgtctctctaagtaattgtgtcacatcactaacacaatcagacaatatacggtacaatgatgtataccttgtgtgctcatgcacgattgatgacatatcagttggcttttcacaatcatataattcatttaaatccacgcaccctacacgggtgcgacattattaagcatacttttccgatagattgtattttattcttttcaaatcgttgcaacacactaatatactaactccaagtctgtctattacttttaccgctgcttgatattcgtcctctgcgacatacatatctacctgtgccatcaactctgtcagagtagttgccttacgccttatattgttaattaatttctgcgcatcattattatcgggtatatccacatataatttctttgaccattttaactcattatttggcttaagaattttaaaacaatcctgtatcggtacaccctgtatcatctgcgcaagtttttcgactcctcgtctgttaataacgcacaaactggaaatcattctgtcaattgatgggttgtttcttttaaattttttaagcgcttcgccttccaacaagtaataatctctattgcgttggagccgtcttacataataacgtatcgtatttgcgtttaatcctgtcagtcgtgctatgtcctgtattgttataaccggttctccattatagtattttggtgtaatttcttctgccttagattgctgttgtttaaaatatgtattcactagctgcctttgcacttcccacgctaaatcatcagtaaatgattttaccaacattaaataccctgattctgttactacaatgccacccctagggctgtttattccaaatgtccgactttcggacatttgcagtttatagtagtcttcgccttcaataaaatgccctttgttgtcattaaatctttttcttgctgttccttgtggtctattgtgtacagtgtctatatccctcaaagttactacccttttcccttggtattctttcaacgataattgatgattattaaccgtaattgcattttgcataaaaattcctcctaaaatttctattgaaattccagaagaaatctgatataatagatttatcagaaattcttctggtgcttgaaacagacttgtgtcttttgtgggagacagtctgtttcatttttttgtttccgaaagtaacatttgaatacctcgtcgtattgcttcgccttttgttatgctgtttttattgcaataattttgcaactttgtttccgtttgttcatcaagacgaatactataacgaataactttaggcttatctgctttcggtctgcctgttcttggtgacattacttcacctcactttctgtcacacctttattatactttatgcgtgacagaaagtcaagagtttttttaaatttttatatctattatataaattttttaatttggaccccattcggaaacagaaatatctggtatagtaatattaccacccatagttgattcatatgttaataatccatttgattttcccataattgttatatagtcgttttctaaaattctcatattagccgttttagctttaggcactctgcaaaaaataatactgtcatagtctcctccaatagcaagacgtaactgtgtttctgaggttccctcaataacttgtattactttaccataaaatttcacctttttacctatgtaatcatttggagtacgtgcaagctgattatatgtaatacctgtttcatagctgtttaattctgcttctttggctgctttttctttagctgccttttcctctgccgctttttgagcagctacaggatcaactgttggcgccggcgtaggcttagcggttggaacaggtttaggagttgcagttgatacagattgacttgccgccaatttttgttctgcgttattgtcagaaacagaaacagctataattatagttaatacgacaataagcaaacatattgacgatatcataattattttatcaatattatttttcactatatctatcagcgaatttgttttcggttcatttcctgttttaatagaatatccacaactatcacatttgtttttatccccgacataaaaaccacaattaggacacttttttatagattgattttcctctccctcctttaactcaccaccgcattcattacaaaactttgcgctctccggattttcagttccgcatttactgcatttcatttttcttcatcccctttattctatatttttctacataataccataattttcttaatttgtaaaggaattttatgacgtgttctctaaattcacatttaatacattcagtaaatcattaattcatattataaaagacaccctgcattgggtgtctttatggttaattatattttaatagcggctcaatttcgtctacgtatgtgtcgtaggggatacaacgccgcaaattaataaaaaccatataccaagttttaccgtcaatttctaattcaagtttatcgttcatgattaattcatcaacatttgtctttaatcctttattttctgctaaatcaattatatattgtgcggttatataataaatttcattatcaagtattgtgtaattttttaaatctactggtggtgtatatttactcttcatagtatctttatcaaccctttctccaatataagctgtattatcagtttcgtcatactctactgtttcgccaagtgcttcgcttactgcccgtaaaggtaaatatgtaatatcattatataagaaattatccgctgtaacagtttcaccattaacaactacatttatatcgtttttcagcacgctgatattatcccaaacaccgtttgctaaacttccaattgatagtgtacaaatcgaaccaattaataagccgcaaataaattttttcataattaacaccctttcgctatatattattaacaatatatcatacaaaataaatatatgtcaatacctacatacctttcaacgcatttatttgctcttgtaatgattgtatatcatcttttgttgctatttcagtgttcttataataccacgttccattcatagaaactttattcgaaagtgttgtcaataattttgagttattacaataaaatgttactccgtctatatcattatataatttaaatatttcaacaccattataataagtcgctaaatcgctatgtctaccgtcaggattactaactaatccgtgtaactgattatcactgttataactctgtattccgttgccgtctataacggttcgtgtctgtccattttcacccgtcataaacacaccgcatatagttaaattaccgttgtcgtccatatatagcgattttttgccgctttcgtcaaaaagctcaaatacatatttacctaattgtggatttaagcccgattgatagcgcagtgttccgtttccgtcatacatttgtatcaaattatcctctattttaagttttccattctctgacattatggtgattaagttagtgtatagatatgtcgttgcccaatcgcttccgtcgccgtgtccaaatactcctatccagttccagccgtcgtcacgacttttgtcagcaactccaatcttgattttaccgtctattattgcaacagcgtacattccgttaggggatacgaacattgctcccgtttcatactgcgctattttttggtattctccgttattttcgactgttacatcagtgttctttttcataaattcaagtgtgtttgtcttatattcatttctttcgttctgcgccagtctcaaatactggtgagccgtgaacataccgctgaatgcttctatcatatttattggcggaactcctacgataatagaatttttgtgaggctcatacgggtattttttaaccgttataactctttgattagatttgattccgttgtttatgtcgtttaccgttactatgtcaccaaggtttatttctcccggcaaatccaatacttttacatttaccgcatactttggcacgtctattctttccgggttgtcttctctaaattgtgtctgtgctgccagcaacaaatcttcctggtctgttacttcatcaaagttgcagaatccctcatattctcccaatgtatcatagttaggacttaaaatgtactgcttgtctccttcaagcggcatgtcgtccttaccgtatgggtacagctttgttactaatgtataagttgatattttaggctttatttcacaaccattgtatctagggtcaatgacaaaatctttcttgcttcccagctgtcttacaagacctattttatcattgtcaatatatacttcgctgtgcactctatatttttttaatgtttccataagcctgttgagacacgctataggagtagtctttgacatttcgaaaaagtctattttgtccgtgacaggttcaagccccagtgcttcaatctcttcttttttcaaaactgttacatacggcgttgttgcaaaaatgctctccacaatctcatttgccggggtgtttatcatatctcctatgtattgcacatgcgttctgcacgcgtcctgcagaagcgttgacgctgatattgtgcagtcgtctatatctttaattctgaatatacgtccgtcgtacccgactttgcggtcaaaatcaatcaatccccattttttatcacctttaggcagaataaatgtcaattcataatctccgtttattgactgttcaatacatacatcttttgcattctctaaaaatcccagtctgtctgattcatactctgttgcgtctttgtcatacactgcaataaatttcatttaaaaaccatctccatataataatttaggtacatattctaatataatctgaccgtttccgctcagacaatttatatttattttatttatttcaggtttcagctcaaaaaaatcacctgaaaagccactcggcagaaccgcattcgcacagtctattgttacaggatttctaaaagccgccgtactgcttattgtgctgttgttaacagtcaggctgaatccatttgtttcagtcgttggcgttataacaacaacgggtctgacaggagctgagccgaaataatctaattcaagtcctgttgctcctgcgccgtatattatctcgttttcatcgcccaatcctaagggtatatcgctgtccaatgaatggttgctgtccagcggcacccctttactgtcatgtatccagtcgttaaatggtctgcacctgaattgtattttggtatgtccgttcttgtataattctattgttaaatcgtctaaatcaacaggctttgctatccattttactgttggcatgtcgtcaaatataagtttcccgtatcctccggctaaccagtttgcgacttttgttacgtttttttggagttcaacagtatcgtgagatactaaataaaagtcaagttccaaaactttatcgtcataatataaccgccctcctgtctcggagcaatcaacatttccgtccctatatggcacctcctcatcaatctgccttacaggcgcgattatcggtcttccaacggtctttacgattacgcctatatcattgctgtgtttacccctaaatgttattccatgtctcatttttagccccctacagcggttaccgttttatccagcactttattttgatagagtattccgtccgtgccgtcatttatattactggtaatattctgtgttactgtaatactcggtttgatttccttaatggcagcttctattctgctcgtcatattatccatattggaatttatactctgttccagcggctcaacaaccgaggcaacttttaaatttgcttcctttgtctgctgtaatatatttgccttttcgtcttcaagcgccttatattcagcttccatttgctttattatggcgttgttttcctgctctatctgataacgctgttcgtctcgctctatctctttgagtttgtctaatgcttcctgatatttttgttttccctctattgttacagcattcttatatttctcaatgtctgacagggtttcagccttatcttctgcccggtcttccacttcccatgattcttctagagcactgagcttgtcgtcgagcaagtccttgacctcgtccatacgttccttagccatatccagcatttcgtcgtatctgtcctctgtggctttatataattcaagccgcatttcgtcagcctgacggcgagcatattgctgtttagtcggatccaggctctcatcttgcgaccattgtgtatatttatctattttgcgctggtaaaaatcaagcttattttctccaatttcttcccagccgtatacccccgcttgcttctcagtccagtctgcgtcgtcttcccattcgctcaattcgtctctgaccgcgtcatacattttcttatccagctctgcctctaccttaattctgactaccttttcttcatcggtcagttctccgagccctgcaaaatattcctctacttcttttctctgtctattaaccgccgctatcgtgtcggcagccgacatattgttatactctttttcattatctatccagtcgtccgaataatccaaataaccgtctaaaaattgctctgtgtaatcaagccttgtgtcaaaataatcttcccaggtgattaatccgtcctttgccgcttgaacattacgctggtttaccgtctgccaaacagcgcccatgcttgtacccatttcgccccagtcgtttatactggcgtgtaaatcaatatacgccttagaggcagcatttgcgtcgtcaataagctgctggctgtacttatgtaattttagtgttgcgtctttccattcctgcgtgtcgggtgcgaaattttcatcacggtatacggcgaggttattatagtattcttcctgagatgtccagcccatatcaagagcaaattccattgattccaggttttggctccacatctctcttgtataattaactatttcttcctcaatctcttttataacctcagcgtcagaagcaaatttctgtttcatttggtcgagccattcaagctcttcccatgccggaattatgttgtatgaagttttgcgtatatgttccctgtcagacttagcgttttcccagtcctcgttgttcttgccgctcgcatagcgtggaattcccgcgcccgacattatttgtcttgtttgctttgcagtataaattttatcgtgtaattttaaatctattggaacgtttttgccttcaaaaatatatccaacaccatcgcgtacaacaagttccctagggtctgacactcctttttcatcattgataataccaaatccgggtttggcgtccattgtccctttagctgttattccgtttgctaaagcatttggactaggcaacccccctcttactactgtatttattgttattgttttagatgatggtattgacctaattgccgaagccacttgattcgctactggacttgcgttatcgcttgctgtaattgaagtgtgatgtgactgcggaattccattaacagaaccagttgcattatttgcaggcgcgctcgctccatcacttgctgtaatatttgtattatgtgaatcagggatattgttcactgcctctgttgcattattagccggttcactagctccatcgtttgcaataatttgtactgttccggtcttcccatctatatcagcaattttattgccaacctcatcaaaaatttcatagttaccgtcagcagttacttccacccttgccgcgcgtccgtccaaatctccgaccgcactgtttatttgttcaacagtcggtgtcgctccgtctgctacctctaatctgacctgtcctgtttttccgtctatctcagctattttaatacctgcttgatttaacacgtcatagtttccctctgcattaactgagacagtagcggtcttgccgtcaatttcagaaattttatttccggctttgtccaaaacctcataattctctgttttggtattaagttttatatcaacatgctttccatttatctcttgtaacttaccgtcaacttctgtaatcgttgatatatctccatccacactaatttgtatagattgattatcggataactcgcccatacttctagctaattctgttgatttttcagaaattaaatcaagttttccagcttctgctgcgccttgtatatctttaaaaccattttttatcagggtcgcgccgactgctgtttcttttgcactggctccaaacttttgactattagatatatagtcactaacaacattattaagcgtttcgccgcccttttgccaagctgtatctaaattttctattccattttgagctaaagcggtcttttgcgcatattcactaacgtcaagacctgcactttttacagcggttcctacatcttcaatattttgcgaaacttcctcatagtttccgctttctaaatttgccttgagcatagaaacagaatcatctgcaagttgggtagctgcttcataatatttagacattctgttttgtctgtcggtttcagcttgacctgctatttccgtttctttagtcagcctgtcatattcattgctaagattgtcaacttgacttgtaatatcctttaatttatctgttttcggcgttagtccatgatataggtcggatatgtcaccgcgagaaaacacctcgtcaataccttgtttaagttctccaaatgatttattatattcatcttgacttattgttccactatctaaactatcgtttagcccctgccattcatctctatacttgcgtaaatcattttttgcgtttaaaatatttttttctttttctaaggctcttgtatacccggcttctgtatggtctctgtctgtcacatcatcttgatattgctgagctccatttcctacactatcttttaaatcattaattgcctctttagctttaagtctttcatattctgtaagtttttttgttacttcatcaagttgtccgtcatcaacatttatttttaaattgtactcgtcagctagtatttttttaatttcctgtaatcgtgtttttgctgattcaatttcttctttacttgtatcctctgcatttatttttatttctaactgttcaacttcctttgataattcactaagattcttatatgaattaatagctttttcagcatttgtaactttttcgtctattcctatagtgtaatctcgtgcctcaacaacacgttttctgacgttttctaatcctacatatgttgcagttaagataccaatactccctgctaccgcaagggctacaggtcccataccagctaatgctggtgccgcaacttttattttccccaaagcttcaacaaaatttcctatacctttagttgtcccggctacaacttttgcgcctgctcctagaccaataagcccggtgccgatattaactagattctttttgccctcatcgctcatattagcaatgtcttgtgcaaaatcttttattccgccggatacattcttgattgttggtaaaaatgtttccccgataccgcgtgcggcttcaaccaagttatttttagtaacttgtatttggcttgccgttgtctctgctttagcattaaattccttttggagcgctgttccatcttcccatgcagtgtttgaatgttctaaagctttagtcaacaattttatacccgactctcctgcaagtttctgcaatgcttgaaggtctcttatattattgaatcctaaattgcttaatgtagatatttggtcgtcggttttagataatccttttagaaagtcctggaacgctccgcttgcgtctgtgttccattgttctttgaattcttctgaactctttccgcttagctcggcgaacgtttctaaatcttctccgccctctgacacagactggtgcatttgcatccatatacgggatactgcactgccgcctgacgcggcttctgctcctaatgatgataatgctgtcgaatacgccagcacgtcctgcgccgatataccaacggttgaccctgtagcccccatatacatagccatatcagctatttcagcctcagttgtggcaaagttgttacctaaatcaactattgacgagcctagatttcctacctggtcttgtgaaacaccagccacattcataaatctagcaagagtttttgcgccttgttctcctgccaaattagtcgcagttcccatttgcgccatagtttcggtaaaacctacaatattttccgtctttataccaagctggccgccagcagccgcaagctctgtcaactgtgccgtcgtttgcggtatggcgtttctgccgtctattcctgttgttgataaatctataataccttgttttactttctcaagctgcggctctgttccgtctacggtctttttaacatttgcaaaattatcctcaaaatctatagcaaatttggcggaagctacacccccggcggcaagagcaacacttgctaactgtataggcttagttattgtgttaatgctctgtcctgctttttgccaactttccccaacatcttgtaaatttaaagccttttccatgttagcaatagctttttggttttgggctaaactttcatactgtttgcttgcgtttgaaacagctgactttgcagaattatacgccgcgctttctctgtttaatgcgctttcattgttcaggattgattttgatacttcatcgtgctgtttctgcaatcctttatattcattctgtgtccactgtatagccttaacattatccttatacgcctgactgtttttattcagccctgcattggcagattctaaagcctgaatctcagcttttttggaagtcataagactgcctatagccgatttctgaccgtttagcccttttatattttcgttcagctgtttagtattttgcttatacgctttttccgtttcagccaatatacttcgcttttgctttaggctttcagccgactttgcgactatcttatcatatccgcccatttgccgggtctgctccgcaatgcttttcacgcctttctgtgacatagcattcataccggataattccgactgcacctttgatatagtagaacttaatgacgatgcgtcgcctgtaaattttacagttaattcccctaaatttccgctcatataatcccgcctttctttttctgcaacaaaaaagcgcccctaaagggtgcgctaagttattaaaattcgtaatgcgtccacatgcttataatttttactgttttcgcgtcttcaaccacttcatacacaagtctatgctttatatttattcttcttgaatacgctccgctaagttcgcctttcagcttctcatacggcggcggattctgatatgggttattccttattatatctataagcttctttgcgttgtcagataatccggcttcttttaattttggtatatctttcaaaacctttttagtataaacaatgctatacattaccattccaccttgtcttcaggcacgcactcacttatcgaagtatttagcccatcttttattttatctgcaagtcccggaaccgaagataaatagagagtttccattaaactgttatagtcattttcgctaattattaccgcattgccgttttttgtgttaacattaataacatcattataatttactgcctggtcaatgtattcaaataaattctttcttaaatttgttatatttgtgttcgtcataaaaacacctccaaatatattatatgtacattatactgtacgtatacaaatttgtcaagaaaatattatttcacaaagcaaaaaacactgtttaaaatgctttttgctttgtgcagtccgtgaactgcacaatatttttataacccattcatccagccaagactgggaggtaagtttgtgacagagttttcctcctcgtcttcgtttagagaaattaacatttccattaattttaccggattttgtcttgccagctcgtcgggcagtatcccttttgtcttatacattactgcatatatatctttaagattaaaagtttcgtcactgtccgactttactggttttttatcagttcgtttacttcgcttatagtgttcaaatatatgtcaagtaatttcctgcataacatatctttttccgcaatagacattgtttcaatgtattctttattagccgctgtgcctctgaacatacgtataagaacatcataacacagcttgcaagcgcctgaatatccccttaaatgcttgtcctgcatatctgcgtaatcctcaaagtcaaacggtcttgattgcacttctttgccgttaatctttatagttaatatattttctatgtcttttgccattagattaagccccctgttccggtgctgccgacggataccagttagggtctttgaaccagttttctatagcctgtgcttctgtcacgccgtcaggaagattgtctgtgtcaatatagtaatatcccttaccgtcagaatcacggaacacagctgaaaatgtggctttggcggtctgatgttcaggcgcgccctcagaagctttggttttgcctccaatatttgaggcaaatccatatttgcccttatagtatctaaccaaacgttttacaccgttagatttttcaattatccacgctactgcaaaatattcagcctttgccgctgtgtctttgttgaactcaacgccgttgtctacaagctccgcacctctccacatagcgtcaacctcgggcggtatatctgcattggtgatttcatgacccattttttcaacatacgaatccacctcatatgctccgttgtccgcgtcaaatgttgaggtagaccctgaatctgtaggagcgatttcaaccgttccgggcaaggtcaccgcctcgccgtatgtagtcttccctgtcgctatatcatcagccgttatggggaaaaaggtataatttgatacaccaattttcgaatgtggtttctttatttcttttactgccataattaatgacctcctaaaattaatttattgctttttgtacttcgtttgttaatatttcaaccgcttcatctttcccggcttcaaaccccggttccatgtacggctgtggtctctgacccctggtcgtgtgccattgtcctttgctgtcctgatacctccacggcgtttgacgtcctccggcgtaaatacctgtacccatttcaacgtatataccataatcagccgtgggtcctatctcagatgtatattttcctccaccgcctgttgtttcttctacaatgctgtttctcagttctcctgtatcaacaggacactcagctttacactgggcttgtatagctttgccgccctttgccaccccgttttgtacagcgccgtcaagtttagatgatatattttctaagttgtccaatatattatcaagcccatcaatttcaatattgattcccattgtcacccctcattttaaaaaaatacctcttttttatatctctgcgacaaatgatataattcatcagggctttgccggggcacatcgcaatcgtatgtccttgtccagccgtccgactgcattatctcattgacttttactcctatattggataactgcacgggcgaattactccaaatatccacagcaaacttgcttacttgtgactgctcggcgttatcggcgtgaaagccctcgtcagttgtcacttttctaaacgtaataacaggcacggcgttaaaatgaaactccgtgccatatttaaccgttattcctgtactttcgagcagttttttcacccgtggaattaaatcaatcaataaaacccacccccgtatatatcacttgcgccgttctctcccgtgttaacgttcacgctctcatcttttacggctgttggcagcttgtttaaaagagccattgtgtaatcgtcccaatgttcggaatactttactgtatagcttatattttcacctttcaaagcgacccttgcgccttcttcaagaaatgtacaaggctcgcagtaaatacgctttacagtctcaatttcaagtccgtattcttcctgtgctagacctccgctgtatggttgaatatctgctgttatttcagctttaagttcagcgccgctgtatacctcaatcgtttttttcaggttcatcaaaatcactcggaaccctccctttacgattaataaacggctttaatctctcgcggtaattattgagaaaatgactgtcgttagccgtactgtcctcatagcttttgcttacagagccctgtgtttccgacttcacaaccttgtctgctttttcctgcccatagcttgcgcgcctatatcggtcggcggtcataaccggcaaaaggctttcaagctcttgcggaaaatctgatattctgcaatagtttaaaatcagatttatgttatcctcaattaaaaaggacagcaggttatccctgcagtccccctctatccctagaagcatttttgcggtttctagcgcgttcgctttgtttaacattggttctcacctccgccttcggcttatcgtcagatacggcttttcttgctttcctgtgtctgcttaataacattcccatagggtattactcctttgcgctaatcttgatggccttggcgtcgtccgcgatgtgcgttgtatagtgcttgtcggctgtgataaccgtggttttattaacaatatctctgtcattttcaatctcggtatcgcgctttaggtaaatcgcaagcgcaccgggcttaacgatatagttcgtataagcgccgttctccgccttaatcttgttggaaagcacaacttgacagccgtgtatcatgccgaccgtgcccttaattataatatccgcgccgatgtcggtcgctttaatccagtcctcggattttctaagctccgccagctgtgccggagcgataagcagaaccttttcaccgtctatgtcctctccgaatttaacgagtgcgtccgctataaagtttgaagtcagcgttgccgtgccatctccgactgtcatagcggatatgatattatcaagcacagcaagcacatcattgtcaagcttgtttgctattgacaacccaagctgatttaccgcctcgcccatagggtcgccatagccgcttagaacggactcgtccgtaagctcaacgcccttgcctgcctttttaacgcttaccttggtggtcgatgtcgccattttctcaatcggaatagcctcgccctcgcccacgtcctccgcgtcacctatgtacgcatactttggaagcgtgacggtatcgcccggctttccctgcaatgttctgtcaatggtcgcaagcggggcaaacttcatagctgcctcaagctttgccgataccataggcgccataacctcgggatttaccatgttttcaagcttcgttgttcctgttgccattattgattacctcctgttaatttttcataagtttctttgtcctcgttatacagcttgacgcgctctgcataactcattttgttaaaagcctcttgcgttattgcagcggctttgtctgtccccgcctttgggacagttcctttcagcttatcgacaaccgcagcttgcacctcttcgttaaacgccttttcaaacgcgtctatattcgcctttgtggtttcggcgttgtcctgcgccaaaaatgaagcgaattgaggcgaaagccctttgtccataagtgatttacccgtttcaaattcaagcttttcacgctcatatttcgcgcgttctttctcgaatttctcctgctccttttgccgctcggcttccgctcgttcgtccgcgttcagcttggcaaggcgttcgctttcgcttattgcttccgacaaccttgtttcaagctctgcgtcccacttcttgcgcgccgcctttaacgcttcatcaattttggattgaacgtcatcagtgccgccagtgttgacagccgtccctgcggccggttctttaggttcggtcggcgttgccaggtctgcaacattttgccctgtttggggcgttgccatagcgccgcctgtctgttttgtattttctgccatttaaaatcctcctttcaattttgggtataaaaaaagagcgtctccgctcatcatctttatttattttaattaatttgttgggtctcttgacctcatgtcatcacctcatttttggtataataaaagcgccccaaaggacgcttttaagttaagctactctcaaataagctcaaataaactaaacattgagagttgtttgataatatatctcatcatataaccattgaagctcacaacccaaatcagtcaaataatcctgattgaccataccatatactattatagcttcatcagccgccgactgaaattctcctatatcattactgttaatctttatattaaatttctcatcatcaaattctaagtttccgccttcataacattctataacatacttttttattaagtcatattgttttttattaaatttatataacatgctaatttcaccttatttcgctatgtggatttgtttgtataagatttcccgttctttggtttattgaaacctcacatttatcagaaacatacttggtactacatttctttttccttacccttccatgtagcaatgcctcttttatatccttaatttcaacgccgtttctagttctgcctgttattgggtctttattggttccaaacactcgttcaataaaatgcttgctttgtgattttattttaattccgtcaactgttgtaagtcctatcaattcgtcggatattatctgcttatactttttataatcttcaaacgatgtaaatgctgaaatcatatttgtgcttctcgacttataatagtctttcaacgattcccataacttattatcattatacttcaaatcctgaaacaatgcaaacgttttcggcacattcttctttcccaacacttcaacatactttgcatactgctttttatcacctgacaggtttttatactgtctcacgtgcaggtcaaacgctaacctttgctcaggattaaggctctcaatccattcattgtaactcataccctttattttatagcccttgcctgtcagagggtcgcgcgcccagcgtcttgcatagtctgtcggcattgttgttgtacatctgcaatgcgggtgcataggcggataatttacgccacctaccgcctcactgactttaaatatcttattatcaagcggcgaacagctttcacacgtcctctcatcaagcgttgcaagatatttgtattgttctattcctaattcttcataagccctcaattcagccatgttcatgaaataactgacctgcgtattaaccagcctctgcgcgttatactttgatgtttccattatctcagcaagccgggcagccatttgcgtatatcccgcatggctcattatcccttctgtaattatcttctgcgactgttcagcgacctttgccgtgttattccacactctatcgctaaattgttcgccatgccacttactcccaagcatttcattaactgcgcgcttaggtataagagaaaagtatacacctacattacagccttttgctatgtcgtgaacggttctgtaatagctttcttctataaccgtattgtataaagtcttagttttctctatctccgttagtgccttttctttgaaataagcatatacattaagcttaaccgcttctaaacggctaattcttgccccgtatgcctgcgcgtgtatcttgcgcataagttcaagccgctgttttggatcttccgtgtcttttaatatttcagacagcctatctgctatttggttctgcgccgctttattaataagctgttcggcttcctcggctgtgatttgtacaccatttttgtatgtgttgaatatcttttttatttctttgtcgatatcttttatgatactgtcatacatacgcctaagctcttgtattgtgtatgctccgcggttgtgtgcatcaagttcgcgcattagcgcaactctcagccaataatcagcacttctcatcagttaaatcttcaagcgctgtataatccgcgcccgtgctctttctgtaaagttcctcgcgctttatctcgcgctctacgcggctttcctcctgcttttccacaagctccatttcttccgctgaatcggacacaaaatcaagctgctcaagcagtgtttcatcagatacaagaccgcgcagataattaatcgtctgtgccagctccaaattattctcaggaagatttcgattgaagacaaagtcaacatctcccgaacttactacactcatacggcttagtaaagataaatagtggacatataggtcaaatctttctttaagtccaagaactaaaaaccgttccttattcttaacatgctgttcaaaccccaaaagcttgtatcttatagcaacgccggaaaggttattgccgaaattcacgtctgtgaggtcgggcgttaatgaaaatttatgtaaatcgtccttgatgttattcctcagtatctctacatcagtctcgtttagaaccttttgtaaatattttgcttccgcgtccggcgtgaaagacatcattattttttcagtcaataattctttggctttttcgctgtcaacctctacgtttttaaggaacaatatagcgtctacaaactgctccttatcattaacgcggtcactcatcaacgtgttgtatgcgtctataagaccgataagctgttcaaaatcgccctgcttgtcttcattgttgatatactcaatcatcggcaccctgccaaatgaatgcgccgtcctctctatttcttcataaacgctccctccccctgtgcttcggtattttataacctcgttttctgtataaacattagcgactttacccacttccagaccgtctatatctgttatcgtgtagtaatgcacaccgaacagttttctttgctctacagtatcatcataaacaataaacgcctgccgcggttcaagcacagcagacttcggtttggaatcttcgttcgcataaaccaactcatatgaatgtccgtaaatagacatatcccgtacaatccggctgtctgtattttgtatctcgctttcaaaatatgcgttctttaacggttcgatatcaataccgtctgccgcactgtacgcaataggcgcgccgagcaaataaccttgtgtcatatcaactatgtacttcgcatggttacataccgttttgttgttcggcaagcctttgcctttaggtcttcgataaagcacatcatgttttcccaaataataatctttaagcttgataagccgtgccgtatcttcagcacgtttattaatcagctttcccaatattcttccgtcaacctcttttaccgtctcagcgtcaactatcatatacccagctccttcctgcttcttatctcaatacctctgttactcatatcatcttccagcgcatacctaactgcgtcaattgtgtggttatccttgtcagggtaagaagctttaaactcacctctgctgtcacgttcaagctcgtagttataaaactcgttggcagcatgcggacaccgcacagggtcgataattattacttcaagcgactgcaggaacttaataccatactcaatactatcgggccctttctttgctccgcgtactttaaggccatatcctcttaactccgctatgcttttaggttccgcgctgtcgcagacaatgtaaccgtcatacacctcgcacccttggatcaactccgccgccgcacgatttgacaagccgactttgtatatttcatccatgaggtacagccgcttccgtgtcttgtcatagtggcagacgagatacgcaaacgggtcaaccgcatacccaaagtcaattccccgcctgatccggtcaaaaaccgcaatctcttcttcgcttatctcgcgaacatcaaggtttgtaaacacctcgccgcccgttccggtaacctctcccaaatactcgtggttataattactcggtttcgtcttctttaaatgctccgcctccaaaataaactgttcgccgagccactgaggaggaacgcttaaatatgtgctgtggtgtatcactctgtcgcttcgcgttgtcaatacctcttcatttacccaattccgttgactttgcggagggttgtaagagtaaaatacattatacatttcacctccgcgcataagtgactgattaatcgtacgtatctcttccatgcctccaaattcgtccacttcctcataccaaatataacgaatatatcctctgtgcaccttggtagatttcagtttcttgggcttatctgctcccctgaataatatccgctgccctgtcggaagatatatcagttcaagcggcgacagcttgaattgccaaaggtgtgatactccgagtttttctatcgcccacacaagctgttcatatacactgtctttaagataaagtcccaccttgcgaactacaacggcattagcactcggattactcattataccaagcacaatttccacgctgataaaagaagattttgtgcttcctctgccgccctttagccagtagtgtgtatgcccgcctcgcttaatatcatggtgaagagcataaaaagaaggcgcgataaggtctgtcaaactaaccactatcatcaccctttggaatattgtctaaaatctgaacctgcgctattccatcaacctgcgttcgttctgtaaacagtgtgtaatacttaccaagcaactctgccgcttttaaacgttctttttcatcaggagatttttcaatgtgcttcgtcttcgaaaagccatctccccgtccctcaacaacaagcacctccgctttacttttaccccgcattactgacgtgagatactctacaacctcctgcgcatctgctgtcttttcgttgtgcagcttctcaatttgctcactaatatatgctttaatcttagtatttcttagcagtttagaagcatttacagccgccgaatcattattttttacattgggataagcgttcttatatgctcgagtcccattcaaatctatcaaatattcatcacagaaacgtttctgtttttcagtcaaatatctcacctccaaatcacatcacagccgcccgcccctcagcaaatttatgatgtacaattcccacaagacctaaaactaaaagaaccgccccaaaaaggaaaacggctcttaaacaaaaaatatataaaaggagaaattactttgcatacctttcataatacaattataacatgtgattttcgtatttttcgtacttttttaaaaaattattatgtttttttctcggaacctgttcatcaccattgcctactttaaaagcaatcttttggaatgtccacccctcaatatatctgtatctgaaaattcgccttgtttcgctgtcagcaatgttgttaataaattcattcaatgcgtgatattcggcttttaataaccccaactctttttttaacatatcacgtgtgtggtcgcactctcctgtttccactttcatgttatgttttatgtacgggaattccctgtctgacccctgcacaatgtcagaactttcaagcatttgtatctgttcggccaattcttcaatttctgcttttatacttttgtactgccttaatctttcagctgtcataagatttatcacatccagtttgataataattctttgtctgttaaattacttttttatccatatagtttcagtccttttccatagcgcacaaaaacgcaatattgcaagccaaatgccacaaatgcggcagtccgctttcttcatctgcacccaaagggtcatttatgtatgacacaaagtgtctgaaagccgcgtctctgtacctttgcggttcaacatctttccagctgtcactatctccatacttttttgctccatactctcttaccatggcaaccgctgtaattatttctgtcgggcacaaggtaagtttcggctttccttcgtcatatttcatcttgtccctccttgttataaatttatttctcaataagttctacatcacttagttgcacatgaataacacaatttgcgttttcgtcatatagttctccgtcatattcgattctatcttcatgaatatttttaaaacatctactagcataaaagacatagtttttatttttataacgaactatactttgttgcataattgcttgtttaacttgttttaactccatcttacaaatcctctatcctgatatatattccgggcttttcagcccaaaatttttccacaatttcacttgccaccaaattatcatctgcccaataccccaactttgtcattacatccttgagtaacttctgtaaattgtccgtatccggcttagttattttatactcaccgtctctgtgattttttctcgggaaacaccattttacaataagccgaactccaccaatatatttttttactggaacaaatctagctaaatgtgacataagttttaagcgggcgtcttttaaattagacggctcataaaaaaccggtttaccttttatcacactgactttcttttcttgatgagtaacagttggtggaataattgcaacaaaaaattcagttgtcataatcaacaccactccaacatcctgattcagcgtcatattttatcgcttcggaattttttatattgttccagatataatttaaaatttcaggttgcattataagccatttaataacttcactattttgtattttaaattctttgcccggaattgaatgtctcagttcaggcattcgtttaactgcatctaacaatttgcttctttgtgttctcatattttttgttcacccctcagtttttgttttactcttgaaaaaattttttgtcagtgacagggggaggcgttgttgtgcgtgagcttcgcacaacgacttaccccactgacccgtgagggaaagggaaaattatatatttatatatataaatttccttcccgatttcccgattgcgctctaacccacatttttacgcggttttcaagacttgagggaaaaagggaaatttccttgttttttcccaatttcccttgagggaaaaagggaaatttccctttttttcccgatttccctctcgagatttaaattatttttcatatataaatccgtttttaatatacagattagagcttgaattaacataatttcttatggttttttctgatttttccatatattccgcaatcattttgagtgtcacatcaccatcaattttacaaacttcatatgccgtttcaattgtttttttattttctctttgtttaacattctttttatttgatttagatttccaagaatgagtatcagattcagctgataaatccttaagaatatttgtatcatctattctgtgaatagggtaatcgaaccataaattaattggttcaaatttaggaaattctcttaacgttccatctatacgccatgctgtacggcttttattttcatctttaaccttcttaatatcttcaatcatcagtttatatgtattactctgtaacaattctgctgaaagttctaacatagtcctagcgctgcataaatcatcctgagaaacctcgttatctttactaaaacgttttatccatttgtagcatgttttacacactaaaacatcttcctgttgttttaaaacatcttctgttaattctaattctatcaaatcaataagagcgtcagggtcacgagcaaaaactccgctgccggatgccctatccatacttcttttgccgccttgtgctccctttgaatgatgatggcaatatattaccgcacagcccaattcggtacagaccttgtcaaactgattacaaaactttgccatttggtccgcgctgttttcatctcctgtaataactttatatattgggtcaataattattgctatatagtcttttttcacggctcttcgaattagtttaggcgccagcttgtccattggcgctgattttcctcttaagttccatatatcaatattattaatgttatcaggattccagtttaaagcagtataaacatctttaaatctatgaaaacagcttgccctgtccaattctaaattaacatataaaactctgcctttagtacaattccatttcagccatttcttgccttcagctatagcacagcacatttcaatcagagcatatgattttccggcttttgaaggtccagctataagcattttatgaccttgtcttaatactccatcaataagagatggtgacaattcgggtagattatcccaaatacttgcaatgctttcaggttccggcaaatcatcattaattgtttcaatccattctttccattcttcgaaactggattttccaatgtttgtagataataaatattgttttttcccatttcttataattcctggcattctagataagcgtgatggatttttattttgtttatctataattaaaccattcttttcacaaaccttatatagatattcaactctttctctatattcactataattatatgcctcaattttcactatagcgtggagacttttccctgcactgtacacaagacatgcaacaggtaattccagttcctcaataatagctttttgacgccctaaatccattacatctgattcaaccaaagcatatctaaaatccgtaacgttttcattttttatacctttaccatcaagagggttaaaacgtatccaagctcctgccttttcactataatcaccaataaccttacatatatctccttcacactttgaaagctcctgaattaaccttccggccgtcctgtcacacaagcctttagacgggaggtactttccgtttttctcccagctccgagtgacatatccaacgttttcatttgcttcaaacagtgtttctaaatatgtagttaattgttcaacaggattccatttttgtggtatgctaaattcacttgtttcaatccaccctttatcgattacaactaaatcatctttattgcctatctcagaattccaatcaaaagcaacatcttctttatgaaatttaaaaccattatcctgtgccattttcactatggttcctgctgttataggagaacttgaaccggaaaaagtattccactttttctcacattccccagcatgataacggttagcgtcacgtttgctccaatcatcccaatcctgtactgtatatccttcatatttaagtgccattccaacattaacccaatcctgataatcaagaaatgatggttctatatattcaagcagttcaaccaaattaatgttattttccatatcctatgctcctaattcgggattaaatgtagcggggttaataccatttggaactctccacccattagcagatattctcgtaatcaatttgcttgcagcttcaaactgccatgttccaacatgtttaaatcctttttgctctaagcatctaatttgttttggcgttgtcagtccttcatttttacgtttctcaagtctgtctaaaattttcgcagctttaccggagttttcaatttcatcaggcataatacccagcttttcgagtgcgtttttctgcttgtccgttggcggtgacatttcccagccaaatgccggaacataccctgataaatcttctgcttgtatactcatttcaaattgtatagggtccactaatttgcgtttcctctttttcatttccgacaactgtttagcaagagcttcttcacgctgcacaacaacatcttcactggcttgaacttctgcttcttctatatcaatcggacagcctgaagcttcaagattttcagtcattttttgagcaacttcttcattttcgcatattagatgagccggtctacaaagttcatgtcgttcagtgtgccaaagaaaatcaagtattaacaattcagttttaccggtttcaggtgataaacgtgttcccctgcctaccatttggcaatataaactacgtaccttagttggccttaatacaacaacacaatctacactgggacagtcccagccttctgtaagcaacatggaattgcaaataacattatatttgcctgaattaaaatcgtttaaaatctctgacctattatcactatttccatttatttctgcagccttaaaaccattttcattcaaaatattgcaaaacttttgactggtttttactagcggcaaaaaaactactgtctttcgcccatcacaatattttttcatttcatccgcaatctgatatagatatggttcaagagctgtacctaaatcactcgttttaaagtctccagcctgtgttcccacttctgttaaatcaagttttaaaggaattgtttgagccttaattggtgataaaaatccttctttaattgctgatgataatgaatattcatatgccatgctctcaaaaaccttaccaagatttttcatatcacctctgtcaggcgtagctgttactcccaataattttgattcactgaaataatctattactttttgataactgtctgatatacaatgatgtgcctcatcaataattatagtatcaaaatagtctgtatcaaattggttaagacgtttctgacgcatcattgtttgaacggaaccaacaactatacgataccagctgcctatacaactttcttctgccttttcgaccgcacatcttaacccggttacttttttaattttatccactgcttgttctaatagttcggctcgatgagcgagtataagtactcgctcgccattctttacacatctttcagttatctttgcaaatacaatagttttaccggtgcctgtaggtaatactagcaaagttcttttattccctttttcccattcggcaaatactgccttttcagcttcttgttgatatggtcttaattccattagaatttacctggtgtgaatgatttttttggtgcagattcatcgggagcgtaaaacctttttatatcattataaatatttccattatattcacgatgtccaatttttgctcttcctcttgctccgacaacttcattccaattcattttcaatttttcaccatgctttctctgaccaatacaagtaaaaaatgcacacaacaacccctcacaacgactatgtaaaaataatctgttttgtataaaacaaattcctttgtcattctctatttctaaagtgataattgccatattacaagccggaattttctctccgccttcatatctgccgcgttcaaaacctgttactttaaaattatagtctccatccggcaaaacgacatattccggtccatcattttgtatttcatcatcccagccatattctctttctgattcattactcatttttatttcctccaaattttattatttatttttcttcccaaggaagtgtctcatattcaactattactttatatacatcatcccaggcgcctatcagaaccccttctataaactcagtatcaaaattttcaattggtgtacccgatggataataacctttttgatgcacaacattttgaatcatttctttagtaacattgttttcaatcattaatttagctaattctttagggattccgtcaacattaattttcttcatttgttgtttatttgttttagtttcttcatcttgtttcggaattttatcaataacagcatcaatttctctttctatttgttctgtctgattaagtttaacaggtgtttggctctgtggttcaaagttatcaaatatatttgcaacatatttataatcaaatggcagctcgctttctaatccatgcctgtttttcgcatcccagcatggatgatgagttgtatacattacacgctttccaccttgagctttatgtttttttccatctttatcaacagctacagaaattgttttataatttgcaaatagaaccatatcagcccattccttcacaagaggtgctgtttgtgaagaagttttctttccgagtttcagttcgtatctgtcatatgcaccaagttcatcaggctgctcaaatttacgtatttgtgcatgtgcagctaaagcaacatttattcctgcctcaataacattatccagcaactttaaaaatcttccaaattcttcttttacatatacatatccggtaccatatccaaaatcctcaattccatttttaccgtacttttcaagtatgttttctgtacaaagctgttcagcccaatcaattgtatctattgtaagtgttttacagcagccaggattttgaataacgtaattaatttcttctaacaattccatccaactttgcgggtttggcaatctagatacattcatatgttttgtgcttccttctgtatcaataaacaacggctccggaaaacaagataaaaaagttgatttacctatcccttccggtccataaactacaaccttttcaggcgttttttgtatacctttaattatcttcatgaatacctcctgcttctacttaatttgaatattttgattttcttcaatatgtaaaccttcaagtaatacacctgatttaatagcttttttggcctccactttgtcaaccgccggttctgtatattttaaatactgcttgtctactttgttaatatcatcaataacaactgattcactcttacgatatgtaatattaacctttggtgattcaaacttttcacccgcaagaaattcattcaaaaatttcttaatactctccgctttatttttggccaccctttcacgctttgcaaaataatctttttcggatttatacgcattaacctcagccatcaaatttttataatagagagccaaattttttattttatcatctctcatcatctgcagcttatcagctctttctgtatcaatcccaataacctcgcctgtttcttcatcaattaagatacattgttcaatttctgcgtcaatttcatataatttcatgctaaatttctccttctctcagcttgacaattcttttattatatgttatattgatatagatttcttgttatatatattttttggtccggtttgtggttccgcacagctggactttacttttatatcctccagcctaaattctctgtactgttcattgatgtccttgtccatatatgccatagccgcaaaattgcagtccataacaagcctgtcaaactttgaatttccacatataactattggttttataataatcacctcacattacaattttatgtattcttttgctactgttatttttataatccctgctgcactccgcgtccgaaaagtcccaccgccgattatccggcttgattacgaccttacgcacatcgtcagctatgggttgttcttcagctgtgtcctctgcgcaattaaaaaatgccaaaagtatcatcataagcggagctgcgtaaaatatgggataccactcaagcgacctaaccataactaacaatacaacgccaaccaccgctcccgatattcgtataatccagttatacaattgatctcacctccttatatactcccagtatttcaaaactggcagaaccatacatttcattaaattgctgttttgccagctttgccgatacagattttacagttatatatttagttgcaggcgccccggtctttagcctatatttaatcaaaaaattatacatcctcaatcacctctttctatatcaggtcaaatttaatttttttaactaccatttaacatttaatagttagtttttttattcactcaagttttttgcaaacgtctcagccgaaatatattttttaccacccaaaaatgtgcgttttgcaaaatcataacaagtccctgtatagtcctgaacatccttaatacacaaaagatgtgatgtcaggaactacagaattgttgccggaaagctcagcaggctcaaacggaaacttgacactaaaagtgccgtatgaaaccgaggcggcagtaacaaatccttcaaaagtatcagtagtgtatataaatgacgccggagaaaaatcaggagtagcgtcggcatatgacacagcaggcaaaaaggtaataacaaagttaaagcatttgagcacatatgcaataactgacagtttgggatatgagttggttacagaattagtaacgccgtcaaacgagaactttaaccccggtgacgagatagcggtagcggtaaaagttaagtccagtgaaccgactaatttcggaagctttaatatagctcttgactatgacagcacaaaaatgacattgacatcagtagaagcgtcagacgctataaaaacaaacggatataatttggtgcagggagaaggagcggagcaaaataagattgcgtatacgtcaggaagcagctcggttgatgtatcaagcgaagctgtaactataatgacagtaaagtatacagtaaatagaggaatagaaacagcggctaatgtatcagtaggaacgaaggacggatattttgcaccaacaggagctgatactgatatagcagcagtatcaacagctgaaaccgttaatctgtataacctaaaagtaacactctcaagcggagatggaaacactgtttcaggttcaccggcagcatattatacaaagtataatacagcaggactatacacagacgacagttatactacggcagtgacagatacgcaaataaagggactggtaactgcaaacgagaactaccgtttggcaaaagatacaacagaggaaccgctgtggaaaacaagcggaggaacagggtatacaagcacagatttgacaacaggaacatatacggaagatacaagtctgacagctcaggcagtgcgccaatacaagataacatttgagccgggaacacacggaagttttgcagcgggagcagtgacagagatagcaaaggatgtaaactcaaaattgctgcagtcagacctgccgacaatagaagcagaagcaggatataatccggatggctggatgagcggagatgtaaagatagacctgagtacatatgaagtgacaggagacgcaacattgacagcggcatatacagaagcccagtatagcgtaacatttaatactgtgacaaatggagcgtatacaggagagacaggagtaacagacggaaaagcgacatatggaacagatataacgttcagtgtagagccggcaaacagcggtgatatagtaggatatgtatattacacagtaaacggaggaaacaaaggatacttaacaggaagcaacggagtatatacaatcccatatcagatgtttggagagaatatccagatatatgcaggagtaataacaggaacggtaaagattgtagcgcacgacagttacaatgcggcgccgagcggaaaagatttggtagtagtaacgacagcaaagaatgaaaatgccaaatatgtattgcagtcagccggaacagcagcaatagaaatgtattactcagaaggcctgggaggatatgcggcatttgtatcgaacaacggaacaacaattacggagcaggaagttaaggacagactgtcagtaatggagggagagacagccaatacagtgatagcgcatacggcggacataaacggagacggatatgtaagatcagtagacgcgatgatagtaaacgacctgtattacaacaaccgaatcggagacacatcagacgaaatgagaataaaagcaaactactataacagtgacgacgcggtagacacaagtgatatagctgcagttctttatactgttgtaggacgttcttttactaaataagactggaggattagattgaaaaaatatatttcgctatttataatatgttgtatgtttttatctttaatgccgggaacagcagtatttgcggctgctgattttgattttattttaaaatcaggcggtcaaagcacggtaactattggtgttggggatgaaattacagttgaatttgaattggtaaaaaatgatggagcttcatattcaatgtattcaatgcagaatgaaatattgtatgatactgaatattttgattatgtgcaaggcagtataaatgttgaaaacggatttaagtatggatttagaaaacttgagtcttcaagcggagcaaaaattttaattggttttgttgattcgagtgaaaacggaaccgaacgcagcggcagaacattagtcggcagttttaaactaaaggcaaaaaagacaggaaacagcagtataaaaaatgattctgcttatgtgacaaaaagcgatttaagcagatattcatcatcatattcagatattgacgcggaaatagtagaaggttcaatatccactccaacacctgttccgtcattgcagccgacttcgggacctactgctaagccaaagccaacctcaaagcctgatacaaacggaaacggtggaaatggaggcggcggtggcggcaatgatacaaataccgccacaccaaagccaactgctgctccttcagcttcagaaggaccgacatctgaaccaataataacaccggttccaacaagtggaatttctgttcaggtctttgatgatgttgaaactggttattgggcatatgatgatattatggagctttattatgcaggtatagttaacggagacagtcctaatacatttttgccggaaaataatattactagagcagagtttacgaaattagttgcattgctttttgagtttgaggtagatgaaaccgcagagacaaactttgtggatgttcctgcaggtgaatggtatactccatatattgcagctgcatacaatgaaggtattgtgacaggatattctgaaactaattttgagcctgataaaaatgtatcaagacaagaaatgtgtgcaataattggcagaaaacttaatattgtatcagataaagaaactgtatttactgattctgatgaaatagaggattatgctaaaccttatgtgcaatctatgacggaagcgggatttataaagggatatgacgacaacacgttcagaccgtttgaaaatgctacaagagcagaatcggcagctgtcattaaccgagtaaaaaaatctaaatagacgaacaaacatgaaatgcgtttcatgtttagttgggcaacagagctattttgaagctctgttgcctttttagttataagctgaagattaaaatctgttattttaataaattataaaaatataatgtgtataatgtgtataattgacaaaatataactaataaataacaaaataaatgtagcaatcataagaaatgtgtgctaaactaagtttagttgttagtatttactgtaatgttgtgaaatatataaaaatataaaataaatttattattaggaggtacattatgttatcaaaggcagacagggcaggtaaatttttaacgcgtatttttctttgtgcggcaattattcttggaactatggttcagttcgtttcggcggcaacccaggatttgagctatccggctcaattggtgaaaatttcagtctatggcggtgaacgaaatttaaatatttccgggtatggtgaaggttctgctcttaatacatggaattcaaacggttcaacaaacgagcagtggagaattgattatgtaagcagcggagtttttaaaattgttaacgtaactacagacaagctggtatcagctgaaaataattctgctgtaagcaacgcaaaatgtgtacttcttaatgataacggaagttcttctcaaatgtggaatattgttggtgttcagcaagattttttgggaaacgatttatattacaaaatttctaactatgcaaatccagaccttgttataagttataatacaactacaaatgctattaccttaaaaacttatacaggcgccaacaatcaaaaatggaagttaaactgtgatggtttagacggttttgccggtaattgtcttgttcaggaaggtgaaaaagctggtaccattggaggtttattaggcgaaacagtatatgtgtcaaatttatctcaacttaaaagtgcattgctcagcacgaaaccgcttacaattgttataactgcaaatattgacaactgcaacagtgaaatgtatgatttaaggatagaagataataagacgattattggttcttatggtgcaaataggcttactgacccccgtctgcgcacggacgactattttaaagaggaggcggtaagcaataacattgttatcaaaaatattaatttcaatattgctgaaagagaagatgtagttgcttttgcagtatatggttcaagaaatatttggattgaccattgttcatttaattgctcattagatttatattatgatgaagtaggtaagtttatttgggtaaacagatgcgaatatgcaagtttagatcctgattttgtaaccatatcttataatgaatttaatcatagattttggggtatagcttttggagctaaatatactgcagaagatagggcgagcgctatgtataacaaatttacttctgttgttcaccgcgcaccgcagcttggaaacggaactcttcatgtattaaacaactcatattatagaaatgattctaccctttataatgacggatacgcttccataaaatgcggagctggttcggcagtatattctgattcgaacagatttgtcggatataggaaagaatcaagcggctattgggatatggaagttacagtagattcttcagccagtttcatagaccatggttcatatacaaacaagggtgaaacacctgtgtctgtaccttataagctagcagcaccgactgatggaagcgttacaacatggagcccgtctgaaaattatggttatagtattgtaaaagcctatggaaataatgatattacagtattctgtgataattattccggagcagtaaagaacttttctgaactgcattatataaatcatgaggcttgttcaaattacattgattcaactgtaatttcgcctgttaattttgcctttagtgacccggataatgacggtgatgatactgtagataccggaatcgttgacggcggaaaatatatgataaaaaatgttaacagtggtctgtatcttgatgtagctggcggtgctgcgtcaaatgggacaaatgtacagcagtggggggctagctcatccgcttcttacaatacgtggaaagctgttttggtaggaaatggatattatcagctttattctcaggttggtgatggaaacacatatttattagatgttgcagacgggaatacatcaagcggaaccaatataaggatttggcaaaatactttttgtgacgcacaggtatttaaactggagaagcagagtgacggaagctatgctattttaactaaaatcactaataaccaatcaggtttggatgtggaatcagggtcaaaatccagtggtgcaaatgtacagcaatgggggtacgctggaggtgcacatcaaaaatggatttttgaaaaggtgaactaaaatcactaaataaatattggtaaaataactaaacattggaacttttttctaaaacattcgtcttattaagtataagtgattattttttgcttatataaaatgtactgaaaggcggagttattatgaagtgtaagaaattagtttcaatgtttttagttgtctttatgttagtttcaattgctttaattcaaacaattaatgtatcggcggatagttccgggactatttatgtttcctcttatcctgatttagtgaacatgatgaagaatcctggcggaagttatattcttttaaaggatatagagataaataacgctgataattttagtgttcaaaattttagcggcatttttgacggcaatggtcatagtataagtttctcaaattcaagggcaggcggttttgttgaagttcttgaaaaaggagcaacgataaaaaatctccatgtttatatttcagcggcaaccggtactgataacgtaggtattattgccggaacttcatatggaacgatggcaaactgctgggtttcagggtatgtcagcgcatctggtgttaattgcggaggtcttgttggtaagctttcgggtggttcggtgagcgattgttattcgttggcaacggtaagcggaaccagtatttatggaggactaatcggagcagctgaaaatgcaagtgtggaaagatgttatgtttcagcttcaatagagggggcaagagctgaggcggggtcttttttgggaagcaacagttcatcatcagtaaataactgttattataattctagtaaaaacggagcgtttttaggggtaggaattggttcggacactgtcactgcaaagactagtgaagaaatgaaatcagcggagacttttgccggatttgacttttctaatacgtgggtacatattgatggtgaatttcctaaacttgtctgctataacggaaagggaacttcagataatccatataaaattcacactaatgacgagttaatatcaataattcagccatatctaggagatgcaggcacaggcagatattatcagctggctgcaaacttaaaaaattattcaggtccatcactgggagatgatagtagcagatttaccggtttttttgatggaaatggttatgtattttataacaccaatatatcaagcggaggaattttttattcagttgctgaaaatgccgttgtaaaaaacgttgtttttgatggatacaatttttccggcggaggtgtagctggcgctgtcgcttcaataaatcacggaacaatagataattgtcatgttggaaatggtacaatttcaggttcaaaagatttaggtggaatcgttggagagagtattaatggcactgtcactaattgttcttttacaggcgatattaatggtcgtggttccggcataggcggtattgtgggatataacagttacggcacaatattgaattgtgcggtctattcgggaactattagaagctccgatcatagtgttggaggtgttgttggggataactccaatggattagcagaaaattgtttttcacttgcaagtgtgaacacaagtaccagcgaaagcggaggagtcgcaggaagactgtataatggagttatacgtaatagttattctaatgctggagtttatggaaacgactcaaatagtatcggaggtattgttggcagtataatcgaagacggagttgttgaaaactgtctttacaataaagaacttgtttctgttttaataggtggaacagaggataaaactggaggtatatcagcagatgaactcaaaaatgcttattactattcgggatttgattttacttcggtttggactgtagatgaaagcggagagtgtattgtattgtcttcgatttcaggaaagggcacaaaagaaaatccgtatttgattagaacatcttcagattggatcagagttggaattgggataaaaaacagcggagaaagaaattattataaaataatgaatgatttattctctgtaagggccttaggtcaattttgcggaagtttggatggcggaggtcatgaggtaggacaacataacggaaatttgattaccacattaaatccgggtggatatattggcaatttaacggtttcaggaataattgttgagaccgttgacaaagcaacaatagagcattgtacagtatataattcaaatgttagctattttgatggaggctttgtaaataaaaatttgggaggtaaaatttctgattgttcagtaattgactcaaccatttctttgactgatataacaggcggatttgtagggcaaaattccgaaggcggagtaataaataattgttatataatgaattgtaaagtttccggtaatagtattgccggtggatttgttggaaacaacactaacggcacaattgaaaattgttatgtttatgacactgttgtaagcgcgccaagtactgttggcggtatggcaggaagaaatgataataacggaaagattaataattgttatacgggggcttctgtttcggaagcgaattatgcaggagcttttgtaggtatgaattacgcagcaataagttcttcgtatgcaaacggtggatattcagcaggcaatgctgtaccggcagtgaaatttgcaggattgaatgaaggaaacatcaccggagaaaatcttgatttcagcggaaatactttaccatataaatatattcaaacttcaggtttaaatatatctgttaacgatacaacggtttatacacctcaaactcctgatgttacaccaggcggattaactgatattagcggtcattgggctgagcaaaccataagaaatctggtttctaaaaatgttgtaaacggatacgaagacggaactttcagacctgaggatagcgttactaagggagagtttattaaacttttgatgagtgcaacaggaaaaggaacttctgacggatttacaaattataaagatgttaatgcgagttgggcaagaccatatgtaagtaaggctatatatcttggaatttgtgataatataagcgacagcactgagatatttggagttgacaagtctataacaagagctcaggcagttgctcttatgggcaggttattagcgccggataaaacaggaattccatcgtttacagataacagtagtattccggactgggcgtcaaacgaggtttattctatggttgaacttggcttaataacaggtatggaggacggaagctttaaacctttagataatcttacccgtgcagaagcggcaacaataattgaacgtattatgaatttagggtaggtaataaatatgaaaaataaattaacaacatttatcctgactgtttgtttggtttttagcatagttcaaataggagctgtgtcggcagatgatagtttgactgttacttcaccaaacggctgtatatccatttcaatagaaacaaaagacggaaaaataaattatagtgttaagtataactcaatcagcataatcgaaagttctaatattggaattacattttcttcagttgattttagtgaaggggtaaaatatgtatcatcatataagaatactgtagatgaaacatattcgatgctgacaggaaaagcatctgtatatacaaataaggcaaatgaaacagttatgacatttgaaaaagacgggcatttgcttgatttatatgtaagagcttatgatgatggaatagcgttcagatatgggttcaatgaaaacggtcaggcactttcagaaaacacaactttcagattacctcaaaattgcacagtaaatgctatggaatacgaaatgtgttatgaaaatttttataatagacataacttatatgagctgaatggagtatatggtatgcctatgactgtcaaggttgctgataatacttatgctttaattaccgaagcggaacttaatggaaactatgcaggtacagtattaaatgctgacggcagcaatgttttaaaactaggatatgagcctaaacaatcagagccggttgaaatttcagcaccatttctgtcgccgtggcgcactgttataattggagaattgaataccatagtctctactgaaatgcctgaaaatctatgtgctccttgcaaattagaagatacttcgtggataaagccaggagtatcaagctggacatggtttaacggtgacccaactaatgaccctgaagtttataaacagtatattgacttatctgccgatatgggctggcaatacgtactgttggatgagggctggcagccattagaatacgatgagtatgggagaaagacatatagcggaattatggattggacagaggaagttattgagtacggaaaacaaaggggaattggtattattgtttggtctacaagctgggatcttgatactgaacaaaagcgcgagagattaaaagaatgggccaatatgggtattaaaggtataaaagttgacttttttaatagcgaaactcagcagacgttaaaacttatggactcaataactcaggagtcagcagagttaaagctgctggtaaactttcatggatgcgttaagccgacaggagaacgcagaacttggccaaatcttattacgcgtgaggcagtatatggaaatgaacattttttaagtggagaaaattggggcccgacggctgagcataattgcacattgccgtttacaagaaatgcagtaggaccaatggattttacacctgaacttactaatcataatgataaaaattattttaccgatggtcaaaaatgtgcgttgcctatagtttttgaatccgggatacagtgtttgtcagataagcctcaaatatatgaaaatagtgcggctcgtgaattatttaaaagcattcctgctgtttgggatgaaacgaagctcttatcaggagatattggagaaagtgccgcagttatgagaaggtttggtgatacatattatgttgggagcatttgtaataatcaatatgttgtggatataaatcttgattttcttaaaagcggcaagtattggtttgaaatgtatactgacggttccaatgatacagatatagctgtttataatggtgttgttactaatcgggatacaataactattccgcagttaacgcacggcggaggagctgtaaagtttacaccgataaaagaaaatacaaagttattttcggacattgacggacactggtgtgaaaaaaatatattatcattagctgaaaaaaataaattgaataaatatttttacggcgagtttggagtggatgaatatataaccagagctgaatttgttatgcttttgacagacgctttggatataggttgtatgcaaggaagtcctagattttatgatagtataaggcatattgctaagaatcatatttatacagccacagaaaaaggtattattaatggaataagtgaggaaacgtttttaccggaatcgaatatcactcgtgaagatgcggcaactataataggccgatatgagaatcttaaaggcggtataaacagtggattttctgacagcaatgagatatcccaatatgctaaagagtatgttgcacaatgtgttgcaatgggagttataaccggatacgaagataactcgtttaagcctaaaaataatattactaaagctgaagccgctgcaatgctgtttaggtgtcaaaacttaaagtgatacttttaaatcccatgatttcatatcatgggattttatatttttatttctttagaatatgctgactttttagttgcaaatactattattgttatatcaatataaaaaaacgttatagctattgccaatatatgttaaatatgttataataaaaataataaactattagttttatttataaatattgataaaaatttatataaaaagattttatctttttttgggagatggggaaaataaataaaataaaaaaatatattagatatgtttttcctttcattttagctggtatgttttgttttataagtgttacgtctattgttacaattattcatatgcagggtaacgcacgggtgattaattataccggaattgtaagaggtgccactcaaaggcttgtaaaacaagaaatgaatcagtacccaaatgatgaattaataaattatattgatggaatacttcttgaactttcaacaggtgatggtgagaatggtttgagaatgattaatgataaagaatatcagggattagttaacgaaatgaaggaaaagtgggaagttataaaatctgaggtacagtttgtcagggctggaggagataagcataaattatttgatttaagtgaagattattttgcgcttgccaacaagacagtttcttctgttgaactttatactgaggagcgcgtaaaaagtgcaaagtggactttgtttgttttaaatgccggttttgttatattatttattttattctttatgcttggtatgagacaaaaaaaggttcaaacagaccttatatctgctaaaaacgccagccgtgctaagagtgaatttctttcaagaatgtctcatgaaataagaacgccaatgaatgggattatcggaatgacagcggttgcgcgtatgtctttggataatagagaaatgttgatagattcattaaataaaattgatttgtcttcaagttatttgttatcactaatcaatgatatactagatatgtctcggattgaaagcgggaaaattaaacttgataatgaagtttttgagatcactgaagttttaaaacgaatatatataatgtttaagcaaaagagtgatgagagcggtatagattttaaaattaaaagcgataatgtaaccgtaaataaagttattggtgatgaattaagaattagccaagttattattaatataatctctaattcaataaaatttactcagttcggcggtaaggtaactcttgatgtcaggcagaaaatcgatgatgatgaaaaagttatatttgaatttgttgtttctgatacagggataggtatgagtaaagaatttcagagacatatgtttgaaccgtttgagcaggaacggaatggaaactctcatcaatatgcaggtactgggttaggattggcaataagttataactttgtaaaattgatgggcggtgaaatcattgtacatagtgaattaaataaaggttctgaatttgttatttatttacctcttcaaaaagcagaaaatgcgaagcttaatgaaaaacaagataaaaatatttttgaacaaaagaaagaggagcttatgaatctttgtgaggttcatatccttttagctgaagataatgaaataaacgcagaaattattacttttttattgcaaaaatgcggtgctgaagtagatttagctatcaatggagaagaggcagtgaaaaaatttgctgaatcagctgttggaagttatgatttgattttgatggatattcaaatgcctataatgaacggtttggaagcaagcaaattaataagagcaatggagcggccggatgcgaaagatattttaatagtgggagtctcggcaaatgcgtttagtgaagatgttcaaaaagctaaacagaatggaatgaatgaatatatatccaaacctatagatatgtcgaaattgtttgaggctattaaaaagtatttataattatatataaatagaataagctttaactaaaaaatatttgaaatatatactttcttttaatgtggcattttgttcttttatagaaaaataatttgtattttaataatgacagttaaagatattaccggttttaaaagctgataaatttggtgagagtgaacaataaaaaactctgtagacaataaattctcattatttatataataaaatcataatttggttatatccaacttatgatttgtaaaaaatccggcaatctggacaattaagttagcgtgctgccttgattatttcacaaataacctaaaatttgttaagcatgttttttaaaactgcagaaatacaaaagaggttatgttggtgagatagattaaaaagtgcataatataaatagaataaaaagtagcgggatagcatgtgctatcccgctactttctggtaaacttaaagtataagtaataccgattcaaaaatcaatacatttttgaatattaaaccatttggtgactcctaggggatttgaacccctgtagccggcgtgagaggccggagtcttaaccacttgaccaaggagccatatggtagcggtaactggatttgaaccagtgacactacgggtatgaaccgtatgctctagccaactgagctataccgccaaatactgttattccttcaatttgcgaacaacagttaatattatatcagagaaaataatatatgtcaacactttttttaaaaatttataaaaaattttttaatgcggctttttaatcttttacagactatttattggtttttaaattttctttttttatgaatatcaattcttaaaaaagaaataatattaatatgctgatacgatatattatatatggcttgctcggaatgaatatggaaatcttctggaccagcctttcgggaataaaaagcggttctcataatttaattggccatacttctatatggatgttttttatatatggtcttgctgtggtcatcatggaaccaattcataatttaattgctgaccaaaattggtttctaagaggttgtgtttgggcttcggtaatttttgtcatagaatttactaccggaggtattttgagattgtttcaaattgagccttggcattataccggtgaattttctatcatggggcttattcgaatagattatgctcctgcctggtttgccgtcggcttactgttcgaacgtattcatactttgcttttaaattataatattgggctgaaataggtgattgaattaactgtttatcattttgttcatatcttttctcagcctttttataattcttttttcaagtcttgaaatgtatgactgtgaaataccaagaaggtctgctacttctttttgtgtcatttcatcgccgttattgtttattccaaatcttaattcaacaatatttctttctcggcctgaaagtttttccattgcaagataaagcagttctctatctgtttcgtcttcaatgtttttttgggttacgtcattatcagttcccaatatatcagaaagtaaaagttcgtttccgtcccaatcgacgtttagtggttcgtcaattgatacctctattctgttattattattttttcttaaatacattaatatttcattttctatacatcttgaagcatatgtagcgagttttatatttttttctggcttaaatgtatttattgccttaattagtccgatggttccgattgagattaagtcttcaatacctataccggtactgtcaaatcgttttgctatatatactaccaatctcaaattgtgctcaattaatatttgtcttgccttgtcggaatagtcaggatttccaagtctcgatgtccaccattgttcatcttctttattcagcggaggaggcagagtgtcgcttcctcctacgtagaaaactttgccatccttttttgaaacaaagtttagataaagctgttttaagtacttttttagtttttggtacattattcttccccctgaagatatatttattatttttttctgtaaaggcgtccgggcttgcaattgcattataaagaccatcgctgcaaaactctgtatttacgaacccaacatagcaattttttttgtcaaaataatattttccatattttgttgttatatgttcgggttcaaataccggtattaagttatcattatttttggatacagtagatattttaaccagcctatattttatatgttcgttttctaaaaatgtatatgagtttttttcgccgccgattaaaataacaggttttccgcttagcggttcaattagctcacatcctgtgtccattaaaatatttagtttgtattttttattcatcaatatcaattcagcgctttgtattattttatttcggcttaggtttctgctgcatatttttataaaagcgagaataatcaaataggcagctataactaatgatataagagttgtaatgtttaagtccaagtatggtaccccgtttgagattatagatgtatcttttatagaaatttgatatgctataaaataaacaaatcccgaaaacaataatgatactataaagaataccaaagtatgtttaatcagtttaataaaagtgttgcatttataaaatatcattacgaataaaacagtaaataatattcggcctaataaagtatataacaaatatgtatgcggaaaaaacataattacagaatatagagctgatattgctgaacctagtgccagtctcaatatcgtggttctaaatctaataattatgcttgctgcaaaaattattaaagagttaatcaaaaaattgcttaaatataaaatatctatgtatatggtcaattatatcaccaaagatattatagagcagtttttgaaaaaaatatgtcagaatgggggaaaaataaaaataaattaattgatgtgaagtaacttcgcattttaatgttaaaacaataaaataacaaatatttatagtatatagataaaaattttttaattttgtgtcttgaattccatattgttatatgatacaataaaaaagttaaatacatatatttagaaaataatattaaatttttttaatgtaatctttaataagggaaggttgataaatgtggaaatcactataaacaaaacgcaaaatcctaaggtaaagcctgatatgagtaatttgccgtttggaaagtatttttcagatcatatgttcattatggactatgacgaaggaaagggctggcatgatccgagaattgtcccatatggaccaattgaacttgacccgtctgctatggttttccactatgcacaagaggtatttgaaggtttaaaagcatataaatcttctgatggacatgttcgtttgtttagaccggacaaaaattttgccagattaaatgtttctaatgaaagactggcaattccgcaaattgatgaagctttatgtcttgaaggtttaaaaaagcttgtagaattagacaaagaatggattcctgagcaggaaggcacgtctttatatattagaccgtttattattgctaccgatccatttttaggtgttaaaccatccgagtcatataagtttatgattatatgctcgccgagcggtttgtattatcctgaaggtttagctcctgtaaaaatatatgttgaggattcttatgttcgtgcggttcgcggcggaacaggatttactaagaccggcggtaactatgcaggcagtattagagctcaggttgttgctcatgagaagggatattctcaggttctttggcttgacggtgttgaacagaaatatattgaagaagtaggttctatgaacatattctttaaaatcaatggtgaagttgttactcctgctctaaacggaagtattttgagcggtataaccagaatgtctactattgaacttttgaagtcttggggagttccggtatctgaaagaaaaatatcaatccaggaagtatccgacgcttatgataacggtactcttgaagagtgtttcggaaccggtaccgcagctattatttctccggttggtgagcttagctgggatgataaagttatgttgataaatgataataaaatcggagagattactcaaagaatttttgatacaataacaaatattcagaccggaaaagaagaagataaaatgggctgggttttaaaagttgattaagtaattgattgggtattataatatatataatataattaggaatgcaggcatcagtgtcatttaaattcaaaatattttgatagaatgaccaatgcctgtttttttataatttaaggggatgagctgatggagcgcggaagtggaatattaatgcatatttcatctttccctgcaaaatacggaataggtacaatgggaaaggaatcttttcaatttgttgattttttgaaaaaaagcggtcaaaaatattggcagatcctacctattggtcctaccagttttggagactcaccgtatcaatcattttcaacttttgcgggtaatccttattttatagattttgatttgctgcgcgaagatggttctttaaatttagaggattattctgaaattgattggggaaacgagcctgacagagttgattatgaaaaaatatttaaaaacagatttaaggttcttaagattgcatactctagagacagaataagaaaaaaggcggaaatagataattttagatttaatcattcatattggattgaaaattattctttatttatggccttaaagtttgataataatctaaaaatgtatcgaaattggaatgaggatattgtaaaaagaactcctgaagcaattattaatgcgtataatgatttaaatactgaaattgatttttgggtatatgtacagtatttattttataaacaatggtatgcgttaaaagaatatgctaatatgcagggaataaaaattattggagatataccaatttatgtagcagaagacagcgcagacgcctggtctcataacgaggtgcttatgcttgatagctgtggtattccaataaaagtggcaggttgcccgccggatggttacgcacccaaaggtcagctttggggaaatccgctctataattgggactacctagcttcaaccggttatgaatggtggatagaacgtttaaaagcggctttgaaaatgtatgatgttgttcgtattgaccattttagagcttttgacgctttttatgcaatagattatggaaaacctgacgccactgagggagagtggcttaaaggtccaggagttgatttttttaataggctgaaagaagctttgggtgaatctcccgcattaatagcggaagatttaggaactataacggatgatgttagagccttactgaaatacagtggatttcccggaatgaaagttatgcagtttggcttttctccgggagaaaatagtgattatttacctcataattataaaaataattctgttgtatatattggcactcatgataacgatactctaaaagggtggtttgattcacaacctgaagaagttcaaaattttgcggttaaatatcttcgtctgaataaagatgagggatacaattggggatttataaaaaatttattatcaactgttgcgaatacggcaatagtaacgatgcaggatattctgaacttaggaaatgatgcaagaatgaatacgccttcaacactgggaggaaattgggagtggagattaaagtctatggatttgctttcagactctctttcttcaaaacttttagaaattactaatatttattcaaggtaagttatattttgtttggttcgcctggaaaatttgggcgaacctttttatttagaataattttataaattatattattataattttgttaacctacttgaagtttaagcttttatttgctataataagtttcaaaattaagaaaaatgtctgattagggcgtgtttaaatgggcaaaaaaaattttgaatcaaacaaaggaaaaagcaaacgaatatggatttattctattattggcgtgctgttggttttgactggagtttttttattaagtgaatctcaatttgacgtaaatcaaattcctaatttgttttcagagatgaaaaatatgctgtttgataaaacagagaataaagttcaaattgccgaggaaatgcctgcggctaaaattaaggcgtattcagaacaaacatcggttgttgagcctgacaaaataactccgtctaatctaaagagtgctgatggaacttataatgctgaaggcggagctaataatctttatgacggagatatttctacatgctcaggaagttccagttcttgggcaactctagatgctggagagttaaaaactctttcatatataagatatataccaaacacttcatcgcaaatcatgggcaatacatgcgttggaactaaatttttggcttctaaggataataaatattttgttgagctgggaacagttaatcctgacgttaacggtgatataaatttagattggcatacacttgagttcagcggttatggagaatacagatattttaaagttgagctttctccgtatgcgtcttttggagaaattgaatgggtaagtgatactggtataatcgcagatgaaaatgataaaaccgattttagttttatggcgtttgacgctatggaaggatttgaagggtatactgtcttatctatatataataaagataaaatattaaaatgcgtggaaactatcgactctgattttaaggtgggtgattatacaaagctggaattttctgatattcaattagagcttggggattacatacgagtaataacatatgataagcaggatatgaaaatggcggttgacttacctttggattatcgctttacggaggcgtcttcaaatttatcggtttcaaatatatatagcgataatatgatgtttcaggcagatcaggaactcgtgatatcaggaaaaggagtgtgcggttctgaggttaaagcggttattaaaaacatggatacgggagaagaattttcgggaagcgatattgccaaagatatttccgactgggagataaatttaggagtttttgaaaacggcggaaattatgaacttttaatatcgtctgaaaatgaaaagttagaatttgcgaatataacctttggtgatatatgggtttttgccggacaatctaatatggaattttatctgtgcggagaaaaaagcggaaatgaactattaaatactaaggaaggtaagaagaaatcaactactgataaaatcagaatgataaatatgtataatatcggatacatgggagcagcaggtgaagttgagaatgttccgctaaacgactggaacgagtattggacagagctcacgcctgacagagtttcttatatgtctgcaatagcatattatttttcccagggaataaaagaccgatatgaccgtaatgtaggaataatcagtgtagcggtcggagataccgaaattaatcaatggtatccaagaggagagagttttggaaaatttacaggtgacagcggaaagctgtacaataaccgtatatatccatttactaagcagaaaataaaaggtattttatggtatcaaggtgaagcggataattacagaactaatatgaatgctgaggaatacagcgacgcgatggccggattaattgatctgtacagacaaaaatggagcagtgaagatttgccgttttattatgttcaattaacaagatatgaaacgaaggatgcaagtgaaattcgagaagggcagcgcatagccctccaaaaagtgagaaataaaaagaatgtaggaatgtttggtctgcttgatataatcggacggtatgaccaaggagaaggatgtgcaagaaccgatattcatccatggcagaaagaagtagtggcagatagatttcttgattatgtaggacatgatatatacaaggattcagaagccaatacttcaggaccagtataccagtctaagcagaaaattgataataccatagttttaacttttaagcataaaggaaagttaaaagttatggataaaagtcaatatgctgattctgtctgcgagcaaaaaatatcagcttcatctacagataccagcattttgcatgagttctggatttctgatgagaatggcaaattttatccggcaaatgcaagaattgaaaatgataaagttgtcgtatggagcgacagcgtttctaatcctacagatgttatgtatgcttggggagcgtatcccgaaatgccaaatttaactgatgattcaggacttcccgcagtaacttttaatacatataacggaagtgaagttttatagtgtttatttgataaatattttgatttattgttttgaccccgcctaatatattaagcggggttaagtatagcatggaataaaaatattaccggtaaaatttataatatgaccaaaaaattgtcaaaaaatatggtttgtttataaaatagtaatctaaattattgacattaaagtcattcaaaggtataataaacagaatgctaatttgagtttttttggtctaaaacattttcagtttttatactgtttttttgcactctgattctaagtataaaatctaaaatttgtgtcttttggcagtttattttgaagatgatattttgttacataggaggtatttaaaatgttgaaaacatttcgtggcggtgttcatccaaacgatatgaaagagccaacagccggaaaggctatcgttgaacttgatccgtcgcaggaaatggtttatcctgttgcccagcatataggagcgcctgcaagtccgattgtcgaggttggtgatatcgtttatgcagggcagaagattgcagaagccggaggatttgtgtctgcctgtattcattcatctgtatcaggcacggttaaagcgattgaaaagaggcttcatccaaatggattaatggttaattccatagttattgaggatgacggacaggatactatttatcctaacttaaagggctgtgatgattatacacagctttcgcctaaggaaataattgaaattataaaagaagcggggatcgttggtcttggcggagctaccttcccaacacatgttaaactgtcgccgcctccggaagctaaaatagattatgtaatagttaatgccgctgagtgcgaaccatatttaacatcggattatagaacgatgcttgaaatacctgaacagattattggcggattaaaaatagtaatgcatatttttggattaaaagatggttacataggtattgaagataacaaagagctagcgattgagacgatgaatgctcttgcggcaaaatctaaagatgttgatattcatgtggaaaaattaaaaaccaaatatccgcagggcggtgaaaaacagcttattaatgccataaccggccgaaaagtaggaccgggacagcttccatatcaggttggcgccattgtgtgcaatgttgatacttgcagagctatttatcaggctgttaaaagaggtctgccggttatgacaagggtagtaactaccggcggtgactgtgttaaaaatccaggaaattacaaagttcgtatcggtacctctcttaaagatgttattgagcaaacgggtggatttgtacaagagccgaccaagctgataatgggaggtcctatgatggggatggctatccctacacttgatgtgccggcggttaaaggcacgtccggtcttttagcttttggcccggatttggcttatggttttgaagaaaacgcttgtctcagatgtggtaaatgtgtttatgcctgtcctatgaaattgctgccgaataggcttgatgaggcggcgagagcagatgattttaaagcactggagaagttgaatattgcagattgtattgagtgtggaagctgcgcgttcagttgtccttcaaaacgcagacaggttcagcagataaaggtggcaaaagttaagcttcgtgccgcacagcaaagaaataaataaaggtggagggaataaatttggataatttacttgttgtttcacattccccgcatatatcaggtaatgatacggtcagaaaaacaatgcttgatgttataattgctttgattccggcattgcttgcaggggttttggtttttgggtatagggctgtggtcgtcactgttatcagtgttttggcatgcgtcttatttgagtggttatggaataagatattaaataaaccaactactgttggtgacttcagcgctattgtaacaggtatgcttttggcctttaatatgccggttacaattccgctttggatggttgttataggagcattttttgccattataattgttaagcaattttttggcggtcttggtcataattttatgaaccctgccctggctgcaagagcgtttttgctggcgtcgtgggcattagcgatgactacatgggttgctccgcatacagctgttccgctttggaatactgcggatgttgtgacatcagcgacaccgcttgcagcatatgcaggaaccgaaggagcttctcagcttccaagctattttaatttatttattggaaacgttggcggctgtattggagagacttcagctttggcaattttaatcggcggagcctatctccttattaaaaaagttataagattgagaatcccgcttgcatatcttttgacattagctcttggaacttggatatttgccggtccggatggattttttacaggagacgctttgtatcaagttcttgccggcggcgtaatgctgggagctttctttatggcaacggactatactactactccatatactcctgtcggtcaaattatttttggtatcggctgcggagtaataactgttttaatcagagtgtggggcggatatccggaaggctgctcatactcgattcttcttatgaatattgttacgcctttaattgacagaatcacagcaccaaaacgttatggtgcctcaagaaaaagaaaggaggcacaagtataatgaaagagacagctactcttactataaagttgcttttgataactgcgattgtggcagctctgcttggcggtgtaaatatggtaacatcacctataatcgctaaaaatactgaggctgcttttaatgagaatatgaaagaactgcttcctgaagcagataagtttgaaaaggacggtacaaaactgcctgaacctgaatccggtataactgttgacggtatatatgccggtatgctaaatgacggtactatagttggatatgtcgcaagtgctgtatgcggagaaggctacggcggtgatatagttgtgatggtaggaattgattcagaatgtaaggtaacaaaagctaaagttacggaaatgagtgaaaccccgggacttggagcaaaaagtcagtctgattggatagaccaatatacaggtttgggtcaggatatacaagttgataaaaatggaagcgctgcatcagcagaatacaaggttgaagctatatcaggcgcaactattacttcaaaagctgttacgaaagctgtaaacgcttctcttgacgccgcacgcgtggttattgaggataataatattccgccggctgaagaagtgcaaaataatgaaaatttggatcaaaatcaagtcgaggaaggtcagccaagtgctgaatctgaaacaatagattctgaagcagaagttagtcaggaagattctgaaactaatagagaagaaccggctgacagtgatgaagatgttgaagggggtgcggcagaatgaagcaaaatacatattttaaaactttcctgaatggattactttatgaaaatccttcgtttgtattatttctaggtatgtgtcctactcttgccgttacaaccggagttgttaacgctatcggaatgggtctttcaactacggcggttttgatttgttcgaatatcgttatatcgcttctgagaaagtttatacccgacaagataagaatagcggcttatatagttataatagccggtttcgtaacagttgttcaaatgcttatgaacgcttatgttcctgctctgtcaagcagtcttggaatttacattcctttgattgttgttaactgtataattttaggaagagctgaagcgtttgccaataaaaattctgttggtaaatcaatgtttgatggattaggtatgggtcttggttttacagccgctcttattttaatctcagcagtaagagaaattctaggagccggaacatttgccggtatttcattgtttggcagcggatttcagccggtttccattatgatacttcctccgggagcattcttgacgctaggttgtctgcttgcggtaattaatataattgttatgaaaaggaaaaagaaaaaaactgctctgaattcgtcagatgaaaaggagggcatataatatggttgcagatttattggtaatcagtataggcgctatacttataaataattttgtattagttcagtttttaggaatatgtcctttcctaggagtgtcaaaaaaggttgatacatctgttggtatggggtttgccgttgtgtttgttatggcatgcgcgtcaataataacatggtgtgttcaatattatttgttggttccgttccatctggaatatttacagacgatagcgtttattttagttatagctgtgcttgtgcagtttgttgagatgtttttgaaaaagtctattccgtctttatatagctcacttggcgtttatttgccgcttattactacaaactgtgcggtgcttggtgtagctatacaaaatataactaagttcggcggaacagatatgagttttttgaagtcggtggtttatggtgtttcagctggtattggattcaccatagctattgtattgtttgcaggtgtacgagagagattagaaagttcaaacgttcccaaattcctgaaaggtatgccgattacgctcgtaacggcggcgcttctttcgattgccttcctcggattttcgggattaagtttctaaaggaggggaaataaatggtttcaagtattcttatccctgtccttgttgtcggtggaatgggattaatttttggagttttacttggtgttgcttcaaaagtatttgctgtaaaagaggatgagcgtgttcctaaaattttagaggttctgccgggagcaaattgcggaggatgtggctttgcaggatgttcggcttatgcaactgctttgtgtaaaggcggagttaagaccaatatgtgtcctgtgggcggtgacgctgtttccgaaaagatttctgaaataatgggtgttaagaatgaagtaaaagaaaaaatggttgcccgtgttctatgtaacggaagtcctgaaagagccgttcaaaaatattattttgacggtccaagagattgttacagtgcttcgcgtcttggcggcggggaaaaaatgtgtgcttacggatgtttgggatttggctcttgcgttaaggtttgtaagttcggtgcaatgagcattaaggatggagtagcatatgttgatatagacaaatgtgttgcgtgcggagcctgtgcggaagaatgtccaaaaaagattattaaaatactgccgcttaaaagtaagtatactataacatgtaagagtgttgaaaaaggaaaaattaccagacgagactgtgcggttggttgtattggctgcggaatttgtgcaaaagcttgtccgaagggggctatatcaataagtgagcatttggcggttattgaccctaataaatgtgttaattgtggtatctgcgcacaaaaatgtccgcaaaaggctattaataaagttactccagctggattggttcgtcctgaaccaaaaccgtctaaacctaaattgacgccggaacaaatagaagctttgaaagctaaaaaagctgctgaaagaaaagacttaaatcagtctcccggcgaaagtgaaaagaatataaagtcaaaagttgttgatgcagatactaaattcaacgatgttgtaaagaataatattgatagagaagtaaaaataaaaagtggtgtgcaaatttctgatactcaggaaataaatgttaaagaatcgaatagaatataatcatggatttatattcaggaggtatatgtatgattgataataactgcgcatattgtgttgaaggcgagttagttgaaaagtttggaataaaaatatgtgaactcgaaacttgtaaggtatatttgtttaaagaacaaagtcatagaggaagagttatagcagctcataaaaaacatgttggtgatatgacggaacttactccggaagaaagatgctcatattttgaggatatagcaaaaatctcttctgctctcagaaaaatttttaatcctcaaaaaataaattatggggcatatggggataccggaagccatttgcattttcatctggttccaaaatatgaagatgaatacgagtggggtggagtgttcctaatgaatcctgatcgtgtgtatcttgacgatactgaatatgcagatatgataaatgaaataagagaagcactaaaagaagaggatgcaggttaaataaaatgcaattaagcagggtcttgtttgactctgcttaatttagactcggaggtgtgtttatgctttcaaaaattctctcaaaagaacagtgcgctgactgcggtttttgttgtgttttcagaagaaccagtatttgggaaactcctcttttttcaaagtcagttattgaaaaactcaaaacaaaatatcaagattctgaatttgttcgcgtaggtgatttatatactatagatttaagcaaagagtataaaactgattctgatgatgaggaagcagcttgtttttttcttgacaaaaaaagtggctgtatgcttaatgatgatgaaaagcctctggactgtaaaatatggcctcttagaataatgaaggatgctgaacatttagttattgctttgaccccaacttgcaaggagattaataaattgcctgttgaaacagttaaagagtttgtccagtcggggattggtgaatatattagagataaagctatggaaatgccagatattataaaggaatatagaagtgattttccggtaataatgacattttctgattagtatacaaatgaaaggtgatttaatgccaagtttagaatttaagaggattgaactttcagataaagaaatagttaataattttttaaataaaacaaattcgaattcatgtcaaatgacattcgcaaacttgttttgtcttcgtgaaaaatataatactgaaatatgcgttcgggataatgttttatttattcgtcagaagaatagaaattttggcggtgaaaataatcaaattgcatattttgttccgataccgataggaaccggaaatcttgagtctgccataaatttaattattgagatatcgaggaaagaagggcatagaccttatttttttgctgtgaccgatgatacgaaagatgaacttgaaaaattagataagtttgagttttgtatagaggagcaggaagattgggcagagtatatttataaaagtgaaaaacttgttgatttttcttcatcagacctttcaaaacagcgtagggcagtaaatcgtttttggaatctctatggagaggaaaccaggattgaaagaatcagcgaaagtaatataaaacaattattaaagtatcaaagcaaatggcttaaagaaaacatagagagaaacatggattctgattctttaataaaagaaaatgtttctatatgcaacgcgcttgaaaattttaatgagttagaccttgaaggaattataatatttgttggtaaatcaatcagaggctatggatacgggacaattttgcccggaggggcttttgatattatagcacagaaaggtgatataagttatcagcagatttataaggtagtattgcaggagcatgttaagacctattatgaaagagctgaattgactaatatggaggaagatataggtcttataggtttaagacgttcaaaaaccaggtatagacctgaatatatgttaaaaaaatatacagctttcttcaaataagtaattattatacaaaagacagggatagtatatatccctgtcttaattttgtttatatagaaaaatcttaataaatcaataaaatttatctttgtcaacattaagcccatacttctcgttatattttttgagctgctcttctttattcttttcaagttttatatcttcatgtatatcagctaccttttgggtaaccatttcgatttgatgtttttcctgcatatggtctacaagagttgtgttgtagactgggtcttcatagtgagctgcttggtatttataaacaagtttgagcaatactggtgtgattatcgtagtgaccaccacgacaattacaacgggagcaaagaactcctgaaccattaaaccaagagctgcacccttgctggcgacaatcagagcaacttcaccacgtgagatcattccaattcctatctttgtagactgtagattagtatatccgcacattttagcaccaacgccgcacccgactacttttgaaagtatagaaacaattaataagaaaaatgtgaaagcgattatagccggtcccattgagttaatggtaacttttaatccgacgctggcaaaaaatacaggagagagcaacataaaagacaccgtatcgaatctggaaattatatatgaagtccttttagttcctgataatataagcccggcaacgaaagctccagttatatctgaaacaccaaaaaatgcttcagagcaatatgccataagaagacaaaatacaaaactcaaaacgctgaaacggcgtaaatcttttttataaccattcatccaaggcctaacaaatttaaaaaacagataagcgacaataccacagaatgcaaagaaagctaaaattttaataagtacaatcggtagacttatagtcggatcagcacagctggttattattgtgagcgctataatacctaaaacgtcatcaataagtgccgctcctaaaatagcattacctgaatgggtagaaagcttgcctaattctttgagcgtttcaactgtgatacttaccgatgttgcagttaaaataacgccaataaaaatgttttgcagcagcgtattcgggtcacctgatttgttaaaaaagtaagctacaacccaaccgccaatcaaagggagaataacacccatcagtgctataaccgtagaggctacaccgcattttttcaattcttttatatcggtttcgagacctgcgctgaacattagaactatgacgccaagttcagatatagaagttataaaatccgtgctgtgaagccatccaaggcaagccggtcctaaaattaaacctgccagcaaagcaccgacaacctgaggcatttgtatttttcttgtgagcaaacctaataatttagtgcttaacaatataagcgctaaatcaatcaaatatccatattccataatccctaccatccttataaattcatattaaccccaaaataacattatagcttttattttataaaaatatattgatgcagaacacaaattgatttaagcaataatgcaccaagaactatgatactactttttttagtttttgtctacctatattttatcgttaatgtgtttttttttgctattatttttgttttgaaaatatcttggaatataatgtataatagtataaagatttgttatagtatatcaattataaaacttgttaattaatgattttattatttataggtaataattatattgtacaacataatcaaaaatctgcataatcataaatacatcatattgaaaagaccagcaaacgctggtctttttcgtatatttatgatgaaattatatgtgtaaaacaagagagatattattgttacagatcacggcaactacacattatatggtgtaaataatatgttaaaatattatgttaaaatattatgtataactcatcctcattgctccgcaagcggtcaaagccgttgtttttaccaaaattattttatattgtcaacaacctcaaagttatatgacaaatagctctgtcaaatagctttgaaaaatgaaactaattttatgtcataaattagtttttaagactatgtatcggtgcaggaatacgtccgccgcggttaataaatacttcactgctgtagttatgaacaggcataaccggagcttcaccgagcagtcctccaaattcaagagaatctccaacagttttaccggcagcaggtattattctgacagctgtggttttttggttaataactcctattgccatttcatctgcaataatcgcggaaattgttgacgccggcgtatctcctggtattgctatcatatccagacctaccgaacaaacacatgtcatagcttccagcttatctaaagttagagcaccgcattcagctgcggatatcatacctgcgtcttcactaaccggaataaacgcaccgctaagtccgccaacatagcttgatgccataactccgccttttttgaccgcgtcatttaatagtgcaagagcagcggtagtgccgtggcatccgcacttttcaagccccatttcttcaagaatataagctacgctatcgccaacctcaggtgttggagcaagtgataggtcaactattccataagaagagttaagcatctttgaagcttcgcgagctacaagctgacccattctcgttattttaaaagcagtcttttttatagtttcagatacagtgccaaagtcttcacctttgacttgctcaagtgctttttttactactccgggaccgcttacgcctacgtttataacagtatcgccctcacctacgccatgaaacgctccagccataaaaggattatcctcaacaggattggcgaaaacaacaaattttgcacagcccaaagagtcatcatcttttgacatgtcagacatctgtttgattatttctcccatctctttgactgcatccatattaataccggctttagttgttgcaactccgacagaagaacatacatattcagtggttgaaagagcttctggaattgattttatcaattttttatccgattcggtatatcccttatatacaagagcggaatatccgccgataaaattaactccgagttcttttgcagccttgtccaatgtttttgcaaactgaacatagttatcagttttgcttgctgcagcaaccaatgatattggtgtaactgatatacgtttatgtataatagggataccatatctcctgctgataatatttccggtttcgactaaatcttttgcacatctagtgattttatcgtagattttttgacatgctttgtcaggattctcgtctgcacaatctagtaatgatattcccatagttatagttctaatatctagatgttcatccctaatcatttttatggtttcggtaatctcatttgtatttaagtttatcatatgtatttcctttcggtggtttaaattctgtgcattgaattaaatatgtcttcatgttgaattctaatttcaactccaagttcttttcccaggccggcaagtttatcagacagttcgccgaaatctaatttggttgagcttacatcgacgagcattaccatggtgaaaatattttgcattattgtttggttaatatcgagaatattaatatcgttttcatagagcagactgctggttttcgcaattatacccgtcttgtctattcccataactgttaatactgctttcataatttttctccttaagtatataattataatttatcttatgtttagagtaatggtctaaagattttaaaccattactctaataaatatattatcattaaattttaaaaaagtacagtacaatattacatcaatttaaaattgctatacctatattaagatacaatgcaaaaatgcaccataataaatatggtatcagcatataagcagatgctttggatattctataaaatgctaaaatgtttaaaataatcagagcaattaatattgtaagccatacagctgaaaacgtgtgcagtccgaatacaaaaaataaaattgtccaagcaaagttaaaaaacagctgtaagccaaaaattaaatagcataatgatttcttaggctgcggagccgttgagttagcaattccatacagtgataaactcataagaaaatataaaaccgcccatactataggaaaaaccacacctggcggtgaaagcggaggcgatgcgagatttgcatattcttccatagcgttttttgtcaatatttctgataaaaaggcaactccaaatggtatcaaaaatgacaaaatgagttttttcaaatttaatgttttaaacatacaaccacctcatatagtttttagtatattgtatgtttattgttataattgtattcaaccgataaagctagtgaacaaaaaatacgtcttatattagaccataattttttaatccaacagttattccttcattcaacacggtttctgttacaaaacttgctatattttcaagttgctttgtgtgttttcccattgcaataccgtatccaacagttttcagcatatcatagtcattatcaccgtctccaaaggcatatgtatcatttaagtcaagtttaaagtgcttcattatttgatttatacccgaagcctttgaaatgttttgtttaaccaggtcgccggaaggattggaacggtgtttggttatattatatttatctccaaaattttcaattagtttgctgaataacttgtcaccgttatacgtaaacatcattttattcgcctgaactatatttatatcttccggcattgggaagaaacagttcatgctaatattaaaatggttcatcatttccataaaactttcataattatttttgctgtaatagcaggcgtcatgattttctgtaatataaccataattattttcatcaaaataacttattaattcagttaattcatttgttgtgagtttatcatttataatgtattctccgtttacagtggcacaagctccatttgatgtaatataacaatcaaagtcaattcctgtttcaggaacataacagcgtgctctgccggttgcaagaccaaccataaaattgttttcctgcagtttttgaatagaatctttagtagatttagtaggaataaagattttttcaccttcgtcaacaagggtaccatcgaagtcaaaaaataccgctcccctgtaattcttcataaatatatctccttatatcatgtttagtcgtaattcagcagactgaaatagatttacttaatctttaaatattctacctcaaactttaaatctttgcaatacattttttatataataggtaataaatctattaagaaaatttgcgcctattatgtatttatattgtataaaaatactatttataaaaatttttatatagtctgattttatataatttaagtaatatttttcttcgtattcttttttacaaatatgaaaaaataagtatggagggttattatgaaaacactaaaaaaatcattgacattaatatttataatttctttgttttgcatcacagcagaagcaaagacaatacagcatacggttgttaaaggcgaaagtatgtggaaaatagcggtaaaatatcaggtcggattaagtgagataatctcagctaatccccaagtatctaatcctgctttaatttatccgaatcaggttttaaatataccattgatggatgagtctataacttctttcgagcagcaggtaatagatttaacaaatgaaaaaagggcatcacgaggattaaaacctttgaatgctaattgggaattatcaagagtcgctcgttataaatctcaagatatggcaaataacaaatatttttctcataccagtcctacgtatggttcaccttttaatatgataaagaattttgggatcaaataccgttcagccggcgaaaatattgcttatggtcagcgtacaccggcacaggttgtaaacagctggtggaattcggcaggtcaccgagcaaatatgcttaacgctaattatactgatattggcgtaggctatgtagcaaatggaaactattggactcagatgtttatacaaaagtaggatattttagaaatctcagaaagaaattttaaaacatgtgtaaaagctctcagccgagggcttttaatttgtttgaaaatttagattataataatttatttgacataatatattatataatgctataatcataacatgaataaatttttgcctatttctaaaaaagatttagatttaagaggaattaagcagctggattttgtatatgtaatcggtgacgcatatgttgaccatccgagttttggacatgcaataatttctcgtgtacttgagcataatggatatactgtaggaataatttcacagccgtcatggaaaagctgtgatgatttcaaaatactgggaaagcccagattgggctttattgttatgtccggaaatattgatcccatggtaaacagatatactgtttcaaaaaaggtcagaaatacagatttatattctccgggcggaaaaggcggaatgagacctgatagggctacaatagtatattgtaataaaataagagaagcctttggcagtgttccgattattataggcggaatagaagcaagtttgagacgatttgctcattatgattattggagcaataaagtaagaagaagtattttaattgacagcggagctgacctgcttatatttggtatgggtgaaaggcaaatagttgaagtggccgaacttcttgacgctgaagttcctgtgagtgaaatcaaaggaattttgggaaccatgtatatagagaatgataaaaataatcttccgtatgatgcaatttcgcttccgggatttgatatggtttcaaatgataaaaaatcttatgctgcagcaacaaaaattcaatatgaagaacaggacgctgtcagaggaaaacctttagttcagctcgacaatgacagatatattgtgcaaaatccgcctgctgctcctttatccactgaagaacttgacgatgtatatgctttgccatatatgcgcacttatcatccgatatataaaaaacagggcggagttcctgcgattaatgaagtagagttttctattacttcatgccgcgggtgttttggaggctgcaatttttgcgctttgacctttcatcaaggaagaaccgtaactgcacgaagtcatgagtcaataataaacgaggttgaactgttaacagaattaaagaattttaaaggttatattcacgatgtcggcggaccgactgcaaattttagattcccttcatgcgaggaacaacttcagagaggtgtgtgtaaaaataaacagtgtcttttcccgcagccttgtaaaaatctagttgttgaccattctgattatattgagctgcttagaaagcttagaaagttacctaagattaaaaaagtttttattcgcagcggtataagatttgattacttaatgtcagataaaaatgatagttttttatatgaattatcaaaatatcatataagcggacaattaaaggttgctcctgaacacatttcagataatgttttgaaatatatgggtaaacctaagcatgaagtttttgaaaaattttccgctaagtataaaaaaataaacgaagagttaagtaaagaacaatttttggtaccttatttaatgtcatcgcatccaggcagcactttaaaagacgcagttaagttagcggaatatcttagagatacaggacataatccagaacaggtgcaggatttttatccaacgcccggaagtatatctacttgtatgtattataccggtatcgaccctaggactatgacagaagtttatgttccaaaaacatatgaagagaagcaaatgcaaagagcacttctccaatatagaaaccctaaaaattataatttggttttgaaagccttaaaaaaggcaggcagggaagatttaattggatttgattccaaatgtttaattaaaccgttaggaaataaaaaaatatataaacctgatacaaagaggagaggataataatggcaaagatattgagcggtaaaattgtttctgcccgtgtaaaagatgagcttaaaaaagaggtggaagaactatcacagcgtggaaaacaaacaggacttgctgttgttcttgttggggatgattctgcttcaaaagtttatgtcagaaataaggaaaaagcttgtgaagaggtaggaatttattcagaagttcataggttgtctgcaaatacatcggaagaagaacttttaaaacttataaatgaattaaatgaaaatgataaaattgatggaatactagttcagcttccattgccaaaacatcttgatgataaggttataattgataatattaaacctgaaaaagatgttgatgcttttcatccaagtaatgttggtaaaataatgattggagattacgactttttgccttgtactcctgccggaattatggaattaatacatgaaagcggagttgaagttgacggaaagacatgtgttgttataggaagaagcaacatagtcggaaagccaatgtcaatgctgcttttacatgaaaacggtactgttacaacatgccattctcatacaaaaaatttagctgaagttacaaaaagtgctgacattcttgtggcagctgtaggtattcctaaatttgtaaaagccgatatggtaaaacccggtgcggtagtcattgatgtcggaatggatagagacgaaaatggaaagttgtgcggcgatgttgattttaatgaggttgagcctgttgcaggagcaattactccggttcccggaggagttggacctatgacaatagctatgcttatgagaaataccgttacggcttcaaaaaagaaattagaaaaataaaaatgaaacagggaagactttttgtcttccctgttaaaattttgaaattaaaaattgaattatataaataattattttaaggtataagctcataagagcatatcctcccaatgttcctgtaataaatcttctgatattgttacattttattatgtttttagattgtaaaaaccaatctaaaaacattgccaaacaaaataatattacaataaatatatttggtttataaaaaaatattaaacaaatagcggcaatccaaccaaagaatacgccggtacatctagaacatacaggaaactgaaatccattgataaaaaaacttctttcaggtatttgatgacattttgtcagccttcctaaattcatgagttttaaccaaagcttatttgaatcaaaatttttatccattaaaacgtcttccgcaatttctgcaaatccaataggtgcggttagttgacgtagttccgctgttacaagctccgcataaaagacccaaaggaccaaacaaaatatatccgcagcatccgcttccggggtcgtatcctccgccggaaactttagtttctgtcattggctgacaattattacttccgcaatgaggacactttatgcctgaataaccatttgcttgttcattatttgaagcatttttagtacctcctacaacttctgcatcatattcaggcacactggcaggttgtccgcaatttgggcagaaagttgagttgcccaaatccgttccgcattttttgcaatacataaatttcactcctaaatctacatcaaggctttactaaatgttattgaatctcatctaaattatatggtgttgtttggtatacaaaataattcagccaatttgaatataataagtttgcgtgagaacgccacatcataagaggttcttttaatggatcattatccggaaaataattttttggcaaattaatatcaatacctttggctttatccctaaaatattcatttgctaatgtaatattatcatactcagagtgtccggtaacgaaaaattgacgtccgcttttagctgatactatgtaaacgccggcttcgtcagattttgataaaatttctagctctggaaccttaacaatatcagattctctggtttctgtatgtctggaatgaggggcataaaacttatcgtcaaatcctcttagaagtatcttatgttttttttcaggaagcacatagtgttcaaaaatgccaaaaagtttatccttcatttcatattttggtatcccataatggtaataaaggccggcttgagcgccccagcaaatatgaaaagttgatgtaacatttttcttcgaccattccatgatttcgcaaagctcatcccaataatctacttcttcgaaatccatctgctccacaggtgcgcctgtaattatcaaaccgtcaaattttttgtctttaaatttatcaaacgtatcataaaatgtttcaatatgactttttggtgtattttttgattcatagctttttgtgtgcataaaactaatattaatttgaagcggcgtatttccaagaaccctgagaagttgagtttcagtttctatttttttaggcatcaggtttaatattactatttcaagaggtcttatttcttgcttaagagctctagtctctgtcattacgaatatattctcactgttaagagttccggttgccggaagagtatctgtaacttttatcggcatatttctcaccaccatttattttgtattctcgattataacatataaatttatactagtaaagcaattttatattaataattttataaataagcagaatgattttataataagcagatttaaaatattatttactttattttataatacagatttattattctaacaaaatatataaaatattagatataatataaaaaactaaagagtaacatatagattttatattgaaatattttcagtttgtttttaatgtatatttcaagtctttatatttatataaatataattatgataatattgtcatgcgtattttttattgttaaatttaaataactatttgctaaatatgtattatgtaaaatttttaataacagttactttttatgtaataaaatatataattactattaaatttctacagataggtgtttgttatttaaaataaagaacagctaaataatatgatacggttttaattatatattaaacaaggtgaaacatgataattttctagtttgattttaaaatacatttatgataaaatatgttattattagactgtttaaatattaaattttaaggaggattaaaatatgaaaattgctgttttatatcaaaagaatagtccgcctgttatcaaaggaataaaaaaaccgatgaaggaaggcggatacagcgacagcggagcggatatttgctattgtcttcaaaaacataatattgatgttgtgactcctgttaaacatcctgatatgctaaaggattttgattgggtttttccggatactaaggaaggaatacagaatgcaatttctttgggtgcagacacaatatggttaaatacagttttgtataacaatcatccgattgaaagttttaacggtattaatattataggtcagcgtccgtcagatgtgtcaaaatatgatgataagtactatacaaataattatttgagaaatttgggatttccggtagtaaagggtgttttgcttaataaagagagtaaatataacggagattttccttgtgtgataaaacccgttcgcggcagaggaagccagggagttgtgaaatgctgttcagctgaagaactttacagtgctttaaaaaacctgattgatagtggaatctatggggatgaaatgattgttgagccgtttttagatggaaaagaaattactatttctgttttaccaaatggcacatgtttgccggttgttgaaagatttaaccattgcaatggtatagctccatataatggcgttgttgcggtttctaaaaatagccgggccattttaaaaaataatgaaagtttaaacaaaatttctaaagcctgttcaaaagctgttatttcaatggatttaaaagctttagtaagaattgactgcagggagaacatccatggagaatatgagatgtttgattttaatttgaaacctaatatgaccggagcggttagacctcacagattagaccaggatagtcttacaatgattgccgcctcggctgttggctggtcgttttatgatttactaaatgagttaatacaaacaaaatggcagttataattaatgttttaattttatacatataataaagtgtttttatacattttgtaaataacttgggtaaatcgtaaaataatataaatatcaaagaaaatattaaattgttaaattgaacaaattatttttaacttaaaaatatgaatttatgcagttatacaagattggataaaatcattaaatttcaaataaaaactagtataatttcaaaatttctacttgacttatcttgaaaactcttgtattatagtaatgacaactgtaaagtctcagttaattttttgcattaaaaggagcggtattatgtacatgaaagaggtagtagttcagaatcaggttggactccatgcgagaccggcaactttctttatacagaaggccaatgaatttaagtccagtatttgggttgagagtgaagatagaaaggttaacgcaaaaagtctgctgggtgttctttcgctcggtattactaaaggtcttacgatcaccataattgctgatggtccggatgaggaagacgctgttaataacttggttgatttgatttcttataattttgcataaaccgtttggttaaaatatactaaaatttgagtgaactgttttcacagtttactcttttttgatacataaaataaaatgtggggtgatattaatgacagaagatattatgtgtagaataaaagaaaaattaaaaactcttccaatgtcacctggcgtgtatttaatgaaggataaggacggaaaaataatttatgtcggaaaaagcaaggttcttaaaagcagggtcagctcatattttataaattcgaaaagccatactgtcaaaactgttaaaatggtgaatcaggtcaatgattttgactatatattaactgacagtgaggttgaggcgcttatacttgaatgtaacttaataaaaaagtatatgccgaaatataacatactcttaaaagatgataaacaatatccgtatattaaaataactgtaaaagaagattatccaaaaatatttgttacaagaagacttgtaaaagacggttcaaagtatttcggtccatatatgagcgccgccaatacaaaagaaactcttgacacgattaaaagaatttttaaaataagaacttgcaatagggttctgcccagggatataggaaaagacaggccatgtctttattatcagattggtcagtgcagcgctccgtgtgcaggaaaaatttctcaggaagaatattctgaaatgtttaataaaatttcagatgttttaagcggcaactattcaatgttagaaaaagcattgactgagaaaatgtacaaagcttcagataatttagaatacgaaaaggcggcaggttatagggacagaattaataatctaagagcacttgatgaaaagcagaaaataatatctacaaatgaggataaccgagatattattggcgtgtacagagagaataacgactgctgtgttcagattttttatatgcgaggcggaaaaatgcttggttccgagcactatgtttttgaaaatagtgacgatacattggaagaacttatttcgggatttataaaacaattttattttacggcaacaaatatacctaaagaaattttgattcccgtagagatagaagattctgaagaaatagagaaatggctatctgaaaagagcggacataaaatacgggttcatatgccaaaacgcggggataaagcgcatactattacaatggttaataaaaatgctgaggaatctttaaaagttcataaatttaaaagggacagggagcaaacaaatcaaaatgctgtattaaaaggactaatggaattgcttaagcttaaaagcacaccttttagaattgaaagttatgatatttctaatatttccggttctcaaagcgtaggtgtttgtgttgtgtataataatgcgcgtcctcataaatcttcatatagaaagtttaacataaaaacagtggagggagcaaatgactacgaaagtacaagagaggttatatttcgcaggatatctaaagcatatgaggaagaggacgcaataaaatcaggaactctgcaagatgataaagcaaaatttctgccgcttcctgatttaattttattagacggcggcaaagggcatgtccacgtaataaaagaactgtttgaaaccatgggagaagaaattccagtatatggtatggttaaggatgataaacacagaaccagagcgctaactgatgaaaatcaagaattttatattgataaagacagcgagttatttaagtttcttacgggtcttcaggaggaagtacataggtttgcgattactgcctttagaaaaaaacatgaaaaagccagcgttcacagtgaacttgatgatataaaaggagttggtccggcaaagagaaataagcttctattaagtttttcatctattaaaaaaattaagaatgctacagtcggagagttatccgctgttatagaccctcaaacagcaaggaatgtatataaatattttcatcctgaaaattaaaaataaataaaaggctaagtaattttgtaaaccgaacaagcatataaatcagtgaggagttgatttatatgtcttttgacttaagaagtattatcgtttacatattcggtctttttttattttttatgtgtattaagttattcaaaaaaccgctgatttggatttttaggctgatgattagctgtattattggtattggaatacttctgctgtttaatttaatatttcaaaaagccggttttactttggctctaaatccgtttaatgcggttacaataggtgtattaggggttccggggcttgttttgctatgcgtgttgtcatgtttagcatagcagcggtattgcgttaaaagtcacgtagattttcataacttattaagtccagcatttgttcaagagtatcgcattgattgataagatttctcagttttgctccgccgcacaaacctttaaaataccatgccatatgttttcttccctcaagaacgccgcggtgttcgcctttaaatttcactaaaagccggagatgtttttcggcaatgtcagaacgttcctcaagtgtaggcggagcaagttcatcaccggttttcagataatgaagcacagaactaaacaaccaagggtttccctgagctgctctgcctatcattataccgtcgcatccggtataatcaagcatatattttgcggatttgccgtcatgtacatctccgttgcctattaccggtatttttacagcttcttttactttttttattatttcaagattcgctttgccggaataaaattgtgctctggttcttccgtgtattgttattgcgtcagcgccgttgttttctgctgtttttgcaaactcaactgcgtttatactgtcatcgtcccagcccatcctgaattttactgacataggacaattgacggattttcttactgcactgataattttacctgccagttcaggatttttcattaatgcactgccgtcaccgttatttacaatcttaggtgccggacaacccatattaatatctatcatgtctgccccgaattcaagtgagcgttcagcaatttctgacattacttcaggttcgtgcccaaaaatctgagcggcggtaggtttttcaaaattcaaaacttccagcaaaacctcagtccttttatttttatacagaagcccctttccggataccatttccgtatacatcaaagcaggaccgaacggctttgttatgagcctaaacgctttgtccgtcactccggccattggtgcaagtattatattgtttttaagatttaaagttcctattttcatatcgtttctccttgcggatattatacactatatattgtgatttgccaatatgaaatattgacataaagagacattattgatataatacccgggttagattttaacaattatgaagaatgaaatttaagggttgattattttgaaaacaaaaagaatagtaataaaggttggaacttctacgcttacccatgaaagcggaaaattaaatctggagagaatagagaagttggttcgtgttatctcaaatattaaaaatatgggtcatgaagtaatattggtctcaagcggcgctattggcgtcggagcagggaaagtaggtttgaaagagaagcctgattcagtcagaatgaaacaagccctggctgctataggtcaggcaagtttggtttctatttatgataaaatctttaaagaatacggatacagcaccggtcaggttcttttaacaaagtttatccttgatgaggaaactagatataacagcgctcgcagggcttttgacgctatgatttcatttggcgttgttcctatagtaaatgagaacgatgtgatatctacttatgagatagagtttggcgacaatgatacgttatcagctacagtagccgaacttgtcagagccgacctcttaataattctttcagatattgacggattttacgacagcgacccgaggaaaaataaagatgcaaaaattattcctgtagtgtctgaaatatctgaggagattatgtcgtgtgcaggagcggaaggttccagccgaggaacaggcggtatgaaaacaaaattaagggctgctaagtttgtgaatgataatggtatagatatggttttattaaatggaaatgttcctgaaaagatctatagagttttagaaggcgagaatatcggaacattatttaaacacaaagaaaaataattacaaataatatattggaactttttccatttttttacgtctaaatactataatatctatcgggaggtatttttgtgcgtaaaaaaatatatggtttgttttttccaaaacttattattgctttgctggtactggctgttatagcggtttggagcagtgatttgttttctgataataaatataatgatgtatgtgcagataatgagtattatgggcagtattctttgtcatatatgccaatttatcttgacggatatgaaattcaagggtattactgcgatgaaaaagtcttaatttctattgatgatatgactagatatggttttgaattaaattatgactcagagaaaaatgtgcttaatttaaggtcaacatctgaaattgctgtatatccatataaacaatcaatagctgtttcaaattacatagctgagccgtccagttttgatgtgcggataaatggtataaaaatatacgcttattgtcttgatggatatgcgtgtgtcagcgttgatgatttggtttatttaagtgatgaatataatatacaaaccggttggtctgattacaatatgtgcggcggttatgacgcttctgccaacgcttttaatataaactgttttaggtttaaggttaatgattgggctgaactgcttgctcaaatggaaagcaaagtaaatcagactgagatagacatatatactgaaggaaagcctgaagaagcaacatattacggagctaagctggaacccagaagcggtatatatgcaggtatagtcagcgacggcaacggaaatcccgaagacggttcgccggaaacatttcatcatgattttggagtgtattcatcatatttagaatttgatgattttcaaacccagcttaataagcccagcagttatattgtcccggagaaaaactgtataagccaggttccctggaatgttgtggatattaatttggttttggacagtgcaaacgatgaatacattaaagaaacattagataatatggctaaatataataagccgacaataatacgttttggcgcggaaatgaatataggatacctgggggattctcctacagcatatataaaagcttttagaaagattgcggatatggtacatgagtatccaaatttcgctgttatgtggtcgccgaatgacaatggttccctggacagaccgtttggatatttttatccaggagatgaatatgtagattggataggagtgtcatcatttttaaagaaagattttttaaacagcctggctgttgaagatggttctgaggtatgtactacgcgcgaatctcagatatactttaccttaggtgattttggctatacaacgaattcacttaaatatataactgattttatgaaagaaaataatattaataagccgcttgccataagcgagggcggtgttgtctctcgaatctcttacagtgatgaaaacatagatttgtggggagaaaagcgggtcagaaatatgtattggtatgcagctatgagattcccgcagctaaaaagtattgtatattttaatcaagatatgaaatcagaagttataggatttgacctttcatttaaacctaactacacgcaaattatagaagaagctattacaaccggtccatatctgctgtcatataatgaaactcctaaatatacatttgttaaagcggacggcggaagaacttataacagcgattatattccgatatacggatatgtctatcagccggaacagtatacgaattatgtagagtattatatagacggaaatcttttggatacgaaaacagaaattccttataaaacatatttgaataaaaattctgtttctgacggaactcatactttaactataactgctcacggtgcagcgtcagaaatatcaaaatcttatacattagtaaaagaagcagggaatatagtaatctattaataattataaaaaaaataactcgttgtgttaaggcaacgggttatttttaatgtataagatttaaattaattttacttaaaccgaagtgttattaataagctttattatttatatttgtgacagttcataaagtttgtcaaaaacaatttcgcggtcccagatttttaccgctttttctatattattaattccgtttctgtttttcgccagcggaagttttgaagtagattttgcgttatgaaggagttcctgtccttttttattaaaattcaatattttaatatattgaggtggtgttacagcgtcttcttttgttattcccaaaaatatattcattatgattcgtctaatcctgctgtgtgcataacgttttgattttatattatcacataattcagaaaaggtttttgaagaaaatgctgactttttaattttattctctaatccctcagagacgtcaggagtattccgaatcgcattgatgtccgattttattatatttgatattatagcagtatctagcttttcaatcctgtggagagatgaatttttgtataatgaaatacagttttcaggaaccgctttaatcatatttgagccatgaatatttaatatattccttatagcgcttgcgctggctatctcgccatgaataacggtatcattatgctccgactcatatctctttattaaaataggttcaatattactgtttaatttgtataatgctttgacatattcaatagcaagaatattattgggttcacttaaaatattagcatagctgtttcctaaaattctgtacacagcgttttttcttgctaaaaaaaacgactttcctgactgaagttctgattttagaatcattttaaattcttttggttcagtgtatagcaatgaagcagttttttgtatttctgttatttcagaatgttcggcgccgaaagctatgctgtcaataagccccaaagaatgtaaaatataaattgaattaaacgcaaaaatttcagccgactgcattgaatgaacagcaggcagttctaacactagatccattcctgattgaacagccgccaaggcacggacagatttatcatacacagccacatcgccgcgctgtgtatagtttccgctcattataccgacaacagcgtcaaaacctaaattttgttttatatagtcaatctgatatttatgaccattgtgaaatgggttatattcacacacgattccgcagactttcaattattattcctccaacataaaagagcaatttttataaaatataaactaaataaaattatatcctactaatgtttatatgtcaatataggctattttatttcagaaaagctgttttatttaaaattttaatgtaataatttaaaaaactggttataagtattaaaaaaactatggtttatagcaaaattttttatatttaatacttgaaatcgactttttataggtgtataatgtaacagctgagtatcaaaaattaccatataaactggaatttttggcttattatgattttgtaaaataattatcaatatacacataggaaatgaggtttaacaaatgtcaaaattcatggacaagattaaggaaactgccagggcggataagaagactattgttcttgctgagggagaggaacgcagaacgattgacgcagcagcccaaattttaaaagaaggatatgccaatatcatacttttaggcaatgagtctaaaataaaaagtatggcggatggacttgatatttctgaggcaactattattgaccctgacacaagcgaacttacagaagagcttggaaacggactttatgagcttagaaagaaaaagggtatgctgccggctcaggctgctgagaaagtaaaagacgtattgtattttggctgtatgctggttaaaacaggcagagcagacggtatggttgccggcgctgttcacgctacagccgacgtaatgagatcgtcattgcagacaattaagactgctcctgacactaaagttgtttcagcatttttcttaatgatggttcctgattgtgaatatggaaataatggaacatttgtattttctgactgcggacttaacgaatatccggattcagaaaagctggctgaaatagctatttcttcttcaaagtcctataagagtcttgtaggcggagagccaaaggttgctatgctttcatattcaacttacggaagcgctaaatcagaacaggttgatttggttaagaacgcagctgataaggctaaagaattagctcctgacttaaagcttgacggagaacttcagcttgacgcggctatcgttccaagcgttgcttctttgaaagctcctgacagcgatgttgcaggtcaggcaaacgttttgattttcccgaatcttgacgccggaaacattggctataagctggttcagcgtttggcaaaagctgaagcatacggaccaatgactcagggaatggcaaaaccggtaaacgacttatcaagaggctgcagtgcagaagatattgccggagttgttgctattacatgtgtacaggctcaaaatcaggattaattatattatcggagggtgtaaaataaatgaaagttttagttattaacgcaggtagttcatcacttaaatatcagcttatcgaaacagaatcggaaaaagttttggctaaaggcttgtgcgaaagaattggtcttgaaggttcaaagcttacacatagccctgagggaaaagaaaaatatgttgaagaaaaaccgatgccaacccacaagactgctgttcaaatggttttggacgcacttgttgatgaagagcatggagttattgcagacataaatgatatttccgctgttggtcacagagttctccatggcggacagtattacagcgactcagttgttgttaacgatgatgttaaaaaggtaatcaaagattgtttcccattgggacctcttcataatccggcaaaccttattggtattgaggcatgtgaggacgctatggccggaactcctcaggttgcggtttttgatacagcatttgggcagagtatggagcctaaggcgtatatgtatgctataccatataaatattacgagaagtatagtattagaaaatatggtttccacggtacaagtcataagtttgtttccggcagagcaattaaattcggggaattagataacagcaactgcaaagtaattgtgtgtcatttgggcaatggcgccagtatttctgcttctgtcggcggaaagtgtgttgacacaagcatgggtcttactcctcttgaaggtttgataatgggaaccagaagcggtgacattgacccggctgttgtacagtatattgccaataatgaaaatttgtcggttgatgaagttttgaatatattgaataaggagtccggtgttttaggtatctccggcgtatcgagcgactttcgcgatttgtcagccgcagcacaggaaggcaataaaagagcacagatagctcttgacgcgtttatttaccgcgttgcaaaatatgttggttcatatgttgcagctatgaacggtgttgacgcaatagcgtttaccggaggaataggtgagaacgactgtgatactagatataaaatttgtcagtatttaggatatcttggcataaagattgatgaggaaaagaataaggagagaggtaaggaaatctacatttcaactcctgattcaaacgtaaaagttatggttattcctacaaatgaagagcttgcaatcgcacgtgagactttggatttagtaaaataattcacttattggttaaggctgtctcgattgagacagccttgcttttaaaaatgaggttgatattatatggctttaaactattatgaaaatatgactgatgaagaaatagtgtctttagcggaaaaggataggtctgctgaggagttcttgctgaataagtataaaaacctggtcaagtctagagctaaaatgtattttttggcgggtggagataacgatgatttgatgcaggagggcatgataggcttatttaaggctatacacgattataattcggataagcaggcttcgttttatagttttgctgaactttgcgtcaaacgtcaaattttcactgctataaagacggcagcaaggcagaaacatcagccccttaatacgtatatatctttaaataaacctgtgtatgaggacgtctctgagagaactttagttgaaaccttggcagaaagggaatctgtggaccctgaaaagctttatataatgcatgaaaaattaaaagatatagagaaagaaatagatgaaaagttgagtgatttagaaaaaagagtgttgattttacatcttcagggtatgtcgtatcaggaaatttctgaaattattaataagcctacaaaatcaattgataatgcacttcaaagaattaaaaaaaagctggatgaaaagtaaaaaaattgtagagcaaaatatctgtagtaattttcaaaaatttatttataaattataatttttttgaaattttacacttttattttattatacttttctttaaaatttaaataaatttgtgttaagaaatattattatccacttttagaatatcccgtaaaatcagttatcaacagagttattcacattatccaccgtttttatatagtaaaaataactaaaatcactgatttttaaaagttatccacaatttgcgtttttacgggcaagtccctcacttaaataaaaaattttgtttaaatttatttttatattttatattcacaattatttaaattattgaaaaatacagatatattgttctttttaatgttgttttttgtctactgagaaagatattattttaaattaaaccagttttttcataaaataccttgaactttgcaagactttaatatataatatcttaagttatattttttaagttaattatgttaattattatttttatatagaggagtatagtatgaatatttataagttatctgaactgacatctgaaaagagagaattcataatgaaacgcgctgaatctgacatttctgaacaaatgaagattgctaaagaagtttcggatgatattagaaagcgcggggatgaagcagttttagaatataccgctaaatttgaccatgtaactcttagcgcggatgaaatgaaggtaaaacctgaagagattgaggcaggttatgagcgcttggatgcagaaactagagaagcaattgaatatgccgttaaaaatattagaaattttcattcaaagcaaatgcctgaagagatgtggtttactgaagtggataagggtcttttggttggtgaaaaaactactcctatcgtagatgtttgtctttatgttccgcggggcaagggaagcttcccgtctgttttatgtatgttggctacacctgctgttgttgccggcgtagaaaaaattgtagttgttacaccgcctaatgaggaaggaaatgttgatgacgcaattcttgcggccgctaaaataatcggcgttagtgaaatatataaggtcggaggaattcaggcagtcgcttctgttgcatacggaaccgaaactattccaaaatgccataagataataggacccggaaacgcttatgctacagcagcaaaaagagttttgtccaactatattgattcaggtttgccggcaggaccaagcgaatgtataatacttgctgatgaaaacgccgaccctgaaaaggtggctttggattggatgattgaagcagagcatggaccggattccgctgcacttttagttactaattgtgaagagttggtttataaagcggctgaaattgttgaaagacagctcgaaaaaatatctgataaaagacgtgagtttgtaactacgaatttcaatacatacggcggagctattataactgaaagtcttgaagagagtattgattttgtaaatgactatgcaccggaacatatggaagttatgacaaaggaaccgtttgtggttcttcccaaaataaaaaatgcgggagaaattctgctgggagattatactccggtcacattgtgtaattttgttttaggtccgaatgctattttgcctaccgggcagtttgctaaaacctattcaagcgtttctgttatggacttcttaaagcgttcttcggttggttacgcaagccgcgacggctttgaaatggttagggattatgcctataagattgcaactgtagagggctttgatacccacgctttagcagttaaagagagaaaataaaattgagcgtacgcgaggattttactatgaaaaatagaattactgtaaagagaaaaactactgaaacttcaattgaggtagtaatagaaaaaggtgagctaaagcctgactatagaaaatatattaaaacgccgctgccatttttgaatcatatgattgagcatattgcgtggcgcgcatcacttaatatcagcattgatatggattttgacgaatttgaactttgccatttggtgtgtgaagatgttggaatgacgcttggaaaagctgtcggggaatatataaatataaattctccatcaggttatggttttgcgacggggattattgatgaagcgtgtgcagatgcggcaatttcatttgaggacaggtcgcagcttacgtttcaaaaatcaataaattattgtgagaatgttgaagggatgccaagcgaagagcttattacttttcttgaaggatttgctcagggagcaagatgtactctgtttattgatttaaaatccggtcagaacggccatcatatttgggaagcagttttcagaggtgttggaatcgctctcggtcaagctttgtcatttgattcttccagagaagggttaacctccggcgttgcaggaaaggtagaatatgaagtttcagccgaataattttgacaagataatatttgatatggatggggttgtaacaagcgaatatatttattgggatgcggcggctttaacggtatatgagcttttatacagccataaattctatggattgagtgagatagaccataattggtgttacggcaactttaaagagcttcacaaaataattttttgcggagataaaactataaaagccgtgaaagcattaggagtaaatacaaattgggatttagcttatatagttttttgtgtttcaaaatatctggagccggatttgacagaattcaacgaatggcattttgagtcagttcgtatgtttattgaaaatatcacggttcaggctcctgaggtctacaatctcgtgggtgaacttgctgctgtatctttaaatagtgagttttccgattttaagcgaggcaggagcaagttatgggatgatgttattaactgttttcaattatggtttttaggaggggaatctgtccccggtcttaatactatggaaaaacctttggtagatttgaatgatttaaaaaagacttttttagatttaaagagcaagggaattagtttggggataggaaccgggcgtccaaaagatgaaattttgtttcctctgaaaaagtggggattaatggaattcttttctgacaatatgattgttacatatgacgacgtattaaaagcggaagaagattttaaacccgaaactcctttgtcaaaaccgaacccgtttgtgtttttaaaagcggcttttagaaatgaactggatgatgagaaattaatatccggtaattatgataaagagagatgtttaaaaattgctgtagttggagacgcgccaagcgatttgatggcggcaaaatcagcaggtatggtttttgtaggtgttcttaccggtattgataggaaatctgctaatgaatattttttaagccataatgctgattatatatttgaagatgtaacacaacttattgacgattaaatatttttgtggggattattatgcaaataaaaattgaaacaccattaacaagtgaaaaggtaaaatctttaaaaagcggagataccgttctcataaccggagaaatttatacagccagagacgcggctcataaaagaatgattgacgccttgaaaagcggagaaaaactcccttttgaaatagaaaataaaataatttattatgctggtccaacgcctgcaaaaccaggtcaggttattggttcgtgcggtcctactacaagcggaagaatggacgcgtatgctcctgaattgataaaattaggtcttaccgggatgataggcaagggtgaaaggtcagacgatgttgttaatgcaatgaaagagtatggagccgtatatttcggagctataggcggtgccggcgctttaatagcgaaaagtattaaagctgcagagataatagcttatgaagaccttgggactgaggctgtcagaaaacttactgtagagaactttcctgctattgttattatagattctaatggtaaaaatttatatcatgatagataataaaaaataccggtatgaaaaccggtatttttttaatttttatcaaatattttattcatcatatttttaatattttcttttcttaaagatgtttcatctctgtcaattgttatattaattacatcgccttcacgggcttcgggcggaatcaattcaaccggcatatcggcaaaccctgaaccttcatcaaattctacaactgcaaagtttccttcaaatctatcaataattattttcatttaaaatatctcctttaatattctctatatacattattgccatcgcttgcaaaaattattgttccgtcagtatcagttctgaatgtctttatacccatattgtttaaagtatttaaagtttgttctgtaggatgaccgtatttattatctgcgccgcaggatataaccgcaaacgtcggatttaccttgcttagaaacgcttgctgactggatgaagaagaaccatgatgtccaatcttaatgacgttagcccaaagagattcaatgttatagtttgataatatttcattttcagattcaatctctgcgtcacccataaacaaaaacgctgtgtttccaaatgctattcttattacggcagaataattgtttaaatctttatattcgttactgcttggagccagtataaaagctgacattgtattttcattgaatattgtaactccggatttagcttcaactacatttatatttttctctattatagtgcttaagaattgctcatatgttttggtagtggttacggcgtttggcatatataatgttccgatttcaaaattgttcagaacttcattcataccaccaatatggtctgcgtgaggatgagttgcaaccaaataatcaattttattatatcctaaattttttataaaactgcatatttcttcgccgtatttagaagttgacgcgtcaatcagcattgtttttccgttaggaagcaaaacaaattcgctgtcaccttgaccaatatttaaataatacacttttacaaacgaattgccaagcgcaacatcgcttggcaactcttcattgttattattgactgaatccacatatgctgtattatcattaggaaaagctctgtatagtattgcagcaacttcgcatcgtattatagggtctccgccttgaaatgttccttcttgagtacctgttatataaccttgtttaacagcttctgctatataaggacgatcttgtttaggaatggtattataatcgtaaaacacatctgataacaagctgtcatcaacaggataatattcggaaaggtcataattcataactttcattaaagcaactgttacgtcctcacgggtagcattatcccaaggcttgaaatacagtcttgaatctcccggagatgtgctttggtatccaggcatttgctgagttattgaattgatataaggaaaagaccagtcattaacatcaacgtctgcatatgggcttgtgcgttttgtggaaagtttaagtccggacgcattaacaagcattttggcatattcacatctggcaacatagttctgaggtaaaaaagttccgtctccataaccggaaataattccgcgtgattcaagatttgttatgtaaggcgccgcccaaaagtcatcaggcacatcataaaacgatgttgcatatgctgagaaactgccgaaacacataagtaacgtcaaaactgcaatagtgacagaccatgtaactctttttcttaacattacaaattctcctttttcgtttaacaatataaatattatctaaatacaatttcaagcaaggattatatcattagtcttattatttgtcaagttttacggaaaaatggagttataataagactattaaatattttatattataatatgactgattcaacaagacaaaagttcctgtatcagccaaaattatttattgctgttgcaaaaaataacatatataaacaaagtaaagtgttataaaataaaaaatttaagtttgatattttttgttttatactttggttatagataaaagtatattgtttagaaacaaattaatttttatttgtctttattctcattattttatataagaataaaattaatttccgtacccaatacttatctcgttaaatatgtgtaggtaatcatcaatactttttttgtttttttcttctgatttgacatccaaaactattttaccttcatgcatcattatagttctgtctccgtatgtcacagcgtgtttaagattatgagtaaccataagagtagtaatatttttttcatctactactttttgcgtaagattcataatagtgtcgcttgatttggggtcaagcgccgctgtatgttcgtccaaaagcagtaaatcaggttttgataatgttgccataatcattgacagagcttgtctctgacctcctgaaagagaacctgccaatgtatccaatctgttctcaagtcccatacccaataattcaagctgttctttataatatttttcgcgcttatgatttaaaccccaagataacccaaatgattttcctttgttatcagctattgacagattttctaaaattgtcatagaagagcaggtgcccatagatggattttgaaaaactctgcttaaatatttggcacgctggtaatttttttgtttaactatatttttaccgttaattattatttgtcctgaatccgctttaatatcaccggaaataagattcagtatagttgttttcccagaaccgttagaaccgattatacatacaaattcacctctgggaacgctgaggttaaagtcattaaatattactttttcatcaattgttccccggttaaatgtttttgaaatattttttatttcaagcatcaggtctcactccaattcctttgtcacgtttaaataagatattatttataaccaaaataaatataaataggactgtaataaccaggttggtatctgttgccatcaggcctgaagcaatagcggcgtatgttaaagtcttatatattatcattcctataataacgctggtcgtgatttttaaaaatctcattttcttaaaaatagttgctcctataattactgcagctaatcccataactaccgttcctgtgccgcctccaacagaaaactgtcttgtatattggcagtttacggctcctgccagtgcaaccagaccgtttgaaatagccagtccaagaatttttatgtttcccggatttttaccgagggtaacaacaagactttcgttatcaccaacgcttcttaaaagaaatcctgattttgttttgagataccagtcaagaagaagttttgatactatagttataaaaaacataataataagcttgctgtataagttaataggggctggaagcatacttgaaaaactggaaaatatagtattgtcagtcatacttataaaaactgttgatgagccggctattctgtaattaatggaatataaggcggtcatagttaatataccgcacagcagatttttaattttaagccctacatttaaaaatcctgtaaatgctcctgctgcacagcctgataaaaatgctaatattaaacttagccacggatctattcctgcggcggaaaccgttatacataaagcggctccaagcggaaaagtaccgtcaacagaaaggtcaggaaaatctaagattttatagcttatatatactccaacagccatgatgccataaataaaaccttgctcaagtatgcttgtaactataccaaccatatatttatctcctatttacttttttcagcgttttccaaaatatcatcgggaattactatattcaaatttgctgctgtttcttcattaactgcaatttcactttgattaattacctcatatggtattgtgctgatttcttcaccttttaatattttagaggccataattccggctttttttccgagttctatataatcaacacctgctgaggcgagacatccgcctgtcacttgtctgctttcggaaccaaatatcggtatattggcggcattagccttttcaagcataacagggagattatttacaacgatgttgtctgttagattagatatgcagtcagcttgtccaagaacaatatctatcgcctgagaaatttctgatgcgttgctgatacctttttctataatctcaaaaccaaattcactggctttttctttataaatgttaagagtgctttgagagtttgactcatttgttgtatatattattcctattttttttgcgtcaggcagaatttttcttattaattcaagctgcttttctacaggcggctggtctgatactcctgtaataccatccataggttctgtttcgcttttagctaaatttgctttaacgggatcagatacagcaccgaaaaccaccggtattttattttcataacaataattatatgctgtcattgccgatggagtagctataccgaaaactaggttaacttttgagtttacaaaattttgaactatttgtgtgtttaatgaactgtcaccctgagcggatttctgaataatttctaagttgtcgccggacacaaaaccttcatttgcaagtccttctataaagccggttttgcagtcttctaatgttgtatggtcagcatattgtactatccctattttatatttatctgattgttgtttttttaaatcattgccgccgaaatttgagcatccgtttataaaaagtatagatataataagtgcagataaaataaacttttttgaattcataagctgctcctctcaaaagttaagtattaaatttttccataataaaaaacaccttatttattaagtattccaattacataaaaatacattcttaaattttatatttaaaattttatggctaaaaacttttattgtttatttgattttaaaaatatatttaattatttttttacgtataaaaatattttgttttttggagtatttataaatatttattaaatgtataattaaatcaattttaaagtgtttatgtcacattttatagataaaatatatgtgtatgtattttttatttattttctacaagaagaatatattttttttgtcaacattgcttattgataaaaataaataactgagttattataagtttgtagatttcataatatatgcagcctccccgctgcacaaagactgtgtcaaattggcgcggtctttgttttatttatattttaaatattgattgattttatataatatagatgttataatattttttaatgcattaattttttattaaaaagagaaaggagttatggcatattagtatgccatatgtttcaggaatgagattttatgaaatagttttaattgctgttggtcttgctatggttgcttttgcggtttctgtctgtaaagggcttaaaatgagtaaagttgactataaatatacttttatcatagcattattttttggagtatttcaagctgcaatgcctattataggctggtttgccggaaaacagtttgaggcttacataaccagtgtcgatcattggattgcttttatattgctggcgtttataggcggtaaaatgatatacgaagcaataaaaaatgaaggtgaagggtactgtgatttaaaatacgattttaaagaaattacattgcttgcttttgccacaagtattgacgcgctggccgtaggaatttcatttgcttttttgcaggttgaaatatggtcggcggcttcatatataggtgttattacatttattctttcaattattggagtcttagttggaaatcggtttggagttaagtttaaatcgaaagctgagtttgcaggaggaataattttagttttgataggtataaagatacttttagaaggtttaggaatattgagtttttaatttaaaatagatcggtggtaatgatgtgaaggaacaattgtatacaattccggtgaatgaagcgattgataaaaatgaagaatgtttattctgtactttaaataaaaaggtggaagaagatatattgaattatattttgggaccttcatatatggaagaagatattaggtctgaaaccgacaaaattggtttttgtaaaaagcattattcgcaaatgtataaagcgcagaatcgtttaggtgtagctttgattttaagtacgcatatgaaaaatatcagacaaaatttgaatgatatttttaaggatgaattaactgaaatcaatcacactattaaaaaaaatctgtttagaaaaaatgaggaacaaacaaaatctgttgaatacatttctgaaatagaaaattcttgttacgcttgtaaaagaatggaatctcgaatgaatagttatattgatacatttttttatctgtggaagaaggaagatgattttagggaaaaaattttaaactctaaagggttttgtcttgaacattttaatatgattattaaagagggaaaaaagaaactaagttcagataaatataaagattttttgaccgtgttggttccgcttgaacttaaaaatttggatttgcttcaagaagatatagattggtttatacaaaagtttgattatcgctttaaagatgaaccatggaaaaattcaaaagatgcacttcaaagaacaatattaaaagtttcttcggagaatgttgaggaatagtccggattaaaatcgtgaggaaatacaatggatattatagatataattataaagcagaaaaatggtattgatctttcagattcagaaattgaatacttgattaacggttatacacaagggataatacctgattatcaaatgtctgcttatttaatggccttgtgttttaccggggcaaatgaaaaagtaatatcaaagatgactatgtgtatggctaattcgggagatatacttaatctttccggtatcagcggaacagtagtggacaagcattcaaccggaggagtaggagacaaaacaaccttagtagtaggaccgtgcgtggcagcgtgcggcggcaaggtggcaaaaatgtctggacgtggtcttggatatacgggtggaacaatagataagctagaatcaatcaaaaattttaatacacaaataccagttgaacgttttatagatataattaatgaaattggtatttctatcgttggtcagttgaaaaatcttgcccctgccgataaaaaaatatattcattgcgtgatgttacaggaactgttgattgtattccgctaatagcgtctagtataatgagcaagaaaattgcatccggtgcaaatgctatagtattagatgtaaaatatggcagcggtgcgtttatgaaaacgtataaaaacgcaaaagagcttgctgaaactatgataaaaataggaaatcagaatggtaaaaaggttaaagcactgcttacagatatgaatgagcctataggaaatacagttggaaattcacttgaagtgatagaagctatacagactctaaaagggaatggaccaaaagattttttagaactttgtatagatatttcaagtgtaatgcttcagcttgaatttgttgataaatcggtagatgagtgcagaaagatggcgctggacagtattgaaaatggaacggcactgaataaattcagagagttggtatttttgcaaaacggagatgtagaatgtattgatgatacaaataaatttccaaaatcaaaatattctttagaagtaaaagctaatatgtcaggtcaaataacaaagatggattctgaaaagattggtaaaactgcatgtttgttaggagcagggagacaaagcttgaatgataaaataaatcattcagcaggaatttttataaataaaaagactgatagttatatttcaaagagtgacgtattagctgttctatacacggataaaaaagaaattttagattttacaaaagaatattatttagacagcttaacgatagaatgattatattttgtgtaaattggatcggaggtaatattggtgagagttgtaaatgcgagtcagatgaaacagatagaaaaaaacgccaacgatatgggaataacatattatcaaatgatggaaaatgcgggaatgtgcgttgctgattttgtacgtaaaaatataaaagattttgaaacgaaaataatattgattctaacaggaaccggaaataatggcggagacggctttgtcgctgcaagaataataaaaaagtttggtggaaacccactaattatgatggttgacggacctcctaaaactatagatgctatcaaaaactttaataaagctaaagattgcggaatagaaataataacttttgaaaaagataaaagtattcccataatttggggaagtgacgcaattattgatgccgtttatggaacaggatttcacggtgaattaaatgataatattaaatcattattttctgcaatttctgacagcgatgctataaaatttgcaatagatattccgagtggagtagatgattcgggtgaaatttctgacggcgctttcaaagctgattttacaatagcattagatagtttgaaaaatgctcatatgaaagaaaatacttttgaaaactgtggaagagtagtatgcgctgacattggaataccggaagaatgccataaaatataattttataaataattaattatatatttaaacgtaataaagtcagttttaattattaaaactctgttgcatataaattattttttataaataatgttaaagaaaaataagattgaattaattataaaatttggcgattattctttaataaaataattaattcgtgtgataaaaacgctgcgctttaaaaaagcgtgacgttttttctatttataaataaaaattttgttttcaatatataatcagtaacatttgtatactaaaaaatgaataaaagtataataaaaatattttttaaatgatattaaacgttgtatgaaagatcaatatattatttgaacagcatataaatattataaaatatcaattcgtttgactttaaatatatatagttttaattcttgtaattttttataagttacttttaaaatattttaaatagttttaatgtaatctataagttgttaggagtattttatagcattcttgacttttattgctttaattaatataatattataatgaaataaattaaattgaaaaggaacttaaagatgaataaaagtttttatgaaaaaaccagtcctgaaaacgcaaacattaattccaaaagaattataaattttataaataggttagaaaaagaagaagtagatatgcacagcatattgataatgaggggaaataagctgatttgtgaagcctattataatccatttaattcaaatactcttcatagaatgttttctgtcaccaaaagtgtggtatcaatggctattggtgccctagccgaagacggggttatagatttagacgcttcaataactaaatattttccggaatatgaacctgaagatggattttatccttatcttattgaaacaacaattcgcgatatgctttctatgacaacgcctcataacggaacaacatttgataaacgcagtaaaaataattggacggaatcatattttacaaagaagcctactcataggccgggaactattttttcttatgatacatccgcctcacatgtaatggcagctttggtagaaaagttaacaggtttgtctttgcttgattatctgagaacaaaaggtttgtcaaaagttggtttttctaatgaatcttattgtatttcggatgggtgtggtgtaagtcaaggaggatcaggtatgatggcgtatcctaaggatttactgcttttagctaaacttgcaattgattatggaaagattgataatattcaaattttacctgaaaaatatttaagagaagcaacaagttataaggttgcgaattttgtaaagggaagttttttagctgaaatgcaaggatacggatatcaattttggatgaccaaaaataatgggttcatgatgtatggaatggcaggacagttggcattatgttttccggataaagatttaatacttgtcacaacggctgacacaaccgatagaaaaggcggcgtacaacaaataatagacgcattttttgatgaggtgtattcatatatagacgaggaaaacgagtttgataaagattcatatttaaaactttgtgagatatctgataattgcagtctcaaacctcttaaaaataatatttcagttgagcttgataagacatatgagttttttgatgataatagtttagaaataacaaatgttagaattattaccagcgtcagcggcggaaaaattatattagataatacttatggcagtcagattataaaatttggatttaattcatttttggacgggaatttcagccattatgattgcccatatattgcttcaggatgctggacagataaaaatactcttgttgttaaggctaatcttatcggagaatgtataggaaaagttataatgcagttttcatttaaaaaggatggagctgttacaatattttccagaaaaactgaagaaatattatttggtgaatattccggttttgctcaatcaaattagattaataattcatactgtgttatttttatatttgtatattgttaattgacatgaatattaatatgtaatataattacattatgatacttttaaaaaggagctaattatgaaaaaaatattttgtaaagtatttttttgttttgttattattgttttaagttcaatatttttgatgagttgtggaaaaagtgccacaaatccggataaaataacagacaataatatttcagaaaataccggtaatattgaaaaatatgatagtgcaataaatgacgagagcaatactgttcttaaaaatgatgttgttgctttggtaaacggtgaagaacttaaagctaaagattttggatattatatttataacaatgctgttatacaaatgtataaagaggacagtaataccacggaggatgttacaacatttgattggtctaaaacaaataaagatgggaaagcattacgtgatgtagttgttgagaacgcaatagaggatgcgataaacgatgttgtgttcagacagtcggctgagaattctgggtttctcatttccggtgctgaaaaagaagccgacgagcttgtaaatggttcaattgaacgtcagggagaagaacaatttaaagtaagtgcgaatttagttggtgtgagcgatgctgaaacatataaaaaaatttatactaatatttctgtttttgaaggcgttgctgaagactttcagaataatcccgaaaaatatgttactgatatttccgtattatctaattatattggcaataaaggcgcctctgtacagcatgtgcttattttaaacgatacagatgacgcttctcaattggctgaggacgttctccaaaaagccaaaaacggtgaagactttgtggagcttatgaaacaatataatgatgataccagcgaaaaagaatccggatatacatttcctgagggagaaatggttccatcgtttgaaaccgctgctttttctttaaaaataggtgaaataagcgatatagttgaatctgattacggttttcatataataaagagaattgttggtgcatatgagcttcaaaatttttggaggtcggaagcagatgttcaaatatctccgaattctctgcaaatggttaatttttacgatgtaatggatatgattaaagaagctaaagcaaaaaatgttggttagataggttagaaaaatttatataaggatggtatattattatggaaaacaaatcaaataaagtgttggttgaaatggaaagcggagattcttttgttattgaactatatcctgagtttgcgccaaaaactgttgaaaattttaaaacacttgtatcaaaaaagttttataacggtttaacttttcatagggttatagatgggtttatggcacagggcggctgtccaatcggtaatggaacaggcggaagtgatgaaaacatagttggagaattcaagcagaatggttttgttgataacacattaagtcatacaagaggtgtagtttcaatggccaggtccatgagtcctaattcggccagcagtcaattctttatatgttataatgatgcgtcttttttagacggtcaatacgctgcatttggaaaagtagttgaaggaatggaaacagttgataagttccttgaaacagaaagagtaggtgcggagggcggaactccggttactcctatagttattaaaagtatgagttttgccgaataatattatataaggtgattttgtgaaaataaatgtacctgaagaagtaaaaactataataaaacgtttgaattctcaaggtttttcggcgtatgttgtaggcggatgtgtaagggattcaattcttaacagaaaaccacaggactgggatatttcaagctccgctaagcccgaacaagtaaaagaaattttttatgatatgggagttatagaaaccggaataaaacatggaacggtatctgtaattattaatcataatccgtatgaagttacaacatttagatgtgatggtgaatataaagataacagaagacctgatactgttacttttgtgtctgacattgatatagatttatccaggagagattttacaattaatgcgttggcttgcggctgtgaagatagcagtgaggttatagatctttttggtggaattgaagatataaaaaatggtatagttcgctgtgttggagaaccggaaaaaagattttctgaagatgctctgcgtatattgcgggctcttagatttgcttcggttttaggatttgatattgataacaaaacttcaatagctattcataagcaaagggacttgcttaaaaatatttccgttgaaagaataatgtctgaatttaaacagttagtttgtggtatcaatgcagtaagtataataagagaatttagagatgtaatcgaagtttttatacccgaaattactgctatgtttgaatttaatcagaatacgccgtatcattgctacgatgtttgggaacatactttgcactctgtcgaaatgatagaaccggaagttgatttaagatttacaatgctttttcatgatattggtaaaccaaaagtttattcagaagaaattttagaaaatggtaatactttgggtcatttttacgcacatgcaaaatattctgaggaaatagctgcaaagatattaaatcgtcttaaatcagataaccgtcttttgcatgatgtaagaaacttggtaagaatgcatggcgatcaaattccattatcaaaatcaggtataaaaagaaaacttaataaaataggcgtagagttatttagaaaattattgaaagtaaaacgcgccgatgttttggctcagtcgcctggattggctgatgaaagaataaaagctcttaaagatattgaaattttatttgatgaaataatatctgaagaagaatgttttaaaataaaagatttaaaaataaatggcaaagacctaattgaattaggtttttcaggttgtgaaatcggccaaactttaaaaattattttagatgcggtagtagatgggaaaatagataatgatagggataaaatctttgaatttataaaaatgatttaatccgttgttttataattttcatattttgacttgatttttatttatattttatatataatgtgtatcatgaaatttttataagatttatgtttagttgatagatacatttggttaggagttttatatatgaaaaaaaggtattcaattggtatagattatggttctatggcagggaagtctgtgttaattgatgttgatacaggtgacgagattgctgtgtcagtttttaactatccgcactcggttatgacggaatgtcttcctgatggcaaaacaaaactagaagatggctgggctctgcatgacccgcaggattatcttgacgtattggcctcaactataccagctttgcttaaagaaacggatattaatccggcagatgttattggaataggtgttgattttgcttcatcgaccgtcatgccggttaaagaagacggaactcccatatgttttatggaagagtataaatctgaacctcatgcttatgttaaactttggaagcatcatgcggctcaaaaatatgctgatagtttaaataaatacgctgaaaaaacaaatgaggactttttattaaaatacggcggaaaattttcttcagaatggttagttccaaaaatttggcaaatagcagaagaagcaccgcgcgtttatgatgaaatggacaagtttataggggctgctgattggatagtttggcagctaacagggattgaaccgataaatactcaaggaatagaaaacacgctgccgtcaaaagagtttttaaaatcacttaacccaaaacttgaggactttgttgatataaaatttaaacgcaaagtttcttcaattggtaaaaaggctggtgaactaaaccaatttgcagctggacttacaggtttgaagcaaggaacagcggttgcagtcggaaacattaatactcaggtatcacttccggccgtagggatagctgatccgtgcaaacttcttatgataatcggaaagtctgcttgtgatattgttttgggggaagaagaaaaaaatatttccggtatttactgcgccgataaaaatagtattattgacggatattatggctatgaggcaatacaatccggcgttggcgaacattttgattggtttgtaaaatccagtgtccccgaaagttattatagggaagcgaatgctcttgatatgaatattcatcaactgctgtgcactaaagcaagcaaacaaagacccggcgaaagcggattgcttgctttggattggtggaatggcagccgaagcgtattgatggataaagatttgtccggtgtaatgctcggattaaacttacaaaccagacccgaagaaatttatagagcattgcttgaagctactgcttatggtgctagaatgattttagatactattagagatgctggaatacctgttacagagctttatgctgccggtggagttgctcagaaagacgcgtttataatgcagatatatgctgatgtaatgaatatggacataaagattgccggttctgttcatacacctgctttgggttcagcaatgtcaggtgctgtcgctgccggaaaagaaaatggcggatatgacactattgaggaatgtgcgaaaatattaggaaaaacaaaagctcattattatcgtccaatacctgaaaatgttgagacttataatgagttatataaagaatataagaaacttcataattattacggtaaaggcggaaatgatgttatgaagcgtttaaaagatataaaaatggcattaaaaaattaaatgatttttaaaaagaggtaaatcaaaatgttagaagaactaaaacagaaagtctatgacgctaatatgatgcttccgaaatatggtttggttacattcacttggggtaatgtttctggaatagacagagagaaaagtttagtagttatcaaaccgtcaggtgttgattatgataagttaaagcctgagcatatggttgtggtagacttaaataccggcaggattattgacggaaatttaaaaccatcttctgatacagcaacccatcttgaattatataaagcttttaaaggaattggtggtgttgttcatactcattcgtcatatgctacttcgtgggcacaggcaggcagagcaatcagagcttacggtactacgcatgcagattatttttatggagatattccttgtactagagctctgactaagatggaaatagagaacgactatgaattaaataccggaaaagttattattgaaacatttgagaataaggatccggaagctattccgggggttttagtatttaatcatgctccattttcgtgggggttagatccagctgaagcggttcataatgctgtagtgttggaggaagtcgccaaaatggcttttcgctgcgagataataaaccatgatattactagaatgggtaaatatattttagacaagcattatcataggaaacatggcaaaagtgcctattacggacaaaataattaaactttacggagaattttatgggtaaatttattgtgtttgaaggtcttgacggctgcggcaagacttcacagattgatatactggcaagacggctaaaagaaaaaggtgaaaaagtctatgttacggctgagcctacaaattatgaaaccggattgtatttaagacgaattttgtcagaaagtttggaaaaagatatatatttgttggctgctttattcttagcggataggattgaacatataacgcatcccgaaaaaggtataaaaaagtatttagatgatggttacacagttatatgtgacagatattattattcatctctcgcttatcaggggaaaaatccaaattgtaattttgaatggatacttaatttgaaccttaactgtgaaagattgttaacccctgacatttgtttgtttcttgacgttaacccatcaacatgcaaagatagaattgatgtatccagggataatatagaactttatgagaaaagcgtggaagaaatgagtaacataagacgcggttttttggacgtgttttctacgctgaaaaaagattatagtcaaaatattatgattattgatgctaatggaagcattgatgatgttgcaaaggagatattaaaatatgtatagaagattattcacttctgagtctgtaacagagggacaccctgataaaatatctgatttaatttcagacgcgattttagatgcaatccttttaaaagatcctaatgcccgtgtggcagttgaagttactgtaacaaccggactggtgcttgttgttggagagattacgactaaaacttatgttgatataaagagtattgttcgtgaaacaattcgcgaggttggatatgaccgagctaagtatgggtttgattgtgatacctgcgctgtgcttgtggctattgacgagcagtccggtgatattgcacggggagttgatgacgacggagacggaattggcgctggggatcagggaatgatgtttggttttgcatgcgatgaaaccgatgaatatatgccaatgcctatatacttatcacataaattgacaagacaacttacaatggtaagaaaaaagaatgttttagattacttgagaccggacggaaaagcgcaggttactgtggaatataatgaggatggctctgtaaaaagagttgacactattgttgtttccacccagcacaatgaaactgttacacaaaagcagcttcaggatgatatcaaggaatttgtaatagaccctataatcggtgatgatctcaaggacgaagatactattatatatataaatcctaccggaagatttgttattggaggcccacagggcgacagcggacataccggaagaaaaataatagttgatacttatggaggatatgccagccacggaggaggagccttttcaggaaaagacccaacaaaagttgatagaagcgccgcatatgcagctagatatgtagctaaaaatgtggttgcagcaggtcttgcaaaagcatgtgaggtacaattagcatatgcgattggcgttagcaagcctgtgtctattagagttgacagccgaggtaccggtgttatcagtgaccaagaaatagaagaaaagattttaaaagtttttgatttaactccgggcggtattataagagatttgaacttaaagcgtccgatttacaagcagactgctgcttatggacatttcggacggaatgatttggacttgccgtgggagaagattgacaaagctgaagctttaaagaatgcataataatattacaaaggaagcgcattcatgttgcttccttattgtttatatattgataggagagtattatgtcttatgatgggtttgttacacatagtgttgttcatgaattaaacggtaaaattttaggcggtaaaattgataaaatataccagcctgaaagcgatgaaataataatttcggtcagaacatttgatgggaattaccgtttattattatcagccagcgcatcaaatgccagagtgcatttaacgacatcaaaacgcgaaaatccaatgaccccgcctatgctatgtatgctaatgagaaagcacttattaggcggcaaaattatcgggatagaacaggtagattttgatagaattattaaaattgatatagaatgttataatgaacttggcgatttaggagttaaatcaattatttctgaaataatgggcagacacagcaatataatttttattgatgaaaataataaaattttggatagtgcaaaacatgtggattttacagtgagtgcagttcgccaaatactgccgggatttgtttatcagcttcctccaaagcaggaaaagatgtcgcctaaggagttttctctgcttgattttactaatgattttactaaagaagataaggatattttactggataagtttctgttaggtaaaattatgggtttgagtccgcttattgcaagggaaatagtatatagattttcaaatcacacaaaaatcgcaaaaagagaaattgatgattataaatttgctgccacagtggatttatttcttaaagatattgtttcagataagtattcaccgtgtcttgttttagaaaaagatacaggaaagccgatgtatttttcatgtgtagaattaactcagtataaaaatgttgctgaaattaatatattagattcaatatctgagataattgataaatattatttaacaagggcttctcaggagagaatgaagcaaaaaagtgcaaatattttgaaattagtccacaacaatattgatagatgcactaaaaagcttgttatgcatcgtgaaaatttagaaaaagcgaaaaatagagataagtataaaatttgcggagatttattgacggcaaatatgtatagggtaaaatttggtatggatgaagtctgtgtggaaaattactatgataataactctgaattaaaaataaaacttgatccaaatatatctccttctcaaaatgctcagaaatactataaaaaatataataaagcgaaagtaacagaaaaatatgccgaagaacaaattgtaggtgctgaagaagaacttgagtatttagaaactgttcaggaaagtatattaaaggcagaaagccctagagacttatctgaaataaaagaagagttggcagaacaaggatatatctctaatactgcttcaaagaaaaagaagaaaactcaaaaatctatgcccatgaagtttatatcaagcgatggctatgagattttagtaggacggaataataagcaaaatgatgaagtcacaattcgtatgtcatattctactgatatttggcttcatacaaaaaatattccgggttcgcatactttaattagaacaaatggttcaggcgaagcaccggatagtacaatacttgaagctgctcagctagcggcatattatagtaaagctaaaaattcggctcaggttcctgtagattatacacaaataaagaatgtaaaaaaaccaaacggtgctaaaccgggctttgtaatttatgaaaaaaataatactgtttatgtaactccaaaattatttgaaaaagttacagaataaatgtttaagtaaaatattgtttttttagataaaatataagtttttatgatagttaataagtaaacttgttattttagtaattatgaacgtatttttttagattgaaaaatgtctttatttagtatagtttaaaaatgtcttttaactatatatttttatttggattaatgatctaattcagcttcccaaatgggaagctgataatgtatttgccgaaatttttaataattaactatttttttcttcatagtatttctttatttcaccagctaaaaataatgaacctataacacataataactcatctttatgaagtgttttcacaacttcattaaatgcagaaattggatttgaattaatatctgagacgatgttatttttcataaaaatattctttatagtacctgaatccaaacatcgcggcatatttatttctgttgcagttatttttgatttttctgagatagcataatcagaaatcaaattaataattgattcataatctttatcagacataaaagcaactaaaaaatgaatttttttattcagactttttaaagattttaagaaagaatttattgcctgcggattatgtgcgccgtcgacgataatattcggtgcaataaactcaaatcttccttctatgtttgcatgttttaagccatttgttatacaatcagaagaaatagcatatccttgatttaataaactattgataatttcaatagctgtaactgcattataagtttgaaatctgccatttaatgttaaatcatagcgcgttcctttatattcaaaagaatttttataaggttccggaagcgttggtaattccggaatgattaaattagagtttttttcttgacatattaatctaatattatcaaatacttttgattcttgaataggatataaaaccacatctgaatttttcttaattatcccggctttttcttttgaaatttcatctatggtattgccgagatattgacaatggtctaatccaattgcagtaaaccctactaccaaaggatttttaataatatttgtagcgtctaatttacctccaaggccaacttcaagaataacaaaatcacagttttgtctattaaaatattcaaacgcaacagcagtgtcaaaagcgaactctgatacaaatgcgtcatatttttctgttattttttttacatatgacgcgatatcagctaaatcagaattgcttataggtacaccattaattttaattcgctcattaaagaattttaaaaatggcgatgtaaataatcccgttttataacctgcttcagtcagtatttgtgaaaccattgtacaggttgagcctttgccgtttgttcctccaatatgtataaattttaaattatcctgagggtttcccattttgtttaaaagtttttctagcagagcattacccaaaacacggttaaatttaggaatactatgtatatattctaatatttctttatagttcatattattctgtcctcctgacagaaacaccctcgttttcaagataattttttaaatcacaaatttctatttctctaaaatggaaaagtgaagcggcaagtgcagcgtcagctttgccgtcagttaatgcatctttgaaatgtgacatgtttccggcgccgccggaggctattacaggaattgaaacattttcagatatagtttttgttaattctatatcataaccatttttggttccatcacaatccatagaagttaatagaatttctccggcacctaaactctcagccttttttgcccactctaaagcgtcaagcccggtgtctatacgaccgccgtttatataaacattccagcttccgtattcatttctttttgcatcaattgcaactacaacgcattgacttccaaatttttgggctgcctctgatatgagttgaggatttcgtatagcagatgaatttattgaaattttatccgcaccttgcagcagaagttccctgaaatcatcaacagatttaattccccctcctacggtaaatggtatgaaaacagtctcggcaacttttttcgccatttctataactgttcctctggcttcatgcgtagcggttatatcaagaaaaacaagttcatctgcgccggcttcgttatatatctttgccacttcaacaggatcgccggcatcaattaaattaacaaagttaactccttttacaactctgccgttttttacgtcaagacatggtatgattcgctttgcaaacattttatttctcctttttataaattgccaaagttctttaaaactttcaatccttcatttccgcttttttcaggatgaaactgtgttgcaaaaatattgtttttatgcacagcaatcggaagttcagttccatattcagttacggcggatataatttccttatcctttggattaatataatatgaatgaacaaaatacatatatggttcttcacttaatccttgaaaaataggacagtttttgtcgtactttattgaattccagcctatatgaggaattttaaggctgccctgttttggaatcttgatacaatttccatcaaatattttgagaccgggttcattaggtgattcctcacttgtttcaaataaaagctggagcccaaggcatattcccaaaaaaggtacgttattttctataacttgatgtatacactgagttagataagctttattaatagaattcatacagtcgccgaaagcaccgacgccgggaagaattaccttatctgcagaaattatttcatccggttttgaggttattttagctttaaatcccaaaaattccaaagctttttctacagaccgaagattgccggctccataatcaataatcgctatcatcgtgatctccttaaagttttgtcaatataatatgaattcaattatactattttataataattatttcaagagtaattgagaaaaatattgctgtaattttacataattcgttgacttaaacagtaaaatattacttgccatatcatttggtttgtagtataatgacaaaaggtataatttactataatgacgtttattactgaaatcaggtgacagaaaatgaaagtattatttatgggaacgccggattttgcggtgccttgtcttgaatcaatcattaaaagtgaaaataataatgttattggagttgtaacacagcctgataaaccaaaaggaagaggtcataagcttcagcctacacctgttaaagcaaaagcagttgaatataatatacctgtgtttcagccggaaactttaaaaaatagaagttttgaagatgaattaaaacagctgaatcctgatattattgttgtagtagcatatggtcagatattacctgaatatattttaaattttcctaagttcggctgtataaatgttcatgcgtcattgcttcctaaataccgcggtgcagctccgatacaatggagcgtaataaatggagacacaacaaccggagttactacaatgtatatggctaaatcccttgatacaggggatatgatacaaaaagctgaaattcaaataggcgatgaagaaactgccggagaacttcacgatagattatctcttataggagcagatttgattgttgaaacaataaaaaaactttctgaaggcaaggcgatcagagtacctcaaaatgattcactatcgtcttacgctcctatgcttaataaagaaaccggtcatattgattggaataaaaattcttctgatataatcaatttaatccgcggaacaaacccatggccaggagcttttacaagttataaatctgaaataatgaaaatatataaagcatataaaggcaatactaatacagttggtaaacccggagaaataataggaataaaaaataaaaaaatagaggtttgctgcggtaactcaagttcaatattaattgatgaaatacagtttaagggcggaaaacgtatgaatgtttcaagttacttaaacggtcatagtatagatatcggtgaaattttaaattaggaggtaattaaatgtattttggtttatttgaccctacaatgtatttgctgattcctgcaattatattagctttatgggctcaaacaaaggtttcaagtacctttaacaaatattcaaagatagcaaatgcacgcggtttgacaggttcagacgcggcgagaatgatattagacaaaaatggtttgtattcggttaaaattcagcatataagcggaagtttaactgataattttgacccaagaaccaatgttgtaaatttatctgacgcaacttatatgagtaacagtataggtgcaataggtgttgcggcacatgaatgcggtcacgctgttcaatatgcaaccggatataccccgataagaattagaaatggaatttttccagttgtaagcatatgcagtaagctttctatgccaattattctattaggatttatacttacagctttcggcggtatggctcctttaattgtggatattggtataatattgtattcagctaccgttgtttttcagcttattactcttccggttgagtttaatgccagcagccgtgctttaaaaactttggaatcatatcaaatgttgggttctgaagagataaaaggtgctaaaaaagttttatcggctgccgctatgacttatgttgccgcagctttttctgcgcttatgacattgctgaggcttgttttgttatcatctaacaacaatagaagagattaggagtattcatgaattcaagagatatttcattgtcgatattaaataaatatgattatgacaaggcttatgttaataaattattagcagatacttttaaaaataaaaatatagacaataaagataaaggtttaattaatgagctggtattgggaagtatagaaaatcggtatttgcttgattttataatttcccaattttctaaaattaaaattaaaaaaatgtctgtatcagtaagaaatattcttgaaatgggaacttatcaattattatttcttgataaaattcctgattcagctgtgtgtaatgaaagtgttaagcttgcaaaaaaatatgcaaatcgttcgtccggttttataaatgcagtgttgagaaatataagccgcaataaatataatataaaatatcctgataagacagaagataaaatagggtatctttctatatactactcatttccaaaatggatagttgaaaaattagttgaccaatttggatttgaattttgcgaagatattttaaaatcttcgtttaaaacatattctccggctatacgtgcaaatatattgaaagtgcctaatgatggaaatggtaaagttaaaactgacgagtttatcgatactttaaaatctgagaatattaatataattcctaatgaagatatacaaaattgtttttgggtagatggaaaacttgatataaataattctgaaagctataaaaatggtttatatacaattcagaatcctagttcacaattaacggctataacgttagacccaaaaccgaatgagataattatagacgtatgtgcggcacccggtggaaagaccacccacatagccgagcttatgaaaaataaggggcgcgttttggcttttgatatttatcagcataaaattgatttaataaataagtcggcaaatcgtcttggaatagatataatagaagcagttaaacatgattcttctatatttaagcccgaacttgttgaatatgctgatagagttttagttgacgctccttgttctgggtttggcgtgatacatactaaaccggatattaagtggcatagaaatgagaatgatattaaagaattaataaaaatacaggaaaaaattctttccgtttcgtcaaaatatgttaaaaaaggcggtacattgatatacagtacttgtacaattttgaaagatgaaaatgaaattcagatttcaaagtttctttcagaaaatagagactataaattgatttcagagaaaagattgtttactcatattgacggaggaagcggtttttatattgctaaattaaagaggatttagaggcttaatattcatggataaaataaatttaaaggatttgacattagaagaacttcaagattatataattaatcttggagaaccgaaattcagagcactgcaaatatataaatggatatacagcggtgtgcggagttttgaagaaatgactaatatttctaaaacgttaagagataagctgaaatctaatactactatcggaaatcttgcaattaataaaaagttcgtatcgactcttgacggaaccaggagatatttgatacaattatcggataataattatattgaatctgtacttatgaaatataaacatggttattcaatttgtatctcatctcaggttggatgtgcaatgggatgtaagttttgtgcttcaactaaaaatggtaaaatacgcaatctctcagccggtgagataattgatcagattatcactgttgaaagggatgttgatgaacgcatttcaaacgttgtcatgatgggtgttggcgaaccgttggacaactttgataatatagtaaaatttataaaaaatgtaaataatccaaacggtttgaatattgggcaaagacatataaccatatctacttgcggtattgttgaaagaatttatgaattggcagatttgaattttcaaattactttagctatttcactgcatgcaacaaatgatgaaaccaggaatgatattatgcctgtaaataaaaaatataatatttcaaaattgcttgaagcatgtaaatattacgtgaataaaacaggcaggagaatcacatttgagtatactcttattaataaaaagaatgattatactcagaatgcagaagaactctcaaatttattaaaaggtattttatgccatgttaatttaattccggttaattcagtagatgggactggatttgtaccaggcagtgaaaaaaatataagagaattccaaaatattctcgaaaagaatggtataccggcaacagttcggcgtgaaatgggaagtgacatctcagctgcgtgcggtcagttgcgttcacagatataaacaataaggaaggagcgttgacaatgaaatttgatgtttatggcgttactgacactggatgtgttcgtcagctcaatgaagataatttttgtatttgtggatttgagaacaataatgaacctggatattgtgtcgttgctgatggaatgggcggtcataatgccggagaggtagcaagccagctggctattgactttattactgaatccctcaatgatatacttcaaaacagtgaaaatcctgatgtgccaagaagaattaatgatgccttaaattctgcaaacgagagtatttataaaatggcaagagaagacaaaaatcggaacggtatgggaacaaccacggttatatgtacatttgccaatggtgagggatatatagccaatgtaggtgacagccgtgcttatgcttgcagaaatgatgaaatttatcaaatcactattgatcattctattgttgaagagatggttgctaatggttcaattacccgtgaggaagctagagttcatccacagaaaaacattataacgcgggctataggaagtgagaaaaccacaaaagctgatatatttgaatatgaatataaacctggggatagtattattatatgcagtgatggactctcaggaatggttgaggacgctactattttgaagacggttcaggatggtaaaagttcaaaagagattgccgataatttgtgtgagttggcaaagaaaaatggcggggttgataatataactgttatagccattagaattatggaggaggagagttccatatgaatatgattggtaaagaaatagatggaagatatgaaattcttgaggaaatcggcaagggtggaatggcacatgtttataaatcacgggataagtcactaaatagacttgttgcagtaaaggttcttaaagaggattataaagatgataaggaatttgtacgtcggtttaatgtagaggctcaagcggcggccagtctgtcaaatccacatattgtttctatatacgatgttggatgcgaaaatggaatgcattatattgttatggaatatattgaaggagaaactttaaaagagtatatagaccgagttggagttcttccctggcgtgaagctgcaaattattccattcagatttgtgaaggtatagaggaagctcataataactcagttatacacagagatataaagccgcaaaatataataatggcttctgatggtgtgctaaaagtaacagacttcggtattgcaagagcatctactcaggcgacaatgaccatggcgaacaataatacaattggaaccgcacattatttgtctccggagcaagctagaggcggatatacagatgagcggacggacatttattctatgggtgttgttatgtatgaaatgcttacaggacaacttccgtttgatgataacagtcctgtggctattgctataaagcaccttcaggaaacggctacacctataacagatataaatcctgacgttcctaatgcattggaacaaattgttatgaaagccatgtcaaaagaacaagacagcaggtattcttctataacagatatgatttcagatattaaaaaagttttggctaatccaaatgtaaatctttttgcggcaggcagacgaagtttacctgttgataatcaggtaaacgatgcagcttcaaatacaataaaaatgcctagaacatttgtggattctaatcttgatgaacaaatgatacctggatatgatttagatgattatgatgagcaggatgaagaatacgaagctatggaacgtttaaatgaaaaaagagccaaaagattgaaaaaaaagaaagaacgtaaaattgcttttattgcctttttgtctgcacttgccgttttagcagttggatttgcggctgcttttgcatttaccggtggttttggtatttttggcgtagagaaagattctattcaaatacctaatgtagttggtatgactattaaagacgctcaatctcagtatggcaaaagctttagtatcattgaacaaaacagaactgaaagtacaaaaccggcaggaacaatattagaacaaactccggctggaggagatacagtttccaaaagagacaacatcattatcagagtagtagttagcctaggaagcagttctgttactcttgatgattatactggaatcaaatatgataaggcaaaagaagaattagaaaagttaggtttaaagtgcagtaaaatagaaaaagttgaccctgaaatagaggcaggactaattattagtcaggaacctaagtccggcagttcggttgcagcaggagatatgattacatttactgttagcaagggaccggaaagtacaccggaaccttctcttgtgccaaataaaaattctaataatgactcgaataatcactcaaataatgagaacagttcgtcatcaaataataaaccgaattcgaatgattcgtcaagtaactcgtcaaataatgacaaaaatgatgagaattcttctaataatagtggaagcaattcaagttcaggcggttcaggtaacactacaaatgagggctctagctcaggcagcagtaccggttcgggaaccagcacaggctcaggcagcggaagcggaacaggttcagaaaccggatcaggaagcgagtcgggttctgagggcggcacaggttcaggcggaggaagcggatccggatctgaaagtggttcaggaagcggttcagagactggctctggtggttccggcagtgaaagcggaatgggtagcggaacaggttctgaaggcggaagcggcaatggtttagaggattaatatatgccggaaaaaaatcaatttgaaatacagggtaaaatttttaaaggtatcggtggtttttattacgttaaagccggtaattttatttatgaatgcagagctagagggcgttttagaaaagatggaataactccattggttggtgatgaagttaattgtttgattgataaaacttcaaatacaggtatgattagtaatataatgtctagaactaattctttaatacgccctcctgttgccaatgtaacacaaatagctatagtcgtttcagtcactaatccgaaacctaatttaaaaactgttgataaacttatatcatcagctatatatgctaatataaagccattaatatgtattaataaaaccgatttacaaaatggcgaaaacctttttgaaatatattcgaaaataggatttaaaactctttatataagcgctgaaagtaaagaaaatatagatatgcttattgaaaagctctcaggagaagtcacggtatttgccggaaattcgggtgttggaaaatcaagtttactcaactgcatattaaaagacgctaatcttgagaccggaacggtgagcagcaaaatagaacgcggacgtcatactaccagacacagtgaattaataccgcttgataacaacggaggatatattatagacacacccgggtttagttcattctctgtaagcggttttgatgaacatgagctttataagctttttcctgaatttatagagtattccgataattgcagatttgccgactgcagtcataccgttgaacagggctgctctgtacttgaagcggtagaaaccggtgaaatcagtaaatccagacatgaaagttatgtcgaacaatataaggaaattctagatagtaaaactttttgataacgggggataaataaaatgtccaaaataattatttcaccttcaatattatctgctgaccctgccaatttagaacgtgatgttaggctggtagaagaggctggagctgagtatctccatattgatattatggacggacattttgttccaaatttaagttattcggcaaatgtaataagagctttaagaaagaaatcaaacttaatatttgacgttcatttaatgcttcaagatgctgacaaattcattgatgaatttgcagaagccggttctgatataattacagttcatcaggaggcagttccaaacttaaaagaaacacttaaaaatattcactcatttggaaaaaaggcaggagtaagtttaaaacccggaactcctgtagatatgattttaaatgttttggatttgactgatgtggttctgcttatgactgttgagcccggatttggagggcaaagttatcttcatcaagtagataaaaaaatctctgaattatataagattatcaataatcaaaatctaaatatcgggatagaggttgatggagggataactgaggaaaatgtgaacagacctgtaagagcaggtgcaaacattattgtttcaggctcagcaatttttaattctaacaacataaaagatacgataaataaaatgcgtaagaaagcggaacaaggagtacaagaacgtgaaatcaataatttttagcggcgcttatatagaaaactatgattatttgtctgaaattaattttgatgaatatctaataatatgtgcggattccggatataaacacgcagagaatttaaaaatagtaccggatgttattttgggcgacaatgattcatatttaaaaaagtatcctgataatattaaaaatcttgtttttccaccagaaaaagattttacagacacccacgcagcgatagattatgctattaataataatgcagaagaaattttaattattggcggtcttggcggcaggatagaccatgaattttctcatttttgtcttatgaattatgctttggataaaggagtaaaactaaagttgattaatgacacaaatgaaatatggatggaaaataaaccttttaaacttaaaaaatctaaaagaaaatatgtttcattctttccttatgcaggagctgtattgaatttttcaataaaaggtttaaaatatgagacaacaaatatgcgtttggttccaaaccgagttcaagcgtcgagcaatgagttttgtgattctgatactgcaattgtaacctttgacagcggacttgttattgttatgttatgtgacgacagatattaattttaagtggagattttgcaatgaaatatatattaaagaccttgtcgtattttgtattaattaccattgtagctgtatacagttcatcatgctctttaagtgataaatctgagagtataagtccttctccagccccaagtattggagtgagtaataatacggctttcagcgatatattttctgagtttaacgaattaaaaaatgtatcagcagccctgttaaatagtaaaactgatttagtttggtggcagaaatttgattcaatatataataatgtgaatgcagtatatgaagaaaataatgctattaatatgagcggtaaactcggcggtatggataagtctttatcacaagcgttggtaagtgtttcgtcatcatataaagacgcatttgatattatgaacgcagcaaaagacaatgatgattcggaaatacagcaatatgcttataatgatttttcaaataaaatatcttctgcaaataatcaatgggaatatgttttagaaacattgattgaaacatctccgcctgatagtagtcaataaaacaattatttatatattgttaatttaaaataaaattatattttagctatttgtcgttaaaccatctatatagtttgtcgtatatagagtatatattataaaataagttataatattaatataagaccccagcgtgtaagaaactacgcatggggtcttatattaatgagattatattcaactatgcctttactatctttaaaaatttctttttacctttttttactatcatttcgttttcattttcgaaataagtattatcaataattgtcgaaacgtcagaaattttctcgttattcactgtcagtccattttgctgtataagtcttctgccttcagcttttgatggtatgagtccaacctgaaccaataaatcaagtacatttattcctgcattgataattgaagcatcaacagtttccgatggcatatcagctgcattaccacctgaaaatatagccatagccgcatcatttgctttttttgcttcttcttcaccatgcaccatttttgtaacttcatatgctaataagcatttcgctttgtttagttcagcaccttcacatttttcatattcagcaatttcttcaagcggtagaaatgtaaccaattttagaagtcttattacatcggcatcatcaacatttctccaatattggtaaaactcataaggtgaaactttctcagggtcaagccaaagagctcctttttctgttttacccatctttttgccctcgcttgttgtaagcagagtaaatgtcataccataagcctgtttgccgtctttacgcctgattaactcaatacctccgagaatattagaccattggtcgtctcccccaaactccataataacgccgtaatctttatgaagcttataaaaatcatagctttgcatcagcatatagttgaattctaagaatgaaagccctttttctaatcttgttttaaaacattcaaatgtcagcattctgttaacggaaaagtgaacgcctacgtcgcgtagaaagtcaatataattcagtttcagcagccaatcagcattgttgaccattatagcgttctcaccgtcaaaattaatgaatttagacatctgttttttaaagttgtctgcattatgctgaataacttcctgagttatcatagggcgcatatcagcttttcctgttggatcgccgaccatggtagtacctccgcccaataaaacaataggtctgtgtcctgcgttctgcatatgtttcattactataagctgcataaaatgacctatatgaagactgtcagcagttggatcaaagccaatataaaatgttattttctcttttccgagaagctctctgatttcatcttcatgagtagtttgggcaattaagcctctttctttcagggtgtcaaaaacatttttattattcattgtccgaattctccttttctccatcatctactggtacagttatttcaatacccagttcttccaattgttttttatcaacataactaggcgatttcagcattaattctgatgcggtttgaacttttgggaaagcaattacgtcacgtattgaatcgcagcctgccataatcataacaagtctgtcaagaccataagctagtccgccatgcggtggagttccaaatttaaatgcctccattaaatgaccaaaacgctcccaagcttcatcatgcgtgaaaccaagtgctttgaacattctttcctgtaaatcagaattaaatattcttaagcttccgccgccgatttcgcttccgtttaaaataatatcatatgcttttgctctaacgttttgaggttcagtttctagtttttcgatatcctcatctaccggatgtgtaaatgggtggtgtttagcaacgtatctgtcttcctcctcagaatactcaaagagagggaagtcagtaacccaaagaaaattaaatttagaattatcaataaggtcaaattgacgtgccacttcaagacgcagattaccaagagcatcatagaccacatcgtttttatcagcaattataagtattgcgtcgccaggtacagcgtcagttttagaaagtattgaattaatctcatcatctgataaaaacttggttatttgtgaacgcaaagaatcatcttcaacaacaatccaagacatccctttagccttatatgtcttaacatattcagagagtgcatcaagcttcttcctggataacttgttcccaagaccttttgcatttatacagcgaacgcttccgccattttcaacggcgccggagaacactttaaaaccgcagttttttacttcatcagaaatatctataagctccaaaccaaatcttgtatctggtttatctgaaccaaatctattcattgcctcattatatggcattcttataaaaggagtttctatgtcaattcccatagcttctttaaaaactttttttaaaaagccttcatttatgtttattatcgtgtcaatatctacaaatgatagttccatgtcaagctgtgtaaattcgggttgacggtctgctcttaaatcctcatctctaaaacatctgacaacttgaaaatacctgtcatatccggcaagcataagcatttgtttatattgctgcggagactgcggcaaagcgtaaaattttccttgctgaaccctgctggggaccaaataatctcgagcgccttcaggagtgcttttggtgagcataggagtttcaatctctaaaaatccatttgcatcaaaataatcacgagcaattttagtaactttgtgacgcagcatcatatttttttgcatatcaggacgccttaaatcaaggtatctatattttaatcttagtgcgtcattagtgtcaatgttttcctcgatatagaaaggaggtgtttcggatgagttaagaacccttagctcagtaacaaaaacttcaatttcaccggtaggcatatttttattgacattttcaggcgttctcttgagaaccttacctttaacagcaataacatattctccttttaaatgctcggatttttcaaatacatctttgtcagttgaatcgttaaaagctaattgtactatgccggttctgtcacgcagcgtaacaaaatttactcctccaagttttctgttttttgctacccaccccataagaacgacttctttgttttcatctgaggcattaagctcaccgcacatatttgtacgtttcatatcagacaatgtttcaaattccatttatctttctccttaaaataaattataaacaagataatattattattttattatattataaatcgaatcacaggataattctacaatagtttcttcaccggtatccatgtttttcagtgaagccttattatttaaaacttcatcatctccgataacaatactataacatgctccaagtttatttgcatatttcatttgtgctttaacgctcctgtcacataaatcgcgttcagcccaaagacctttatttcttaaatcatatactaacttttgtgcggttaagctggcattatcgccaattgaagctacaaatatattcggacccaaactttctccaagttcgattccttggctttttaaaattaaaatcagtcgctcaatacccatagcaaatcctataccaggagttggcttacctcctaattcttcaacaagtccattatatctgccgccgccgcatactgtagactgagctccgagagcgtcagatgttatttcaaacactgttcttgtgtaataatcaagccctctgacaatatttggatcaatagtatattttatattaagtttatctaaatatgatgtcagctgtttaaaatgagaatcacaatcctcacataaataatcaatcatacgcggagcattagcgcaaacttcctggcataccggtgatttgcagtcgataatccgcattggatttttctcaagtctatctttacaagtatcacataatttatcaatatggctgctgaaatatttttttagttcttcattatactttggcttgcatttttcacacccaatactgtttaaattaagtgataagtcttttacaccaagagttttaaaaaagtcaaaagcaagagttattatttcagcgtctgtggcgcttgaatcgcttccaaaacattcaagaccgaactggtgaaactcccggagtctgccggattgaggcttctcatatctatagcaagaaattaaataatataactttgtgggttgaggattcgcataaagcgaattttcaatgtaacttctaaccaatgaagcggttccctctggacgcaaagtaatgctacgcccgcccttatcgttgaatgtatacatttctttttgaaccacgtctgtcgtgtccccaactcctcggctaaaaagagaagtatcctcgaaaacaggagtacgaatttctttatagccgtatttagcacaaatttcatgagccgtattttcaatcagtctccaaatttttgaatcgtttggcagtatatcttcggtgcctcttggcttttttatcatttttgcctctcctttacaaaatttgttaatgtcccaataccatcaatttcaacctccactgtatctcctatattcatagaaccaataccggagggagtacccgttgtaatgatgtctccgggataaagagtcatgatttgcgatattgcagaaactaaataatcagttttaaatataaaatttgatgtattggattcctgcattacttttccgttaaggcgcaaacgaatatcagcgttatcaggatctaattctgtctctataaatggtcctattggagcaaatgtgtcaaatcctttagctcttgtccactgtgaatcaagcctttgcaaatcacgagcggtaatatcatttaaacaagtatagccgagaatatattttttagcttcagattcgcttacgtatgatgcggtttctccaataactattgctaactcagcctcataatcaacttgttctgacatatcaggatatataatattatccatattaccaataacagaagaggatggctttaaaaacagagcaggaaatttaggaatattcagccccatttcatttgcatgattcgcataatttaatcctactgcaactatttttgagggttcgcacgtcggaagaattttaacttcatttctattaacatttgtacttgtatatgaaaagaaatcaaaaatatctccttcaattaattcaaacatatttgaagaactatcatactttgcgtaataaatctcatcattatataatattctggcaaatttcattatttcatctccgtttatttttctgatatagaataatttgaaaggatttcatcaaataaagctatcaaatcatttcgtccggtacgcttttcggcagaaaatggaattaatattgaattattatccatttgtaaatcattataaatctcggttaaatttttgtcaatttgtgatttctttaatttatcaatttttgttgcaacaacaattgtattaaaattataatgtcttatccaatccgccattgtaatatcatcttttgacggtgcatgtctagcatcgactaactgaataacttgaactaaattatatctttttgatagataagtatcaatcatggctgaccatttttcttgctcagcttttgaaactttagcatatccatagccgggtaaatccacaatcctgtatctgtctttttgaatttgatagaaatttattgtggcggtttttcctggagtactgcttgttcttgcaagtttatttctatttgtcaggcaatttattaaagaggattttccaacattcgaacggccaacaagagctatttcaggaactaatgtatcaggatattgttcaaatgaaactgcggttttaagtaaatctacttcaacaaaatccattcgtatcacctcatcaaatttatatattacagttttgcaatcgttacattgcttatatcattttttatatatagttcattgtcaaggggcaataagttattcccacttttttttacaggcaatgacggtttgaatggtttagttaatgcattttccaaaacatcaaccatatttttagcaaagataaactcaatattatttttaactatatcaggaagctcttcataatctgctttattttcaaacggtataataactttttttatacctattcttaaagctgccaatgttttttcttttaagcctccgattggaagaacttttcctcttagtgttatctctcctgtcattgcaacgtcatgttttacaggtttgccggttaaagcagaaatcatagctgttgccatggtaattccggcagatggtccatcctttggtattgctccttcaggaatatgaatgtgcaaatcataatttttataaaaatcagacttaattccaaatttataactgtttgaacgtataaagctatatccggcctttgcagattctttcattacatcgccaagattaccggtaagctcaagttttcctgtaccgtccataatattaacctcgacggataatgtttctcctccaacttctgtccatgctaacccattaactattcctacagaatctttcttttcgattgagctgtcgttatagatttttttgcctaaaaattcatttaagtttttccttgtaacgcttatataaaaatcattatcttccgcaactttaacagcaacttttctgcaaaccttagaaattgctctttctaaatttctaacgccggattcacgtgtatacccgttaattatttctttaataccactgtcggtaatatttaaattatggctagtaagtccattatttttacgttgtttttgaattaaatatttttttgcgatattgagtttttcatcttctgtatatccagaaacttcaattatgtccattctgtccaaaagaggacgaggaatattttcaagactgttcgcagaagctatgaacataacgttggataaatcgaaaggaagctcaatataattatctctaaagcttttattttgttctgggtctaaaacctcaagcatagctgaagttgggtcaccgctgatatctttcgtcattttatctatttcatccaatagtataacagggttatttacattggcacgctttatagcatcaattattcttccgggcattgcaccgacatatgtttttctatgacctcgaatttcagactcattatgtacgccgcctaaacttagcctaatatatttcctgcctattgattttgccaaagagctgactattgaagtttttccggttccgggaggaccaactaagcataaaatatttccgtttaccttatttgtaagtttgcttactgcaatgtactctaaaactctttctttaaccttatccaaaccataatggtctctgtccagctgtgtttttgctgcttttatgtcaagagtttcatcgccggttatatcccatggcagagctagtatggtttctatatatccttgaataacagcatattcctgtgaatgagggggagttttagtaagccttgagaattcatcattcagcttgtccataacttcttttggtaaatttctgtctttgatgctctcacgatatttttttatatcagagtcgttttcttcgccttcgcctaattcttcctgaattactttaagtttttctctgagtacataatcacgctgattattatcaagattttcctgaacctgatccattacacttttctctatatcaagtagatcaatttcttcagacattattgttataagctgttccattctttcaagaacgttcactttatccagaaccgtttgtttaagagcaggttttataggaatatttgatataatgacatcagtcatttcaccaggatcgtcaattgcgagcagagcgcttatggcctcaggagatgccttatcatacagttcaagatagtcctctgtcaaacgctgaatttttcgaattaagatttgagtatatgtatcatcatcagaattaatatcgtcaagcttagtaacattaacttgtatatactttcctaaatcttcaaaatcatttatgcttgctcttgattttccctcaacaagtattcttatagaaccatcaggaagacgaagaatttgacgtatttcgcatatagttccaatttcagctaagtctgatttaaccggagactcaactaaaaaatcattttgataacacaaaaatatcaatttatttttctgcattgccgcttctacagcgtcaatcgaccttggtctgccaacatcaaaatgaagtgccatgcccggaaagacaataagtcctctaagcggaacgaggggcagtgtatatttattatctatcatatttattataccttaactttctatatgaatttaatgccgtgtaaaaatactcggcagaagttaattatactattaatatatataaatatcaagtatttccgcaaaattctactgtataaattcttataaaaacataagaagtttttgtgcaacgaataaacaaataaacaaaaatttacagattatagtataatagtcaaatttgcgttttaaatcaatataaattacttttatttgcatatcaattgaaatataaaatatattgtgatataatagataaaatattgggggaagtgatattatgagtttactcatatataaagcgttgtgttatttttttatatatggatttttaggctggtgctgtgaagtcatatatgccgcaataattgacggaaagttcgttaaccgcggatttctaaacggacccatatgtcctatatatgggtttggggttttatttgttttaactttattggaaccgattagagaaaattttttatttttatttatagggtcagttatattaacatcagtgcttgaatttataacaggatttttgcttgaaaaagtatttaaaatgaaatggtgggattactcaaacgaacgttttaatattcacggttacatatgtttaaagttttcaattatttggggattggcatgcttaatagtagtcgatataatacatccattttttatgaaggctgtggaaataaatccaataaatattggtattatcacaattggtatattaagtgttttatttatatctgacattatctcaacaattattggaattaacagaacaaacagatatttaaaattattgtcaaaatcaggcagtcagcttagaaagatttctgaatctataggtgaaaatatttctgacaaaacaattcaatttactcaaaaaagtgaaaatataaaaaatgatgtaaaagaaaaacgtcaaaaagccataaatgatatggaaaagcatagagcggctattcagagaaaacaagaggatatattaaagaatatgcctatgactgcaaaacgtatacgttctgcatttcccgacttaaaattatttgagtattgggataataagaataaagaaaataaaaaataatttataatataaaataaaatttggaggaagtaacataagtatgattaaaagattagtttctgtagtatccatcattttaatttccgcattgttattttgctcatgcaatcagattgcatcagttaaaaacgatgataaaataagtgtagtcgccacaatttttccggcctatgattttgttcgtgaggtctctcgcggtacagacgacatagatttaaaacttttgcttaagcccggttcggaagcgcattcatatgaaccaaccccgcaggatataattgctatacaaaattgtgatgtctttatttatgttggcggagaatccgatgaatgggtaaaaaatattttgtcatcgattgacactaatttaataaatatagtttctatgatggattgtgttgagcttgttaaggaagaaacagttgagggaatggaagaggagaagagtgcaaaagaaacatatgagccggaatatgatgaacatgtttggacatctcctagaaacgcgataaaaattgttgataaaatcaattcttcaatggcagaatcaagacctgttaataaagaaatttataataataacactataagttataatgaaaagctagaacagcttgataaagattttcatgaaattgtgaagtcaggcaaacgaaatacaatcgtcttcggcgacagatttccatttagatactttgctgatgaatatggattagaatattatgcagcttttccggggtgttcggaagaaacggaagctagtgcaaaaacagtttcatttttaatagataaaattaaaacagaaaatattcctgtagtattatatcctgaattgtcaaatcaaaaggttgcaaaaacaatatgcgagtctaccggagcattttcgctccagttcaattcatgccataatttaacaaatgatgaatttgaaagcggagctacctacttgagtcttatgaaagaaaatataaccacgctaaagcgtgcattaaactgaatatggagatattatgagtgattttagcagaaaaaatgttatagttattggcggaggacctgccggaatgattgcggcaggcacagcggcagaacgcggtcacaatgttaaattgattgaacagaataagattttgggcaaaaagctgttaataaccggcaagggcagatgtaatttaaccaacgcttgcgacgatgttgaaacactgatacaaaatgtacctactaacgggaattttttatacagtgcattttatacattttcaaatatggcggttatcgacttttttaataagcttggcgttgaaactaaagttgagcgcggaaacagagtctttccggttagcgataaaagctccgatgttgtagaagcgcttagaaattatattattaaaaacaacgttgaaataattaatgacagagttgattctatacttacaggtaatgataattctgatgaaaagagcagaatatccggtgttatgtgcagcaaaagaggaaaaatatcagcggacagagttattattgccacgggaggaatgtcgtatcaaaagacaggttcaacaggcgacggttatttctgggctgaagagcttggacacactattacggatattagaccttctttagttcctgttaaagtaaaagaagattggattcaagatgttttaggacttactttaaaaaatatatcaattaaagtaaagaactcaaaaaataaaactatatatactgattttggtgaaatgatgtttgcacattttggattaacaggtcctgtaatccttagtgcaagcgcgcatatgaaaaatattaaatctgaacattatatgatagaacttgatttaaaacccggactgagtgaaaagcagcttgatgaaaggattttacgtgattttagtgaaaatttaaataaagattttaagaatagtttaaataagctaatgcctaaaaaattaatagatccaattattgagatgtctgaaattgatccgttaaaaaaggttaattcaataactaaatccgaaagaactgcgttagtaaaactgctaaagtgtattaaattcagcgtagttgatttttgtcctatagagcaggctatagtaacgtctggaggaataaatgttaaagaaataaatccatcaactatggaatctaaaatcgttgacggattattctttgccggagaaataattgacgttgacgcttataccggcggatttaatttacaaatagcgttttcgagcggctttcttgcgggaacgtcgtgctgaactgcgctgaaatgatgacttaaagtttctgtatagagttgcggaaattacacagaatattattgataaagcatatgtaataacagcagtaattataaatcttgatatagtatctgtaactttaattccatttaaaatttcataagtcgaagtgattatcaaacaatgcacaagatatatgttgtaagaggctccggaaatgctgataaagaatccttttccacggctttctagggattcagtaagaccatacgcgtactggtaaaaaccaaatgttgagaacagacagaataatatcactattgtaggtgagaaaggattgtttataacaccgccatactccatatatgaagttacgcagtgaagtattgcaaaaacaagccagcctgcatagaccaaaagtcttgatttgcttaagaaacgtaagaactcattataatacattccggcgtacattccaagtatccaaaacaccaagtatgacggaaatatcttatgcgtatattcagtcgaagatatcagcattctgaatcctattgaacatacgacagctataaagattattattgtattaaaaagcttagatttatgcttgctaagtaaaatccaaagcggcataagcagataaaactgcattattaagacaacaaaataaaattgagcagataaatctccgttcaaaatatattttatcaatgaaactggattaaattcataaatatggaaagcataaacaaagatgatataatatatgacgaccataattatatacggcagatatatttttctgattctatctaatagaaacggcgcgtatgtaaattttctttcgctgaatttataaaataattttaatgcactggtaaaaataaaagcaggtacagcaaaagtagtgagtttcgtaactgtgaaaaacactatagataaaacgctccatttcggaaatacatttatgccctctgaaagcaaatgtattaatataacaaacatacagaggaagaattcaaaaactgaaacttccgtaatttttcttttcatataacatccctctacataatagtatttatattttacactattttcatatttaagtcaatgcttaataaaactacataaattttataaaaagattataaaaagtttatgtagttttattgtatattatagttgaatagttgtgcaaggtctggtataatcaaacttgccgatatacaacatattgtagaatatggaaattttatttaggaggaactgctatgacaaacttaggttggcaaggttttaaagatggtgtttggaaagatacaataaatgttgaagattttattagaaataattatactgaatataaaggcgacgaaagttttttgtgtgacagaagcgaaaaaactgatgctgtatataaaataaccagagaacttattctcgaagaaataaaaaagggaattatagatgttgaaactgaaaaagtttcaggtattgataattttgaccctggttatattgataaagataatgaagtaatcgtgggtcttcaaacggacaagccgttaaaaagaatagtaaatccatatggtggaatgagaatggttgaacaatcattaaatgagtatggatataaacttaataaagacattgagaaccatttcaaagaatatagaaagacacataatgacggcgtatttgacgcctatacctcaaaaatgagggctgccagatcagttggattaatgaccggtttgccagacgcatatggaagaggaagaattattggtgactatagaagaatcgctctttatggagtggatagactgattgaagagaaaaagaaagattttgaactaaaggaatctcttcctgcgtcagatgatgttatcagaatcagggaagaaatacgtatgcagattaaagctcttaatcagataaaaagtatggctgaaaaatatggatttgatatttctaagcctgcaaaagacgctagagaagcgatacagtttacgtattttggatatttggctggtgttaaggaaaataatggagctgcaatgtcatttggcagaaattctgcattttttgatatttatatttcacgtgatatagaaaatggagttttgacagaagaagaggctcaggagttaattgaccagcttgttataaaacttagattggttcgtcatttaagaacacctgaatataacgaactattttcaggcgacccaacttgggtaactgaatcaataggcggaatgggcgcagacggaaggacaatggttacgaaaacgtcttatagaatgcttcatactttgacaaatcttgacccggcaccggaaccaaatatgacagttttgtggagtaataatttgcccgaagcatttaaaaactactgtgcaaaaatgagcattgagacagacgctatacaatatgaaaacgacgaccttatgcgccctctctatggagatgattacggtatagcttgctgtgtatcatcgatggaattgggcaaaagaatgcagttttttggtgcacgcgttaatcttgctaaaactttactaatgtcaatgaatgacggtgttgatgcgctaaagggcttgaaggttttgaaatgtacagaaccaatgacagatgatgaatatttagattatgaaaaggttaaagcgtcatatttcaaatgtttggaagaggttgccgagctctatgtaaataccatgaacacgatacactatatgcatgataagtacgcatatgaagctggacaaatggcacttcatgacacagatgtaaaacgtttcatggcgtttggagttgccggactgtcagttgtagcggattcattatctgcaataaaatttgctaaagttaaacctatacgcgatgaaaacggtttagcttatgattttgaaaccataggtgattttccgaagtatggaaatgatgatgataaagtagacagcatagctgttgaagttttagaaaaattctttaatgaattaaagaaacatccaacttacagaaatgcagaacatacgctttctgtattaacaataacctcaaacgttgtgtatggtaaaaagaccggaacaacacctgatggacgtaaaaaaggtgaacctttggctcctggtgctaatccaatgcatggaagagacataaacggcgctttggcttcactgaattcagtagctaagctaaaatttgctgactgttgccaagatggaatttctaacacattttcaattatacctgatgctcttggaaagagtgaagaaacaaaggttacaaacttagttgggcttttagacggctattttaaacagggaggtttccatctcaatgttaatgtattaaatagagaaactttagaagacgctatggaaaaccctgataagtatccaacacttacaatcagagtgtcaggatatgctgtaaacttcaacagacttacacgtgaacagcagcttgaggtaatatcaagaacattccatgagtctatgtaacgtgtaaagtgtatttgtttacacgttgatgtaagagaagataatattaatattatagcaaacgccatctgtaaagaatatagctttacggatggcgttaaagcatttatttgttgctgaaaataatatattaaatttacgcaggtgatacattatggaaaatgaaaatataataaaaagtaatactgatataatcggtaatatacattcttttgaaagtatggggagtgttgacggacccggtatacgttctgttgttttttttcagggatgtagtttaaggtgcgccttttgtcataatcctgacacctggggaaccgatcctaataaagtaattacttccgccgatttaataaaaaaaatactgcggttcaaaccttattatgattcatccggcggcggtgtaacattttccggaggcgaaccgcttcttcagcctgaattcttgcttgatatattaaaaaaatgcaagcaaaacaatatccacactgcgttggacacatccggagtaggtcataaaggggacaaaaagttcagacctgattataaagaaatactcaaatatactgacctggttttgctggatgttaagcatactcgttctgaaatgtataaagaaattacttgtgtagatatgagtttttttatggagtttcttgacacgctcaattcatcagatacggatgtttggataagagctgtaattattcccggaataaatgataatatagattatataaaagagttagaaaaatttgctaaaaagattaataatgttaagaaatttgaacttttgccgtatcatactcttggagtaaataaatataaagagcttggtattaaatacagattagaaaaacttcctcccatggataagaaaaaaacgaaggaatgggaagaattattaaataagtcattagtgtaaagcatgaaatttttatatttttgtaggtttgtcaatgatgtgttacaaaaaagattaaaagagttcaccgaaattgataaaagagttgatgtagtcaatgggagctttccagcgtctactgatcttacatatccgtctccgtttatgtccgccgtatgcgctatcactgtattggctgtctctccctccattactgacagtctgtccttaacttcctgctccgtaattgttgttccgttgttcgatacaaatgccgcatatcctcccaggccttctgagtaatacatttctattgctgctgttccggctgactgcaatacatatttggcattttcattctttgctgtcgttactactaccaaatcttttccgctcggcgccgcattgtaactgtcgtgcgctacaatctttaccgttcctgttattactcctgcatatatctggatattctctccaaacatctgatatgggattgtatatactccgttgcttcctgttaagtatcctttgtttcctccgtttactgtgtaatatacatatcctactatatcaccgctgtttgccggctctacactgaacgttatatctgttccatatgtcgcttttccgtctgttactcctgtctctcctgtatacgctccatttgtcacagtattaaatgttacgctatactgggcttctgtatatgccgctgtcaatgttgcgtctcctgtcacttcatatgtactcaggtctatctttacatctccgctcatccagccatccggattatatcctgcttctgcttctattgtcggcaggtctgactgcagcaattttgagtttacatcctttgctatctctgtcactgctcccgctgcaaaacttccgtgtgttcccggctcaaatgttatcttgtattggcgcactgcctgagctgtcagacttgtatcttccgtatatgttcctgttgtcaaatctgtgcttgtataccctgttcctccgcttgttttccacagcggttcctctgttgtatcttttgccaaacggtagttctcgtttgcagttaccagtccctttatttgcgtatctgtcactgccgtagtataactgtcgtctgtgtatagtcctgctgtattatactttgtataatatgctgccggtgaacctgaaacagtgtttccatctccgcttgagagtgttacttttaggttatacagattaacggtttcagctgttgatactgctgctatatcagtatcagctcctgttggtgcaaaatatccgtccttcgttcctactgatacattagccgctgtttctattcctctatttactgtatactttactgtcattatagttacagcttcgcttgatacatcaaccgagctgcttcctgacgtatacgcaatcttattttgctccgctccttctccctgcaccaaattatatccgtttgtttttatagcgtctgacgcttctactgatgtcaatgtcatttttgtgctgtcatagtcaagagctatattaaagcttccgaaattagtcggttcactggacttaacttttaccgctaccgctatctcgtcaccggggttaaagttctcgtttgacggcgttactaattctgtaaccaactcatatcccaaactgtcagttattgcatatgtgctcaaatgctttaactttgttattacctttttgcctgctgtgtcatatgccgacgctactcctgatttttctccggcgtcatttatatacactactgatacttttgaaggatttgttactgccgcctcggtttcatacggcacttttagtgtcaagtttccgtttgagcctgctgagctttccggcaacaattctgtagttcctgacatcagttttacgtctataacttttgctccggacattatcatattatttactgtttcattttcgctggcatcatgaacgtcaacttttaaactaataccttcacttcctgcagtatttgaaatcttctcaaatgcagttttatcaagttctatctccgccacatcagtattgattaccacactgtcaggaactgcactgcttatactatctaccacgtcttttggaatactaacatcactgtttttaatttcactgcttggctcatcagttgttgacgcatttattacaggatttcctgtgtccgcccctgttattttgctgtcatcaatagtaacgtttttggcaaatgccgcagtaattaaaactccgttttcgggcattacaaaactataagttccattattttcagttattaccacaggatttgctccatcagtcaattcagtatatgttaaacttccgtttgcaaaggtatatccttcattcggttcaacagttaaaaccactgtgtcgccaatatttgcgtccggattttcaacactaactgttccccctacaattccagtatcaattgttatttttttagaaattgaagaaaatgctgttccatcataataatatgtaccggcatcaagttttgtatcaaaccatagagctccatcaacatttccgacagtatatctggattttttatcagataaaatttttcctgtcattaacgatttatcaccggcaattatatttgaagaatttccaaaatcaaattttgaatttgtggacttgaagtctacaaaaccaagattatttaaattaatagcactattcacattctcaaaagcaacagatgaattatcaaaattaaatccaagtgctgtataccaagagtagccatcaagatatataccattttcagagttctttacagtcaaattaatatttttaaaattaatatattgcgtatctgaatttttagttttaatcgcagatataccgttgccattcatatcgatactaagcgttggtggctgatttgttgaatcttcaattcctacaatattagatgttcctgtaaatataccacaagcatcagcttctgttcctgtatacttaatggaattatctccatacataaatatttgcatattatcatatgagtctataatagctttttttgaaagatttgaagttacagcaattttatcagtttcaattgttacattatttaatattagcagtttttcttctggaatccattttataccatattctgccagctctgaaattgtcaacgaatttagttctgaaccgatatcatctgcgcctaaaccacctgtaaatatatttcctgacccactgtttacataataataattactgtcttcatatgcagcgttgaaattccaaactgaattttctatactgtatattcctgacggaataatatttttatcataaatatacatatcagaaataaaattaatacttcctgaaccttctgcagcttcaggcttaacagaaaatgctttgtatttaacgttatttaatgtaatatcaccgcttagtttaattctattattatcattgttaagcgtaaacccaattgctttcgaaacattttctatattagtagtcccgccttgaatttgtatacttccattctcttcaatattaattgctgtagcggttataccatgtagattctttatacttgtagtacaatttgttaaagaaattgttccgcctgagcttgtttgaaatccatacacatatgaagatgaagatccatccaaatcaatatttactattgaatcagttaatataatagattcctttgtaatcacaaagcctttcaatgtatttttaatattaacttcactattttcagaaataatacttttattccccttcacacctgcagctccaccggaagaattaacattaattttagaattatttctaaacgtaaccgttccgctaaaatcaagaccgtttccttttgtatttgtaactgtaatattagaattatcaaaaatgacattttgcttagcatatgatataaatatacctgaaccacttgtataattagaatcagaaaaattaattttagcattttcaaacctaacttctccttcagaagaagattcagaatatataccatatcctccgccgctcatatttaattcaccatttgtagcagaatcgctggatataaatccatcacctttcatgaaaacagatgctgccgcatttgaagatgtagcgatagtattctttatattattaacacccattaatattacttttgtattagccggcaaatttattattccgctcacttgaccaaatcttgcaacttccaaagctacttcaatatttgcattataaagtgtcaaagtatggcttccatctgtgttatcttcaaaatatattccatagtccttttgctgctgctctgtcaaagggttacttgaagtaaaatcaagtttcttctcgcactttactgtaccgggagtttttgcttctcctgccggttctttatcagaatttggatatgtaaatgtcactgctaaatcatgtatattgctgtcgcccaacgattcaaaatatccgctttcacgtacgtccgagtatttatatgcaaacgctggactgctttcgaatatacgtacttctactccaaaatcttctcctgttgacaactgttcttctgtatatgtctgtaccggatgtaatgttattgtctctttatcgaaatcttctaatgttactccatcctttaacctaaaataaaaactcatcaagtcaaatgaattaatcgctttcgataacggcgttgtccatcctgctgtcattcttactgcttttcttccttctatatccgcatgatataattcatttgctactgctgcgcctgcttttgctgctacttccagcgctcctgacactgttattctattatcttgatccggctctgtatataataaatcactgtattgatcatttgataaatcaccaatcgcatataccggctgtatcttagaatcgtcatagtttaatactgtctccaccatctgcaagtttgcaggagctgataaattacatactatcttatatatttgtttattatcagattccctaactcctgcttcctgccaatttagagcaacttccggcactgtcacgtcagccagctctgcttcactgctactgtctataatttcttcattgttttcttctgtttttattttatcaacactgtcagaaatatttgtatcagacaaattattatcagcaaatacaaaagtcggcgatacgctgaatatcatcgctatagccaataccaaacttaaaataccttttttacaattcatttttattcctccatagattttcatatttaccattcacgttatttatataatttaattattcataagcaacttattcagctatggcgcttctttgataattcgcgagtaaaatcgaaagatcagccgacgtaaccattccatcaccattaatatcgccaatatcaattgatttttgataatttccaagtagtattgaaagatcagacgaagtaacctttccatcactatttaaatctccgccgtttaaaaccacctcagatatatttacaatattagaatttgatattacaattgctgattttctataatttaaaaagtttaatttttgaatatttaatatataagaaccatattcaatattactgaatgtatatcttccgtcagaatctgtaaccgctgtataattattttctgaatttgaaagcgtaacactaactccctcatttgatttgtttccgtcaagtgttaccattcctgtcaactgtccgtcactgcccgtctgaactatatcgcctccgctccaaactgttccggaatacaaatattcaccggcttttgtccccaaatgttttgttgagtcagcaaatataaattcagtatcaaaattcaatttaactgaatccggtcctgatgttgcacttggtctgtatccatttgcctctctagttgtgacatcaagaaccgccccatcagatatcactactttggccggcgccgccgccgaacattcaggacttccggttatgtcagctgaaaaatcacaaccactgtcaactgtcacaacagctccggcatagagttcaaacttagccgccggacgttcaggatattcagtatttacaagatttttaacatcatggaattcgtcataaaatacaactgtgccgcgtttacccgtagttgttggagtttcctccctatatcctccgtttattgttaatgtagaagattctaaaagatttaactcagaaccggtcaaaaatttaaaatcatcattaatcacataatttccgttatgaagattaaatgtcattatcccgttaattggatataaataatcttttgtgcttaggtcagtgcctacaatattaagagagctatgacttgcctcagcaccgccataaatatcgattgtagaacgtcccgactctttatcaagagtttttataacataaccgccgtcatttattctaactaaaccattatttttatcaaactgcggaaatcttgttcgattatatcctccgcccgcatacatttttacggttcctgcatatgtagcacgcgaatcaattttaactggcacttgaatatttctgcattcatactcgttcataggatatattccttcgtcaagagtaatagttgccgcctggcttccgcctctccagctcttaacaacatataaatcatagactgtagacgacgcgtttgcatttacttgtccatttcctgaaatatatccgcagcagtcaagcattccatatgcaccgacctcaattgtgccgtccaatattatctcggcatatcctgctgaaatattttggtcaaagttgccgcctcccgggcgtccaaccactgagtttattaaaaccttgcctaagatattcatcgttacattttgaggtatagtaagcgtgcaatattttgactcttttccagccacatcagttccgtccggacaaaagcctgtttctgtatcataaccggtatcaccgtccatacaagacaataaaaggaacactcctgatggtacagtaatgtcccgggtaagttcataatcttttaatagaacaacggtatcgccgcttacagcaccgtcaagtgcttcttccaatgtattatatcctgttccgtttctctgagctatcgtatcggcttctgtctgtgccaacacaacttccggtaaatccaaagtactcctgttaagctcgtctgaaccagcaatttctattgttatatcattactgtcggcggacaaaagcatggcacccgaaaaatccggatctgaaaaatatacattaggttcgttagcttcattaaactcagtttctgcaaaagaaaaagtacaaaaagaaaacgaaaaaaatattgataaaaataaaatactaaaacgtaattttgacataaaattcctctccctaaatacaaatatgacataaaattattatatagacatattttatcataaaaattacataaatctctatgttatatttataacacaaactataaccacaataaaaacataatattttttaataaaaaacagttccaagagtattcttggaactgaaaataaaacttatatttttactcattaaaattattttaaaataaactgtatgatacttaaaaataacctataatagtattttgctatttatcaagtccctgcatatactcatccatggcgtcggctactaattttgaatattttaccgcttcaacaactgtttttgctccttttacaacatctccggaagcaaatatcccctctctggttgtttcaccgtattcatttgtaaccaaaagaccctttttgtttgtatctatacctttggttctcgaaaggatttggtcttgagcgccttgactgattgatataattactgaggtagaaggatataatttttcgcttccttcaacttcttctattgaaccgtcttcgtttactacagagtctttaaaaataacaccgtccggctttatctctaccggaatcttacaaaattcaaaatcaactccgtcaaactttgcatattcatattcaaggtcgcttgcggcaactttatcacttctgttaaacaccgtaacatttcgaacacccttgcggatagctgttctggcaacatccatcgccgcatttccggctccgatgattataagattatcaccgagattgtactcgtcaggattaattaaataagctattgcatagtgtacgtttcctaaactttcacctttgattctaagactattcggtttccaaacaccggttcctataaataatgcgtcatatccgtctctaaatatatcttcaatacttatagcccctccaatagtagcgtttggccttatttttataccaagctcgagcataagtgatttatatttttcaagaatagtttttggaagtctgaattcaggaattccgtacctaagaactccgcctattttatctttagactcaaaaattgttacatcgtaacctcttcttgcaagttctatggcgatcgtaattcccgcaggacctgaaccaactattccaaccattttaccattgctctctggtttctcaaatttgagacggtcaagataagtagtggaaatataattttcaatactgctaatatgcacaggatttccttttcttccaagcacacaatggccctgacactgtttttcatgcgaacataccaaagaacaaacaactgataacggattgttatcaaaaagcatttctcctgcctcttccatctcaccattcaaaaacatttgtatcatctttggaatttcagtgcttatcggacatccttccatacacattggctttttacaattcagacagcgtctcgcttcgctaactacatttaatgccaattcaaacacctccaatttatatttttatcctactatataacaagttaaaaagtcaatttaaaattcattttataacaataaattatttaaatataacaaaatattcaatttgtcataaaattaacattctcatttgataaaatctatagcaaaggcgctatcaaccttataaccctgcccaatattctagtaaccaagcttctatttttaatcgtatcttcagtaacttcttcacataaactcagcgtatgaacaaaatcactttccatatctttaatctgaggcacatcaaccaaataagccgcacactcataatgaagataaaggcttctataatcatgattaatggttccgattatagcacgcttatcatctgaaattgacatttttgagtgaacaaatccaggcgtatattcatatattttaactcctgctcccaaaagttctctgtaataagttcctgcaagccaaaaagcataaggcttgtccggtatatgagggaggattatcttaacatcaacgccgcgttttgccgcaaactttaatgcctgcatcatattggtacccagaacaagataaggcgtcattatgtgaacataatctttggcaagattaagattattaatatacatagtttcaccaaatctgtcctttttcagagggctgtccgcaaacggtataatatatccctctccctctttaaaatcaccatcagaagcagaatttatatatttatcataattatcttccttaactttattaattgaagtattccacatctgaagaaacatggaagtatatcctgataccgcgtcacctgttatttttatcgcgttatctttccaatggccgaatctttctctttcatttatgtactcatcggcaaagttaacgcctcctgtataaacggttttaccatctattaagataatttttctgtgatccctattattttgatatgttgaaaaaaaaggaactataggcgcaaacactcggcagtttataccaaattttctaatcgtatcatcataatcatttggcagaagagacatacatcccattccgtcatacattaatctaacttctacgccctccttagctttttctttcaatatttctaaaatttcaggccacattctgccgtttaaatttattataaacatttctataaaaataaacttttcagctttccttagttcatcttttaaatcaataaacatttggtcacccaaagaaaaatactctgccgacgaatttttatataccggaaacccggaataatcatatatatattttgatatacctatatcctcttgataagtttcagaaaatttttgtaagacatcagtctcctgttttgtatatttaagagtacggcctcttatttcgtcactgtgaacagcaattttttttgaggctctgttataatgcagaaatatataaagcaaagttccgaaaattggtataatagcaataagcattacccatgtcagtttaaaccccggttcttcttctctgttaatttcatatataatcaatacagcgctcagaaaattcataaaagtataaaaatatttagaataatcaccaagccaagcgctgagcaataaaagcacagaaagctgtgctatcatcataagaaggcaaaacaatttattagaatatattattttaaaaaaacgagtcatcatatcaccccaaacctaaaataaaattggcgtataaatcaaaaaaatgaaataaaacctgtaattattaaactatttaaaaagtcaataaacaacgctccaactatcggaacaactaaaaaagcctggggcgacggagcatatttatctactatagactgcatattcgccatagcattaggagtggctcccataccaaatccgcatgctcctgctgtcatcacagcagcgtcataatccttgcccatatacttaaaaattacaaaacgagaaaataacatcatcaaaataagctgggaagcgagcagaatcaacattggcagcgctaaatttgataaagtccatagttctaatgtcatcaatgccatcgataaaaagaaagacaatgaagcttcgcctatttcctgaatttccataaaataaactttaaacttccctgtgaaatcagaatagtttctaattgcagctgccacaagcattgcgcctatataggaaggaaactttaatcctgtcaatttcaaaacatatgaaaccaaagtaccaagtcccatagcaattacaatctgataaaaaccatatgaaaatccgctggctataaactccttaaacccggaaaccgagtcctcgatatcagggtcatccaatctatgttctacttctttatagagatttttcttttcaatcaatcttttagctattggtccgcctatggcgctgccagcaaccaaaccaaaggttgctgaagcaattgccacagatgtggctccgtcaacgcccatagcttttatagtgggaccaaaagcgccggcgcttccatggccgccaaccatgggtatggatcctgtacatagagaaagcaaaggcggaacattcaataatttacctattcccagagcgataatgttctggcagataattaaacaagcaataagaacaaggaatataaatatatgctttccgccttgttttaatggctttattgaagcattataaccaaccgtagtaaagaatgcaatcataaaaaaatcttgcaatgtggtgttaaagttaatatataaccagccaaactcatgacatataaaaactaatacagaaaaaatcagaccaccgataaccggagatggtatgcagtatttttgaaaaaaatgtattcgtctttttacaaactttccaaagaacaatagaccagtagccagcgctaatgactgaatcatatctaaatatattgtcatttactgcaactccttcttaaatgtctcataatcgtctttattcttaggaacaattatttcatcagaaattattttttgttttatgttctgtgttttttcatacaactcatctgaataattgtcatggtttgacggtatatctacagaaccattttccaatccaaaatagtatgtgtttttattgctgtttttaaaattatttttaattatatcctcagatacatattttgcaattgctctgcaatgtttcagcgcagacgtaagaacatttttgggcgcaatctcactctgatctacatcaacgccgataacccacctgtcattttgaaccgcagattcaataactccaagtccggcagctcctgcggcctgataaatcacatcattaccggctttatacatttcatcgccgattgaaaaagcttttgctaaatccacataagaaccaacatattcagaagatatattaatattagtttttctttctttagccgcaaactcaacaccggctttatagccatattcaaatgttgctatattatcgtcatttattccgcctacaaatcctacttgatttgtattagtggtcatccctgcaatatatcccacaagaaatgatgattcctcagttctgaacacaacgccgaacagatttgttgttttatcatcagagggactgtcaagtacaacatatttagattttgtattaaactccgcagctttttttgcatcatcaaaaaaataagccccgcaagcccatactaaggaaccattttcaccggcaaagtccagcttatttaaaaaatcactttcatttttacatgtcaaactttcaaaattaaaattattatcaccgcaaaaatcgtttactccgctttttgtttcttcaagaaaactatccttttcaactgaatccactactatatatatattatttcttccactctttgtatttccacaggcggataataatattgtcaccacaattacagacaatacactaaaaaacacactaaattttttcatattatcccccttaaaataacacatcaattattatttttagtatatcataatcacataaatttgtcaaagaaatcatataaaatttgtttatattttcaaataaaaaaacgcccttaaagggcgaaagtttatatatctaaatttgcataagcattgagcgacaagtcggcaatatttccattttgatactcataaaaacctgcgcatcctatcattgcagcattgtctgtacagaggataggcctagggtaacaaaactcaaattttttctcagcagctttgtcacttatagtttcccgtaacggaatattagacgccactcctccggccaatgcgacacggtcaacacaatactgctcagccgcttttataaggtgatccgacaatacgtcaactactgcttgctgaaatgaagctgctatgtcgtttttatttatctcaatccctttttgctcagcattatgtatataatttaatactgatgttttcactccgctgaaactgaagtcaaatccattacttcccatattaacacgcggaaaatttattgcatatttatttccggattcggcagctttttgtatctgaggtcctccgggatagccaaaacctaaaacgcgcgacactttatcaaaagcttctcctgccgcatcatcattggtttttgctataacatcatattcaaaatatgatttaacataaataatatggctatgaccgccggacgctaccaaacaaataaaaggaggcttaaaatcaggattttccaaataatttgcgcatatatgccctttaatatgatgaaccggaatcagcggcttatccagcgaatagcttaaccccttagcatatgacacgccaacaagcagcgctcccacaagccccgggccatatgtgaccgcaacagcgtcaatatcctcaaaagtcagattgcagtcatcaagcgctttatcaacaacagcgcttatgttttcaatatgttttcttgaggcgatttcgggcaccacaccaccatatagtttgtgcaattcaatctgagtatttataacgttagataaaatattagttccgtcttcaactacagctgccgcagtttcatcacatgaactctctatagctaatattttcataatttaccaccttctataaatcctttgtcattaatatagcgtcagaattatctttataatatttttttctttgaccaactgatacaaatcccattttttcatataacgatatagctgcaatatttgttgattttacttctaagtttatatacttgcatttattttttttagatttctctattatataatatagtatagttttaccgattccctgtctccaaaactcaggagagacagcaatattagttatctcagcaaaatccgcaatgaaccaaacacagcaatatcctagaatagcttcttcgtcgtttgacaaagcaacaataaatgaagaaattttgttctttacttcactttcaaacattaatcttgtccatgaatctcccaggaaacatttttcctcaatcttaagaagcctgtcaatatgactttcatccataggtttaaatatcatatccataactattcattagcctttatacgtaatataagtttttcaatcaaggattttatatcaatcatacagctcttataaagattcaaatctccgccaaaaggatcagatacgtcacttttctctccaacaaattccgcaatcgtataaaccttattttttaaatcaggaaattcatttattatcgccgacttatgtgacgatgacattgtcaaaactaaatcagcgtcacttattaactgaaaatccaactgtttgggctgatgttttgaaatatctatgttttcaacactcaaagcgtccactgagttttttgacacttttgaacacggcaatacatagataccggcagaacttgctctaacattcaaattttcattttcagccatactgttaaatattccttcagccataggacttcggcaggtatttccggtgcaaacaaataaaatattatgaatatcttttatttcagattttatattaggattaattctagattttttaaaataatcttttgtgtcaactattctatttccggcagctctgtataatctgtttctaacaccgctccatttatcagtacttgggatttcaggagcaaaaactctcttcacgccacggttgtccatttcccttaaagctttaaataaagaacttgccgcttctttcggagacttcatactcccaagcgagataatctcgatattgggactaatttttttatttagttctgaagaaaactcgtcaaatattagaataccgcatctgtctttctgaccgtttacgcaattcactacttcctcaaccgaacctttaacaatgataacctctgcttttggagaatagtgcttatatttaagacctggagatttgggcttttcattttcttttacttccgatactgttttaactttacaattcagtatctgttcaatttgttcagccgtaacatcacccggtctgtatataataggttcacctgataaatctataaccgtggactcaataccaacattacagtcgccgccgtcaattattgcatcaacccttccgttcatatcgtctacacaatgtgcaaacgctgtgggacttggtttgcctgacaaattagcgctgggcgcggcaatcggaactcctgaaagttctaaaagtctctttgcttcaggctgtactggcattcttacacctacggtatcaagtccggccgttacttcattcctaattttgttgcttttctttaagataattgtaagcggtcccggccaaaatttattcattagttttttagccgattccggaacttcacttactatctcgttcaactgcttaacatcataaatatgaacaataagcggattgtcagccggcctgccttttgccgtaaatattttttttactgcatcaggatttaacgcgtcagcgcccagcccgtatactgtttcggtcgggaaaacaacagttcctcccgaccgaattatctcagctgcaatattcaaatcattctcactatttgataataatttagtttccataaacaacacctgaattaattatatatttccctcagcttgagacttcagcttttcactttggtcagttgtaatcaaagcgtcaataatctcatctaaatcaccgttcattatctgttccagtctatacaaagtcaaaccaatacgatggtctgtcattctgccctgcggaaaattatatgttctgatacgttcgcttctgtcaccggttccaacttggctctttctgtcagcagctatagcggcgctccgctcctgctccattttatcatatagtcttgaacgaagcattttcattgccgcttccctatttttatgctggcttctttcatcctggcatgtaaccactattcctgtaggtttgtgagtaattcttatcgctgattcagtcttgttgatgtgctgaccgccggcgccgctcgaacgataagtatcaatttccaaatcatccgggtttatctcaacctctacatcatcaacttcaggcagaacagcaaccgtaacggttgaagtatgaattctgccgctcgattcagtttcgggcactctttgaaccctatgaactccgctttcaaacttaagccggctgtaggctccttcaccattaatcataaacgttacttctttaatgccgccgattcctatttcacttatattcaaaacttctattttccactttttactgtccgcatacattgaatacattctgaaaaggtctccagcaaacagtgccgcttcatctccgccggcaccgcctcttatttcaaccataacgtttttatcatcattaggatcttttggaagaagcaatatctttaattcttcttcaattttttcaatattggctttagctgtttttgattcatcaacaagcatctctttaaattctttatctgtatcagggtcatccattaatgcgttagcgtcttcaattgtttccatattttttttatattctctgtacttttcaacaattggagtaaggtcggaatgttccttacataatttacgccaagtctcctggtccgcgatgacctccgggtcacttatcttttttgccagctcttcaaactgttcttctaaaaatgatagtttttcaaacatcttattctcctcatagttttaattatatctcaccttttgattttgctttaagatacgcgttaataaatccgtcaatatcaccgttcataacagcgtttatattacctgtctcatagtttgttctatggtccttaaccatgctgtaaggatgaaaaacgtatgaacggatttgatttccccatgcaatttctgtctgtacaccctttaaatcgtcaattttgtctttctgttccctctcagcaatctcgacaagctttgattttaaaactttcatagcagtttctttatttttatgctggcttctttcattctgacatgtgaccacaatacctgtcggcaaatgtgttattcttatagcggattcagttttatttatatgctgaccgccggcgccgctggagcgataggtatctattctcaaatcctcaggatttatctctacgtccaactcctcgtcaagttccggtattacttcacaggaagcaaaagaagtatgacgtctggcggctgaatcgaaaggtgaaattctaacaaggcgatggacgcccttttcagattttatatatccatacgcattcagtccctcaatagaaaatgtcacgctttttataccggcttcttcaccgtcaagataatcaattacctcggttttaaaaccttttctctccgcccacatattgtacattctatatagcatttcgcaccaatcctgggcttcagttccgcctgctcccgaatggagagtaataatagcgcttaatttatcatatttaccggagagcagtgtatcaagcttcatattgtctattttttcctgaagctcgctatatccggactttacttcacccaatacgctgtcgtcattctcttcaattcccagttccacgagggtagaaacatcctcccactggtttttaatatcattaaaaccctgaaccttgtttttcagcgattttattttctgcagtatctttccggctttatccatatcttcatagaaacccggctcaaaagatactttttcaagttctcctatttcacattcaactgcggacaagttaaagtgaatccctcaattcagtaatatctttttccatgctctcgagccctaacttaaactcatcaaacgctatcactttatcacctcaataaaatttatttatatagatatatagttatatatttccattatcacggtccttatcaagacagcagttcttatactttttacctgaaccgcatgggcaaggatcgtttctgcctatctttgtaacccttcttatcggcttctttttaacagttccatctccgcctgcattttcagcaatcggttttgctacctgctgtctctctatctttgactgaggtattacatggaacaaatgctttattgtatcctctttaatggattctgtcatctcttcaaacatatccatagcttcaaacttatattcgattacagggtcatgctgagcatatgcgcgcaggaaaataccctgacgaagctgttccatattatcaatatgatccatccacttctggtcaacaacacggagcaatattatacgctcaacttcacgcatagcgtcgccgaacatttcttctttctcagcatattttttctcggcatcttccattacgtaatcagtcagtctgtcctgagtcattttgtcaatttcaacatcagtgaatttcaggaaatcttccggcatttcaccaagtatggtttcaagatggtcttttaagccttcccaatcccattcttcaggagtatttcccttgtcgcctatatatagaccaattacaccactgaatacgtccttcatcattttcatgatgctgtctcttaaatcttcgccgtctaaaacttggtcacgctgtttgtaaataatctctctctgctgattatttacatcgtcaaactgaaggacattttttctgatatcaaagttctttccctcaactcgctcctgagcagtttcaatagctccgctgagcattttgctctcaatcgcgtcatcgtcttcaagtcccagcgtattcataactttagaaatacgctccggcgcgaacaagcgcattaggtcatcttcaagtgaaatataaaatttagatttacctatatctccctgacgtcctgaacggccgcgaagctggttatcaatacgcctgctttcgtgtctttcagtacccataatatttaaaccgccggcttcaagaacttccttttgctccggttctatttcagatttaaatctatcgtttaattctttaaatgttttgcgcgcttctataatttcctggtcgtctgtttcggcaaaaccagttgcctggttaataagctcctctgaaaatcccatcttttccatctcatgcttagccataaactcagcatttccgcccagtacaatatccgtaccacgtccggccatattcgtagcgattgttactgctccttttttaccggcctgtgcaactatttctgcctctttatcatggaacttagcatttaagacattatgttttattccgcgctttctgagcattttactaagcttttcggatttttcgattgacaccgtacctattagtacaggctgacccttttcgtgagccgcagccgcatcatttataacggcattaaacttagcgtcttctgttttataaacgctgtcatgctcatcttccctttgcagaggcctgtttgtcggtataacaataacatcaagcttatatatttcctggaactcttcttcctctgtctgtgccgtaccggtcatacctgataatttcttatataatctgaaataattctggaaagtaatagtagccaatgtttttgactcattttctacagttacgccttcctttgcttcaatagcctgatgcaaaccgtcattatatctcctgccgaacatcatacgtcctgtgaactcatctactataataacttctccgtcttttacaacatagtccttatcctttttcattacaccaatagctttgatagcctggttaatatgatgagacaaagtcatatttgccgggtcggttaaattttcaacatgaaaagcttcttctgcctttttaacgcctctaggcgtcagcattgcagttttagctttctcatctacaatataatcatattcgttaagttcatcttcgtcttctacctcaacctttgagtctgtttcaactacctttttgaattttaaagtctttgcaaacctgtccgcttgagcatacaaatcagttgacttatcacccattcctgaaataatcaacggcgttctggcttcatcaattaatatgctgtcaacctcatcgacaattgcataattatgtcctctttgaaccttattctctttatatatcaccatgttatcacgcaaatagtcaaagcccatttcgttatttgttccataggtaatatcagccgaataagctctcttacgctcagcattgtccatatcatgaataattaagccaacgcttagccctagaaagctatatagttttcccatccactcactgtcacgctttgccaaatagtcattgaccgttacaatatgaacgcctttgccttcaagagcgtttaaataggccgggagagtagcaaccaaagtttttccttcacccgttttcatttcagctattctgccttggtgaagaacaacgccgccgacaacttgaacagggaaatgcttcattcccaaaactctccaggcagcttcacggcaaaccgcaaaggcttcaggaagaatgtcatcaagtgtttctccgttacttaaacgttttttaaaaacttcagtcatagctttaagttcagtatcgctctttttttccataacaggttcttgttcgaggaccttatcaacaataggatagatttttttcaattccctgtcgctgtatgttcctattactttctcaattatcccttttatacccataaaggatacctccaaaatctcatattattttcaaaattaatataataaatctataatttatactttgtaatttccataccatttatgttatatgttaaacaaactgtttctaaatttaaacacatactggtatattataactccaaacaaattttattgcaagagttttgttacactaaataaaagttcgtaggcttatatatttaaataatgtaactatatgattaaaaactgcaaacaaaaagcaggcattcacccataaaatttggcgtgtatacctgcgtaaattatatatttagaaaatttatacatattttctgtacacaaataataacacggccaaataaaattatataaccgtattatctattgttttatctgctctatcgcattcaaagtgtttgtaacaagaagttcaggcagtgcagaaccatctactttccagcttccgccctcttttttcatatttacatcaatagttttcgtaacattaggaactccgccgttatccagcacatttgcaagctggtcgtccataagtttttgataatcctcttttgtcattgtagcaagattattctgatattccggacttgagaccatcgcagcaatattttctatatatttctgcattacttgagacgcgtcaataagagtaatatctgcattaacaacagccttttttgcacttgacgcagtaacagaattaatatcatacgtcacattctttaacgatgacagaattgcagctcttaaatcagtattatcatttatctcaactgaatcacagtagttttttatctgctcaacattaccggatttaaatgcctccatggtttctgaaaaagcttgttcagcttcctgtcttgcctcttcagtgtttccgccgcatgatgtcaaagcgccgataattaatatcaaactcaaaagcaaagcagtacaggaaaaaaactttctcaccattatctttcccatttcatcactcctaacaatttataactatgattatacactaaaatattaaaatgtcaacattttatatgaataaaaaaaggatacccaaaacaggtatcctgaaataaacactttacttataaataaaatattaatccactatgtctatttttctactccgcagtacatttttgttgccggtctattttgaatttgatccaaggcttctccaaatctttggaaatgcactatttccctttgacgcaggaattttataacatcgtttacatcagggtcgtctgatactttcaaaatattatcatacacaacccttgctttttgctcagcagccaaatcctcggttaagtctcctataggatcgcctgttgaagctatagccattgcatcaaatgggactcctgtagcatcagccggataaactgaccttccgtgattcatgaaataagcgcctaaaggactgttagcaatttctttatcacttgcatttttagctaactgtctcaccagggttccaacaatttctaagtgtgcaagctcctcggttccaatatccgtaagcaaagcctttgtcataccgtttggcatagcaaaacgctgtgataaatatctgagcgaagctgcaagttcgccattaggaccgcctaattgtattatataataaatcttatataaatctttatccttcttttattcttagttgtctgcttctttcgggcaatctattattatattgttttccacagctgcaaataatatgaaacgcataatttactactttatttctatctatgtaaaacagctcctttttacaccgtctgcaaacagccactccatttataatatctatataataattttctgttgtatcaggattgccttcttctgtcctataaacaacctcagctccgcatttacataaataaactaaaaacaaatatttataatctctcaatattattcgtcctaaacgttcgccgcattgcgtacaaaaaacttgaccataattttgtcttccgattctaatattacgtctgtatgcttccctatgcaaatatatcactcccaaaaaactatatgtaatacctattttaaatatccttctttgtcttttattattaaactgacaaaatataggatattttatcaaaattctcaacatttcaaaaggaaatgtattgctcaaattatatattttgtaactaaattttactgcaatttttagaaattgatatatctattttatataatatactcattttataatttcaacttatttttttgcaataaacactaataatatatatattataattagttctatttatccactattcactttatattattattttttatatacgtattatattcgggtttccaaactgctttctgtaatccattgctcacgtattcagaaagaggacaggcaatatgttcaataaaatctatactataatcatatggtttagtactgccatcagataatattactgatgaacttgcagaccatggctttatattccatttttttctgtttgaaatatcattattttttattccattttctttcataaaaccacctctgttaaaaaatatacttataactgcttatccaatataactctaaaatctatatttttataaaaaacaaatttataaagttcatattaacttaattaaatacaatattttttacagaaatataagctctaatctgaatttttgtgttatctaaaatggattttttatatattttttaatttattatgattgctagatacaaaaccgtcatattctttatagtgtacttgtatatattatttgaataatcacaattttctttttattatatctaacagaatactatgaatcaggtgaaattatgaaaacagcagcttgctatattcgagtatcaactgaagaccaattggagttttccccagacgctcagcttcgggctatgagaaagtattgtgacgaaaactacttattgctgccggatgagtttatttatattgatgaaggaatcagcggccgcaatgcaaaaaaacgccctgcatttcaaaatatgataaaaaaggctaaatcaaccccaaaaccatttgatgtaattttagtacataaattcgaccgctttgccagaaatcgagaagacagtgttgtatataaatctttattaaggtctgagctaggcattcaggtattatcaataacagaaaatatcggcgatgacaaaatgagtgtaattatagagtcaatgcttgaagccatggctgaatattattctctcaatctttctgacgaagtaaaaaaggggatgagcgaaaaagcgaaaaaaggcggcgtacaaacaaaaccatctttcggatatacggttgttgacaataatttttcacctattgctgaagaagctgttatagtaaaaaatatatttcaaagatttgtttcgggtgagtcattcggacaaattgcagctcgtttaaattcacttgggttacgcactaaacttggaaatccttttaggaaaagaactatcgaatatataatatccaatccagtatataccggaactttaagatggactcataaccgaaaatccgaaaatattaatgacactatttatttagaaaatcaacatgaacctattgttgaaaaagacttatggattaaggcacagaaacgttataataaaataaaaactattaaccgcaaacatttgaaagaccaagctgacaagtcatactggctcagcggtctgttggtttgcggcagctgcggctgtacactcgcacgaagcggagattatttgcagtgctgcggatatattaagtccgcttgcaatgtctcacattcaataagtataaaaactgctgaaaaaatagttatagaacaattgaaagcagactgtttaaaagcagaatcagctcagataataaaaaacgcaaatacaaaaaataatgatgaagtattgttatataaaaaagctgaaaaacgcttaaaaaaatcattagacagagctaaagaagcatatctctcgggaacagacactttagaagaatatagtaaaaacaaaataaaactgcaaaacgaacttaaagaaatacaaaataattcaatttgcgatatagcagataatcataaatatattaaacagacaaaagatattttagattttattcaggataaagatatttcagacgacgataaaaataacgcattaaaacaaattgttgcaaaaataatttatattaaaccggaaaagcatctagaaattatatattattaatttattataaaaagcaattaggaccgccgtattggcttacaatatagttagcaaggctaggattcgtagtttttatatttactggatattgtaattttttttgataattccacatatattcttccctccagattatgtgttaagttaaacaattatttttataaaagtaattaaataaatattgtcattggcttttttgtcatgcctgaatatagttatcaaacattatcccacggccatggttcttcaatccaatcaaaacattctgtgttagtcacattcatagtagttaaaggaccaaacttttcctcaaactctttacttaattcctttgccttatcagccattcttctgtgcatcataaggccatctctatcatttggatgagtatccaaatataggttccattctttttccgcaaagctataggcggataatttttttaataactcttctctcgcattcatattacattcctccgtttttaaaaattatgtcgccttttgtttgctttccatacacacccataggtttatttaaaatagggaatatagttccttccttaagaccgtactcaggatcaaacaaatttctcatttcggcctgctgcataggcacataggcatagccaacaagcggcatttcaagaggcacggtttcatttgcaaatggcataaaatcattcctttcaaattagttggctcgaataattaattaatattttgtttcgtcaaaaattgacatctcaagcctgatatattatatgattatataagtaatttgtgctagaagcctttaaggaatatattatttacatatacaaataccggcaagatagtatttgggagattaattcaaaacagttcactaagattgtggtaaaagctataataaaaaatcagtatataaaaaacactgtaaccaattaaaatttgattacagtgtcttttaatatcatactatttttataagacggtatcttaaccgtttatccagctattttatatcattttttaagaattcgcgtattgccttttcaaccatatcaacctcttttttaaactcatttgccgacaccctatatgcaccgttcccaaggattattaactgttccagtccgtcagaagtcgctactctaactctatgttttttacttagctgatgagataccttctcaatatacatatcggcagtttccttttctttggtataaacaatatttatattgtgatatttttcaatttcgcccgggttatttttgaccttataagcgtcaaacactaatattacctgacacttgcaaaatccctgatagttacacaaaatatttataagcttgtgcctagccatatctaaattttcatcagcatattctttcaaattatcccaagcatatataatattgtatccgtcaactaatagataatcctctccctgttcttttttaggtttattctttatcggcttattgttgttaacatgagacttttttgtatataacgcagaataggtatcccgttttataggtccgtaagtgttttcaaatattttcattaattctttatcagttacaacactgctgatatattctgatgtccttttctctgaaacatcaatttctttttgtaaaccatctatatcaaaaccactgtcaacatgcatataatcccgaacttcattccatttcacaacaaatcccgctccatgagaacaaaatacagaatcagcagtattttcaatatctctttcactgtcatatccgattttttcaatgacttcatcggaattattacatggctcatagccgtttggcaaacatgtaagtcttcctctgccttttgtatacatactgacttcactttgataatccatcatcccggacaccggcgcagatcctgaaattactgtcatatcaacgccattattctccggctgtgaaaatcttcctcccatctgctgtatatccgtcattgctctgcctatcgaatcagtcggaacttctaatttaaactcataccaaggttccaggagaatgttcttagtcatttttaagccctgtctgacagccctatacgttgcctgcctgaaatctccgccttcagtatgtttttgatgagcccgtccggccactagtgtaatttttatatcagtgattggggaaccggttaatacacctatatgagtcttttcttttaaatgcgtcataatcagtttttgccaatttttatccagtttatcttcattgcacttattataatactttattccgctgccccgctttcccggctgaagaagcaaatgcacctctgcataatgtctgagaggttcataatgaccaacgccttcagtctgttccgcaattgtttcacgatacgctatatttcctcttacaaagtcaattttcattccaaatctgtcaaaaactatttgcttcaaaacctcaagctgtacctcgcccataagttgtatgtgtatttcctgaagctgttcattccacataacataaagctgcggctcttcttcttcgatctttctcaagtttgaaagagcgttatgcaagtcaatatcagaaagcaattcaactttataagaaagaacaggcgttaatagagcagattgagaattctcttcatctcccagcccctctcccggataagtgtttccaagaccggtcacagcgcagattgttccggccttaacttgttcagctgcatgaaactttgttcctgaatatatccttatttggtccactttttctgaccagttttctccatcagatgttgttccgtccagaagctgctttacctttaaagttccgcctgtaatttttaaatgagttaaacggttaccgttgccgtcgtctgatattttaaaaacttttgccgcaaaatcacttttataatttatactttttgtatacttatctaatcctcttaaaaactcatccacaccactcagcttaagcgctgatccaaagaaacatggaaaaacacagcgttctgatatagcctcctgaatatcagattccttaatttctcccatatttagatactgctccattaatttctcactgcacattgctatattgtcataaaaagcttctgagccaaaatcagacgagaaatcaacacagccatcgtccagtttatctcttaaattcagaattatatctctatggctgctttcagcaatatccatcttattaataaacaaaaaacatggtatttcgtatcttttaagcagcttccacaaggtttctgtatgactttgaaccccctcagagccgctgattactaaaatagcataatcaagaacctgaagggttctttccatctcggttgaaaagtccacatgcccaggggtatcaagcagggtgaattcagtatcattaatgttaaatacggcttgcttaagaaaaatagttattcctctgtcacgctcaatcgggtgtgtatccaaaaatgcattgcgatgatcaacccgtcctaattttcttatttcgcccgcctgatataataggccttctgaaagcgtagttttacctgaatctacatgagccacaatgccaattgcaatttttttcatatactctcctaccttgaaactttgaataatagctattttaaatcactgactttggaaagagaaatattatattgcttgccgcaatcacatataacatgaaagccacaattaatgatttttcttttatcaatataaaataattcttttccacagcgccggcacgatgcaataccatttttaagctctataaaataattttgcgtattatccggattttcatactttgtttgatatacaacttcacatccgcatttgcatataaacacaagatataaatatttatagtctttactaattacatgtccaatccgttctccgcattgagtacaaaagatttgtccatagttttgtctgcccattctaatattacgtttatatgcttctctgtgcaatttaaatcctcctaaataatacaaaaatatttgtttaaataacacaatcttttaccttgtctaacacattaacttgaattatacttaaaaagtcagttatttatattttatttttatttgaaaggcagattaatatgaaaaagcccattggttttactttgaatttccaggcgcagaaatgtgacgatattgttgaatatattcacattcagaatgataacgctgatgatatatcaaatatacatattgaaaacggatgctgtacagacatttatatggaagacttgtatttcaaaaatacaatatttgagaactgtacgtttataaattgtaatcttaaagactgcagctttaataatgttaaattttataaatgcctgtttaaaaattcaaatttatcaaacggatggtataaacaatgctcttttgaaaactcacaatatataagcaccgattttaaaaacagtaattttaataacgcctgtctttatcaaacaacaaccaaatattctaactttaaccgttccgtctttaacaacatcataataaacgactgcgatatgtcagacacttttttctcagattgttcatttaagaatacggagataaaagagtctaaatttgtgcgcactgaattctttcaaaccagtcttgcggggctggacttttcaaattcaatacttgaaagtatcattatgtcagacaatgcaaaggaattatccggagctaaagttaacagttatcaagcagcagagctgtcaaaactgcttggattgattgttgttgactgatacattaataatattatttatatatattattttaaaacattttcccattccttttctttaaagcctattaaaaccttatcatcttttataacaagagggcgttttacaagcataccgtctgttgacaaaagttttaactgttcttcttcagacatatcatttaacttatcttttaatcccatagaacggtacagcattccgctggtgttgaaaaacttttttagctccaatccgctcatatcataccattcttttaattcatcaaaacttggattattttcttttatatcccgaacagtaaaattaactccattttcattaagccatttctctgcctttttacatgttgaacattttggatagcaaataaattttatcataactctgttatacctttctttagtttctatatttttataaaatacttttttatctaataaaccttcaatctctcacatataaaactaataaataatattttaccatacatattaaaaaatgcaagataaatattagaatatatcgcactataccaacataaaattacttcaggaggtgcgacaaaatgaggatatggttcgtcggtaaaaaaactggtatcgccttgggcgctatcgtaattctattttttgcattaattttatttggacatatcaataaaaattctgcagccataagcgctgcaagccctagcgaccgagacttaccaatatactgcgttgaaaaagatgaaaatgacaaaaaaattgccatttcatttgatgctgcctgggataactctgatacggaaacacttaagaacattcttggagaaagaaatgttaaaactactttttttgttgttggcgattgggtggataaatatcctgattctgtaaaatccttatcagacgcaggacacgaggttatgaatcattcatcaaaacatccgcatatgactcaaatatcaaccgacaaaatgaaagctgaacttgacgactgtgcaaacaaaatcgaggcaataacaggcagaagaccaaatctcttcagaccgccatacggagactacaataatgaagttgttaaaacagctagagagtgcggctattacacaatccaatggagtattgacagccttgactggaaagatttaagcgctgatgaaatatataaaagagtagttcctaaagttaaaccgggcgctattgtattattccataatgcggctaagcacacgccggaagcactgcctaaaattttagatgacttaatagcacaaggttatgaaatagttcctatatcggaattaataataaaagataattatcaaattgatgcaaacggaatgcagtacagcacaaataatgaaaaatcggaggtcaacaacaatgtctgaaagcacattcaccgaaagcagctactatgacaataatattgtcacactggtgggaaaaataatttcaccgcctgaactgtcacatgaaatctacggagaaaaatactattctactcagctggccgtcagcaggctcagtgaaaaaatggactatatacccataactatatcagaacgcctattcggtgaatattatcctacacctaacgaccatgttaagattataggtcaataccgttcttataataattattccggcgtcggaaacaggcttatattaacagtttttgttaaagaaatactttatatttcagaagctgacgaagaagattttgaaaagtcaaaatctatgtccaacgtaaacccaaatcaaatatacttaaacgggtttatttgcaaagagccaacctatagaacaaccccatttaaccgcgaaatatctgacgtattgctcgccgtaaaccgttcatacaaaaaatctgattacataccgtgcatcgcatggggcagaaacgcaaaatatgtacagtcgctgtctgtgggtacaaatataaaagtttggggaagaatacagagccgggaatatcaaaaacatataagcgaaaccgaagtagtcaataaaaccgcatacgaagtttcaatctcaaaattagaaatagtagaatagaaaaagggtggctaaacagccaccctttgttgtcattttcatcacactcatcatatccactgacaaagctcaaaactctgcgtcctatatgctttagatttaacttccattgctgcccctgcagcaatcaacatctttcaaatatctaaatacatcgacgaaaacttcaaataatacttttcaaacaataattgccagcaatctgtgagttaattgacgcagccaagacatattaagcaatccgacttgtcaaaccatttgtttatttcaaactttttcggagccctcgcacttgctcaagcgaccaatagttaaataaacatatttacgagtccaaatactcatcctctacaagcgtgcttaactgttatgcttgctcgtattcatctattgagataaatacgagtgcgtcaatctgtgaatcaactgactcttcttgagtcatccacacatcgcatcacctccgtaacagccacttttataaatagccgtgctttgtgtttttaactccccatacgatttatcacagctttgttccgctataaagtttaattaataacgaaaagtttataaactaacataataataaatctttaacctttttatcaacttattaaaatctttcagcattacatttaaattcaagtatcaaaacaatttttataaaactattaaacacacatcatcaaaacttctctgcattgttagttaaaactttcatttttaaacttacatcctcatcataaactcggtaaaacttccagtttaaatgcgagtttgcggaaaccatataagagctataaaaaattcatttgctcttgttcctgataaatctatgagatcgataaataaagaaatataaaaatcattcaatctttttaagattttcctaatcagcattaatattaatttaaatttctaagtcagccatttagtaatacattaaactcaaaatattacaagacgcagccgacaaatagtttctaaaccaaagtccaaatcctcaaccaaaataatatattagatttgaattcaacttttcatttctcttctgaaaagtctgtgtttaaatttcatttcaatacataaacaaatacaaaagaaacaaaataataaacaaatgaaaatcttaaatcagctcattactataaaaatcatctttaaacagtttatcataccagtatcaaaatttgacttagtatgtgtgagcttttagattggtaagctttatatttacttcccttatcttggttttattatacacccgtattcctattttgtcaagatttttaataaaaaatattcaaaaattctaaggccaaaaatctacgttataccaccactttttagctctaaacagacatatgtatatttttataaaaaagaaaataaaattactgcaaaatactatatatatttctaaaaatccaaaaatattactgtattcttgccatataaaaataataatattttaaatcacaaaaataaatattaatatctaattaattgtgcaatataaacaataagtgagtaatataataaaacactatttaatcaaacaaaacaggaatataatcgtttattttcaaactaatttccgttaccatgctgtcaaaagcaataatttttactccggattcagatgctttcttcaaatcctttgaaaaagttaaatctgttcttatattaggtttaaaaaccttaacaccggacatttgtataatgaatacaacataagcgtcatatccgtctcttacagaatcacttaattccataagatgttttcttcctctctcggttggtgcgtccggaaacatcgctgtaccattttcttcaagcgtaaccccttttgtctcaacaaatatttttttgccgtctgcttcaatataaaaatcaaaccttgacgttccatattttgtctccggttttactaacttaatatcattaaataatttgttttcgttaagccattcattaaaaaccttattgggagcttgactgtctatatttatcaaattgtcacccttatatacagaaatcaaatcatacttagtctttcggttaggatttgaagatacctccaaaaaaacagatgcgccgggaacaagcagctcccgacaccttcctgtatttttcacatgacacatctgttcagctccgtcaacatcgacaattgcaataaatctatttggtcttgaaacaaacctgcctgatacaacattattatatatcactatatattcaccttataaattcttatttactcagtaacagtactatcccatatacttaaaattttctctgccgtatttttaaaattatcctcactatttgtctctaatatcgcattaatcaccggagtatattttttagcatacttaaacagatactcataatcaaaaacgccgtctccagccaatcttccttctttttttccgtctattacttcataatctttaaaatgaagaatacctatcctatcaccgtatagactgtatacttcatcaactattttatgctgttcatccctatcattcatatctgaaatatttacaggatcatatataatagtaacattcggagaatctatttcgtcaaggaatctctttgtcattttagggttaaacatactatgttttgttacagtctctaccccgacaatacttcctaagttttcagcacagtcaactatttcgcgcatacttttaaagaatcgctgataattctcttctgtatgagtttcttcaaatgtattataaaaccctgtttctgttccaaccatatcacagcctaaatatttagcaaatttcagatgagctttaaaccactcaacttcttcttttcttttagcttcatccggatgaaccgggtttatgtaacaccccaaaaccgacactctgactccgtgttccgcaagagtgtttttgatatagcacccgagttccggagtaaggatactattctgccaatttatatctttaaaagacttttttaaagccagctgaacgtgagcagcgccggcctcttcaaggatttttgccaggctctcaatatcagttgccttagtatcatgacctctcattccaaaatttaacttattaaacatgttaacacctcaaattcaatattatattttcgccgctattctatgtattttataatactaataactacatataatagatttcggctctcagtattatgaataattatatatcaagattttaattttgtacactgaaattttgttatttataacattttttcagttgtcttacaataaatttcttgtctatttcatatcgttgttataaaatacccattggaaagaattatatattttctcttggaggtttttatattgagtaagcaaagatttttagaaacagctaaaaaaatggcggatactgtcatgaaagataattcacctataataagtaaaaaatggcagtatgactgcggacttaccttgcttggaattggctcggtatatgaagaaacaaacgacagtaaatattttgattatatcaaagagagtatggactattttatcaacgaagacggaactataaatacatataatccaacagtatataacatagaccatataaataacggaaaagactgcttttggctctacaataaaacaggcgaagaaaaatacatcaaggccgttgagttattaaagtcacagctcaaaacccatcctagaacggaatcgggcgcgtatttccacaagttgatttatcctaatcaaatatggcttgacggattatttatgggtgaaccgttctgtgctcaatatgcaaaagagtgcaaccatcctgaaaattttgatgatatagtaaaacagtttgtgattgcggaaaaagctacttacgaaccgcgctgcggcttatatgcacatgcttgcgacgaatcaaaatcagccttttgggcagataaggctaccgggcgttcactcaatgtttggggccgttcatgcggttggttctgtatggctattgttgatgttcttgactttatgcctgaagaccatcccggaagacaaactctaattgatatgtataacaaggttatttcaaatgttgttaaatatcaggacgaaagcggcgtttggtatcaggttcttgacaacagacgcagcgataattataaggaatccacttgcagctgcatgtttgcttattctatgaacaaagctataaaaatgggatatattgatgaagaaacttataaaccttatctcttaaaagctgttgacggaatttttaacgaatttattagaatcgacggcgactatgcttatcttaaaaactgctgtgctgttgctggtttaggaccggatgacaatcacagacgtgacggaagccttgattattatttcagcgagccgattactgaaaacgactgtaaaggtgttggaccattccttctgctcgccacaaattatatttattaattattataaaatagctcaaagacaaatgtctttgtaatggtcatctatattgctgtatatttgtgcaaatccggtgtttttgttgaactaaagcaggagcagttgttcaagactattcctcaaacacatgatttatttgcattgcagtttggttgctgagattttttaacattgatgaccactttttaattaaaattttaatcaacgtaaatattaaaaaaggcatgtattcgcttatgaatacatgccttaaatttttagaaaagtgattttcgagaaaaatttaagcaaaaaagaatggctcactcaatcgaagaagctgccagcgagactgactaatggagttaaaacaagccaaatcccattgagaccaaaaatcagcctcttcacgcattggtggaatgttttaaagcattagttttttgcacaccgccaaatttttcataagcatatctacccatttttccacataactttttgcagagatactatatttgtttgctaaaaacttgtatccaacgctcccatttgaatattcctgaactattttcttttttaattcaaactatattttgctataaaaaaccgacctcctagtcgttagattttcggtctaactttttggggtcggttcaatacaaggtctttttatattattcattgcaagacttagtctttactatatttattacttttaaattaatatctcttttatacgcgaaaatttgatctgccattttcacttaatattatattattcataagaacacatacatctctaatctacagctgttccattggagcgtccgggtcattaatactcatatgttttaccctatctctgacctcagcctttttagcgtcattaaacctatccaatgtacctgccaaataacctgttactcttcttattctttctataccaataacttcaccgttttcatcagtatcaagcgcacttctgccgcacttaggacattcatcgtttataattccggtatatccacacaccggatcacggtcaacagggtgattaatactgccgtatcctataccgcattctttcataaatcggataacattttcaaatgcttctacatttgttgtggggtcgccgtcaagctcaatataagatatatgtcctccatttgttaatggatgatatggagcttccaatcttattttctcatatgcgctgataggataatatacaggaatatggaatgaatttgtataatattctctgtcagttaccccttctataacaccgaatttttctctgtcaatgttgacaaatctgcctgaaaggccttccgccggcgttgctatcaatgaaaagttcattccatacttttctgtggcttcatccattcttttacgcatatgcccaacaatttcaagacctaaattctgagagcgctgagattctccatgatgtttaccggtaagagctttcaaacattctgcaagtccaataaatccggctgtcaaagttccaagtttaagaacttcacccacagtatcatttggaccaagcttttcagaatccagccatatcccctggcccattaaaaacggatagttttttacggtttttgcagcctgaaccttatatctcgctaaaagctggtcgattaccaaatcaatctttctgtcaagctcatcaaaaaaccaatctatactgccgttggcattaatagctatacgcggcaaatttatcgaggtaaaactcaagtttcctctgccatatgttatctctcttgatttgtcatatctattggcaacaactctcgttctgcagcccatatatgttgcttcagtctcaggatgcccctctttataatattgaagattaaaaggagcgtcaaggaaactaaagttagggaataatcgtttggcagatacacgacaggctaatttaaacaggtcgtaattaatatcttctttattaaagtttataccttcttttactttgaaaatatgaatcggaaaaataggcgtttcaccatttccaagacctgcttcctccgccaacagcagatttttcataaccatacggccctcttcggaagtatcggtgccataattaagagaactgaaaggaatctgcgctcccgctctggagtgcattgtattgaggttatggattaaagcttccatagcttgataagttgccctgtcagtctcctttacagaattttctactataaatttaaccgctcttttagcagactcattactcatcttttcttcaagcttcttaagcagaatttctccatactctgcggaaccggctaatgtcggctcaattttctgctcagattttatgtcggaaacgatttgtttagcagtgtcttttgcattttcgtcgccgctaagcattgcaagagcagaagatagatttgaaataaatttcttcttgtaggtttttgcaactcccggagccatacaaaaatcaaagttaggtatactttgtccaccatgctggtcattttggtttgactgtatcgcaatacaagctaaagcggaataacttgcaatatcattcggctcgcgcaaaaaaccgtgaccggttgaaaaaccatttttaaacagtttcagcaaatcaatctgacagcatgttgttgtaagcgttaggaaatccaaatcgtgtatatgaatatcaccgttcctatgagcagcagaatgatgaggatctaatataaacatatcataaaaacgctttgcaccctcgcttccatacctaagcatggttcccatagcagtatcgccgtcaatatttgcattttcacgctttacattgttatcctttgccgatttgaacgtcaaatcctcataaactttcataagctcagtattcatttctctgacgcggcttctttgagcacggtacaaaataaattcctttgcagttctggtatgaccattatcaacaaggactttttcaaccgcgtcctgcagctgttcaacaccgggtctttctacaccaagacaattttcaacataatccacaacctgctcggcaagttcatcggccatactatggtcagtaccaccaagcgcttcggcagctttataaatggcatttgaaatttttacaacatcaaattccgcctcgcggccatcccttttaacaatagttttaatcatttcaatcctccagaaaatataataacaaattaaacataatacaatatatggtatactcgttccaaaaaacggaatatatatagtatatcattctaaataaaagtgtcaatagcaaaataaatattgaaacataaaagtaacaattcaaatttaagtatagaaatattgacctatagtatgaattttttattcatttcaaattataaaaaatacgtgacaataaaaaaactttatgatataatttaatttatgttgcatattgtaaaagaatagttttaaatctataatggagcaaaaatatgattctaaagaatattgagatgcagggctttaaatcctttgccgataaaatctatcttgattttaattcaggtatcacagctatagtcggacctaacggttccggaaaaagtaatatctctgacgctatacgctgggttatgggagagcaaagcattaaatcgctgcgcggaagcaaaatggaagacgttatattttcaggaaccgaaaagcgaaaggctctcggtttcgctgaagtaaccttaacattggataattccagcggaatatttgatattgattttcctgagcttcaggtaacccgccgtatatacaggagcggtgaaagtgaatattacataaataaaacgacatgccgcctaaaggatattcatgaactttttatggataccggtttgggacgtgacggatattctattatcgggcagggtcaaatagataatattttaagcacaaaatcggaggacaggcgccaaatttttgaagaagcctccggtatttcaaaatataaatacagaaaaaatgaagctgaaaagaagctctcccaaaccactgaaaatctaacccgtgttaaagatattttgagcgaacttgaaagtcagcttgaaccgttgaaaaagcaatctgagaaagcaaaaaaatatcttgttcttcacgaagaaatgaaagggcttgaaataaacgtttcagttataaatatagacaaaaaaagagaaatactagaaaaactaaaagaagatatagaaatatatgaaaatcaaataaatgatatacaaactcagataacagaaaatgatgaaaaaatttctttgatgtttaaggaatcggaagaaatagatttaaaatgtgagaactgccgcactgaggacaggagtattacagaacttattcatgagcacacaaataatctgaatttatctgaaagcgatataaaacattccgaagatactataagcagatttatctctgaaatagatgattataccaaacgtatggccgaacttgacagcgaatctaaaagtttaaaagacagtcttctttcactgacatctcaaaacgacgcgtttgaaaaaagttcattagagctgcaggattcagcaaatcgcgcaggagttgatgtgtctgaaaagagtaaagaaatcgaagcgctgcattctgaaatacttaaaaatactgcaagcgttaagaatatagagaattcaattgaaaatcaaaaaatacttattgataactttagctcacgttctgatattataaagcgggaattaagccaaaaagaatcagacattaataatacagccaatcagttaaataaacttgaaaaagatacagctgaaaaagaaaataatatcaatgacttaaaaaacaaaataaatcagcttgaagaaaaatacggttccaaaaatgttgaattgcagaaagaggtatcaacaaaaaacaaaaataatattaaattgggtcaaataacctcaaaacaaaaaatgctcatcgacatggaacgcgatttagaaggatacagccgaggcgttaagaatattataaaatcttaccaacagaagaaattatcagggataacaatacacggtccgctatcacagcttataaaagttgataaaaaatatattaccgcagttgaaacggctcttggaaacactgctcaaaacattgttaccgatacccctgaagatgctaaaactgcaataaaatatttaaagcaaaataatttgggcagagcaacttttcttcctatatccacaataaaagcaaaaaatataaacaactcatcagcccaaagttatgatggatacattggtactgctgactctctttgcagctgctccgatatatataagccaataataagcagcgtactttcttccacagttgtagtcgacacaattgacaacgcagtgaaaatggggaagggctgttcacaccgtttcagaatagtaactctcggcggtgatattatacaggcaggcggtgcaatgacaggcggcagcgtagctaagtcaatcggttcgctctcaagagcaaatgaaattgaaaatttagccgacgaaattttaaaggtagaaaaaataatagaaacaagcagctcaaaaattaaaatgctttctgttgaaacaaatgatttgatggatgatataaaaaacaacaatgaaaagttaatggcatataatgaaacactgataaaacttgtatcagataaacatcatttaaatgatgtattaaatactatgagcagtgataaaagtaaactttcagaagaattaagtgatttgaccaataaaattaataacatatcaaacgaaatatctgaaaataaaactaaaattctttctattaataaaattgttgatgaattaaaaataaaggctgataaagaggaaaaaacgtttgcagaattgtcgggcaaaaacgaaaagcttactcatacaatgcttgacctcagtattaagaaaaatacaattttaaaagacattgaacaaacaaatgaaaagatccagagagttatctcggagaaggaacaaatattgtcatcaatttcaaacagacaatctgaaattgagaagctaaaaaatacaattgaggatttgcgtaaaaataaacttgattttgaaaaaaatattgagaaaaataaaaaacttttgcttgataccagaacatcactggaatcttatattaaaaagagacaggaaatcgacgacaaaataaaaagccggcaggcttctgtcaacaacataagagaaaccttgtttaatctatccgggcgtcttgcaaaagcacaaacgaaatacgaaaactctgaaactgagcttgaatcaataattaatcatttatgggaagaatatgagttaacctacagcgacgcgtcaaacagagatttgaccgggttcgatttaaacagctcaataaaaaggataacagaacttaaaaaggaaataaaatctctcgggaatataaatattgattctatagaagagtataagactgttagcgaaagggtagattttctgactgaacagacaaacgatttagaaaaatctaaaaaagaattggttcgtataatagacgaaatgcttttaattatgaaagaaagattttcagaacaatttaaaattattaacgaaaacttcagccgggtattctctgagctgtttggcggaggacaagctaatctaagtctgtcagacccggataacgttttagaaagcggaattgaaattgaggctcagccccccgggaaaaaacttcaaaacctaacgctgctgtcaggaggagaaagagcattcactgcaatagctcttctgttttctattttaaacgtacgtcctactccattttgtatattagatgaaatagaagcggcgctggatgatgtaaacgtttaccgatttgccgaatacctaaaacaatacagccaaaacactcaatttattgtagttacacacagaagaggcacaatggaatccgccaatattttatacggcgtaaccatgcaggaaaaaggcgtttcaaaattattaacattaaatattgacgaggtgagtaaataatgggattatttgataaattaaagaaaagtcttgcaaaaacaaaagaaagtataaatgaaaaatttaatacagtcttaaaaacatttaagaagattgacgacgacttatttgacgagcttgaagaggttcttattacatccgatttgggcgtaaacacatcgatggatataattgaaaaactgcgccaagctgcaaaagagaaaaaacttagagacagttatgaattaaaaagtgaactaaataaaataatgagtgatattttaacagaaggcagcggttcaaaaattgaacttcaaggcacgccggctgttataatggtgattggcgttaacggagttggcaaaacaacatccataggcaaaattgcaaatatgtatagaaatcaagggaaatcagttttgatagccgccgcagacactttccgcgccgcagcaatagaacagcttgaagtttggtcagaacgcgccggggttgatataattaaacagcaggaaggttcagacccagctgctgttatatatgacgctgtaaacgcagctaaatcaagaaatattgatattcttttatgtgataccgcaggacggctgcacaataagaaaaacctgatggaagaattgaaaaagatttataagattcttaaccgtgaactgccaaactccagcaaagaagttcttcttgtgctcgatgcaacaacaggtcagaatgcggttcagcaagccatacagtttaaagaggccgcagatataacaggaattattttaacaaaactggacggaacggcaaagggcggtattgtattggcaatcaagaatgattatgacatacccgttaagtttattggcgttggagaaaaaattgacgatatagaaccttttgaccctgttgaatttgtaaacgcaattatagaccctgaaaatgaagaaccggttgaggaaatagttaaataggttttatttaaacataatttactatcattactaactattaaaataaattataagatttttttggcgaattttctcaaaaaatataaatgtttaaaaattacttgcaaatatgatatttttatgctattcttataaagttaataataggtagtcctctgcctgatgtgtggcaagaatatcttaaaaggaaaggatgtaaaaatggatattttacaacaaattacacaagaacaaatcagaaaagatttacctgaaattgctattggtgacactttgagagtgtatgtcaaggtaaaagaaggaagcagagaaagagttcagatgtttgagggaaccgttatcaagaagaatcatggcggtattcaggaaacatttactgtaagacgtctttcttatggagttggcgtggaaagaactttccctgttaattctcctaaaatcgaccgcattgaggttgttagacatggtaaggtaagacgtgctaagctttattatctacgtgatagagttggtaaagcagcaaaggttaaagagaaactttaatagttaaaaaatgcagtggtggttaatctttaatcaccactctttagcattttgtagttattttaggagtgtttattatgaataataaaaatcaaaagccgaacaatcagaacaatggaaatattgatgaaactgttgaaaaagctaaatctgaaataaatgctcaaactgactctatgcttcgtgaaatcgaagaaagacgccagcggcgtttagcaagacaaagagaaatggaacagcaaatacaagctgaagaagaggctaaggcaagacggttagcaagactaaaagcccaggaagctgccaacgctgatttaaaaatggcttcatcacgcagaaatactgccgatgttcaaaaacctgtaccgactgtatcttcatcagacagtgttttcagcaacgcccacagacagcagcctgacgcgatagagaatttttcatcagctccgtctgcttctaaaaatacacagtctcgtccccagcgcaatgaaagcgttttaaacgcctcttcctcttctgcaaatacacgcagacgaacaataatgtcttcaggagaaacgcaggttatgcctaaaatttctgaagctgtacctccgtctcagaagagacaaaatactgctccatcaagtcaaaaaagagcttcagagcagaattcttctaaaccaagtgattccgcacatgtatccagagcttctaagagtaatgagcaagcatttaaaagaagacaagttcagaataccgtgtctgcaaactcacaggcggccggacgcgcacctgtaaaaagaggaaatatctcagcggcaaaaccaaaaaattcacataaggaagtaaacatgatgaaagaaatcagagattgggttattgcgatagttattgctgttgccgttgccctgcttataagaaattttgtattcactttggttaaagttcaaggtgagtctatgcagccaacactgcaggaaaacgatagattatatgttaacagattattctatacaccaaaaaagggcgacgttgttatctttaaaccatcatctgaccctaaaaggccatatgttaaaagagttattgcaaccgagggcgacactgtttatattgattttgaaacaggcgatgtatatgttaatgaccaggttattgacgagccttatatcaaagctaaaacaacacgctccggcagttatatagctgaacaaattgcatcaggaaattatagcaaagataatccaattgttatagaaaagggtaaaatctttgttatgggggataataggaataacagcagagacagccgtgaaattggtcaggttccgaaaagtgaattaataggcggagcagtatttagattttggccattaaataaatttggttctgtctcttataaagctactacctcttatttaatcgaagatgaaaacatgaatttcaaatttgttgcataataagtgtgaatatatcggtattgccgtcggcaataccgtttactttatagagatttaaaaaggagatatatatgaacaataaatatcagcttcaatggttccccggtcatatggcaaaaacccgccgtatgatacaagataaccttaaactagtagatgtagtaatcgaactcgtagacgcgcgccttcctctttcttcacgcaatcctgacgttgataaaattattggttcaaaaccgcgtattgttgttttaaataaagccgatatagccgataactcattgactatgaaatggttgaattattttaaagataaaaatatagaagcgatttcagcaaacagccaaaccggcaaaggattgaaaaaagagcttgataacgctatagaaattgttctggctgacaaatttaaaagagatgagacaaaaggtatacaaaggcacgctgttaaaatgatggtaataggcattccaaatgtcggaaaatcttcatttataaaccgcctgtcagggcgtgcagcggcaaagaccggtgacagacccggaataacacagaccaaacagtggataagaatagcaggaaaatatgaactcttagatacacccggaatcctttggccaaaatttgagaatgaggacgacgctaaaaaaattgcctttacaggcggaattaaagatgaaattttggatattgaggatttagcatatgaacttttaggatatttaaagcaatcttatatggacagccttttaaaaacatataacttaaatgattcagacagcgaacttaataagtatgaactcttagaaagtatcggccgcaagaggggctgtgttatatccggcggagaagtggatacatttagaacagcaaacattattatatctgattttcgctctgccaaactaggcaggataactcttgaagaacccaaaagaaatgaggaaaactgatatggaaattgatttattgcaatatgaaaaagatttaatatcccgcggatacgaatatatatgcggaatagatgaagccggcagaggtcctcttgcaggaccggtatgcgccgccgcagtaatactgcccaacggacttgttattgacggcgttaatgattcaaaaaaattatctgagaaaaaacgtgaaaagttatataatgaaataatagaatcagctttagcatattctgttcaatttgtctttcaagatgtcattgatgaaataaatatccgtcaagctacccatgctgcaatgcaaaatgcagttaatggtttaaaaatacatcccgatattttaatcgttgacggaaatgataatattgattttgataacattgaaactctatatattaaaaaaggcgattccttatcccaaagtattgccgccgcgtctattctggcaaaagtcacaagggacagatatatcgttgagctatcaaaggattatcctgaatacggtcttgaaaagcataaaggttatgctactaaagctcatatggaggcaataagaaaatacggcgttcagcctatacatagaaagacttttatgactgataaagttcttggaataaataaaacaaattaaaacggtgatacttttatgtataatactaaagaaaccggtaattatggagaaatacaggcatctaattacctagttaaaaaaggatatacaatcattgccaaaaactactatggcaagcatggagagatagacatcatagctgtgacaccggataacactactttggtgtttgttgaagtcaaaacaagaaaatcaaagttatttggttatgctgccgaagctatagataaaaagaaaattcaaagtattataaaaactgcagaaaattttatgtttgaaaacccatctgaacgccaaattagatttgatgttattgaagtttattataaaataagaaataacgatgaactcatattggatgaaattaatcatattgaaaacgcattttatgatataagcaattatatatagcgatattaatttttaattcaataccaattaagtatacttatatgaactgacttgcaataatgctctatttgtctgcaaatattattatactgtttgtacataatcaattaacgtcactataatatatttatatataacatatctgcctgatcatattaatttttttatacagcataaatcatataaaataaaaatttattataatgataaaacacaacgattatacattgcgtgatacagaatttatattatataaaaatacattaaaactataacattagataactggttcaaattttgctaagtttaatgaaattagaaaagcactttatacaaaagtatattttgcggttcctctctccttggaagagaggttgaaataaaaatataaatgggattttactattattttttaaaacagattttattttagaattctaaaagatagagagtcaaacaaaatcgttaaactatttacatacacacctatgtttaaacctgattttacctgatgagatttttgctgcacttgtcaatctaccggaatccgcaaatttatattaaattattaaaacaaacgattattttacagactttataaaattaatatttaatttttatatatgaatatctatgatagtgacttaaaaatttgtcaaattcaatattgcaatttgttctgtcttatattacaatattatacaatagttctaatccataaatatcttattgtagattatatagctgaaatttattatttatttttcaaacaaattaaattattgtttatacaaataatttataagattttggaaatttatctatattatttaagataataaaaattttagtcaaatagaaattttaaataaatctgaaaggaacaatactatgaataaagatgtatatgaaagcccgctaaactcccgttatgcgagtaaagaaatgaaatatattttctctcccgataaaaaatttaaaacttggagaaaattatgggtcgcactggctgaatccgaaatggagcttggtcttaatgtaacaaaggaacaagttgaagaattacgtgcaaacgtggacaacataaactatgacgttgccgaagcccgtgaaaaagaggtacgtcacgacgttatgtctcatgtatacgcatatgggcagcaatgtccgaatgctaaaggaattattcatctcggcgccacttcatgttatgttggcgataacactgacctaataattatgaatgaagctttggaacttataaaaacaaagcttctcaaagtaattgctttattaagagattttgctcttaaatacaaagacttgccgacattaggatttacccattttcaggcagctcagctgactactgtcggaaaaagagcaacgctttggatatgggaactgttgatggatcttgaaaatatagacttccagctaagccgcgcggctctgcttgggtgcaaaggcacaacaggaacgcaggcaagctttatggaactttttgataatgatattgaaaaagttaaagctcttgataaaaaaatctgtgaaaagatgggatattcaaaattttatcctgtttccggacaaacatattcaagaaaaattgattatcaaatgctgtcagtattgagtgatgttgctcaaagtgcgtataagtttgcaaatgacatacgcctgcttcagcatcttaaagaaatagaagaaccgtttgaaaaatctcagattggttcctctgctatggcttacaagcgtaatcctatgagaagcgaacgcatttgttctttagccagatatgttattgtcgacgcagtaaatccagccataacctcttctactcaatggtttgaaagaacacttgacgactcggcaaacaaaagaatcagcgtagctgaagcatttttaaccgttgacgctatactgaatatttatatgaatgttgcttccggattggttgtatacccgaaagttattaataaacgtattatgtctgagcttccatttatggccaccgaaaatatcatgatggacgctgttaaaaacggcggcgaccgccaggaacttcacgagcgtatacgcaagcattctatggacgccggaaaagtagttaaagagcaaggcggagagaatgacttaattgaaagaatagttgctgatgattcgtttaatttgagtcacgaagaaatagacaaaatattaaaacctgaaaactttataggaagaagcgtaagtcaagttgaagaattcatagacgaatacgtaaatcctgttttagataataatgatttagctgaagaagtggaacttactgtttaattaaccaaaagattggagcgcagaattatgactataggatttattggcggaggaaatatggccactgcattgatttccggacttatttcatcccaaaaatttaaaccggcggaaataactgtttatgatattgacgcagtaaaattaaaagaactttcaaacaaattaggaattgttccgtcaaattcaataactgagcttgaggagcgggttgatataatcgttttatctgtcaagccaaatataatgccgcaaattttaaataacttaaacggctataatgaaaaaatttatatttctatcgccgccggaataacacttgacgccctggcaaacggtcttggctcagataaaaagattataagaaccatgccaaatactcctgctctcgttaaatgcggtatgaccgttataaccccgaaccaaaatgtcgatgaaggcgaaatcaggttagtcgaggatttattgtccggagttggagaaaccgtaagacttgaagaaaaatatatgaacgcagctatcgcgctgcatagcagcagccctgcatatatatatatgcttatagacgcaatggcagacagcggtgttaagtatggaatccccaaagcgctatcacaaaaattagccgctaaggctgtcgaaggaagtgctaaaatggtattggaaagcagcgaacatccgatgaggttaaaagataatgtttgttcccccggaggaacaactattgcagccgtatgtgatttagaaaaaaccggattcagaagttcaatccagagtgctattgattcatgcgtgaataaagcggaagaaatgtctaaatagataaaaaattaacgcctgataatcaatatcaggcgttaattttattttatagcggctgttatttcatcttccttcatatcaattagaacagttttgccatgtattagttcaccttttataagcatctgcgctaacttatcttcgatattcttttcaataaatctccgcattggtcttgcgccatattgtctgttataggatttatccaaaataaattcttttgctttctttgaaacttcaagagttatatccttttctttcaatccgtcagacaaatcatgcagcatcaaatctattattttaattaactcttctttttcaagttccttaaatataataatctcatcaacgcgattaagaaattcaggtctgaataactctttaagcgctctgtcaattttaatatgagtggcttcttcatcttcattaaaacctacaacgtttgattttttatcacttccggcatttgaagtcataattataatagtattttcaaatgacactactttaccgtggctatcagttattcttccgtcatctaaaatttgaagcagcatattaaatacatcagcatgtgctttctcaatctcatcaagaagaattacgctgtatggttttcttcttattttttcagtcagctgaccggcttcatcatatccaacataacccggaggcgaaccaatcagttttgaaaccgaatgtttttccatatattcagacatatcaagcctaatcaatgcgtcttcaccgtcaaaaacttctctggcaatttgctttgcaagttccgttttaccaactcctgttggacccacaaaaataaatgacaccggtcttctttttaagctaatacctgctctttttctccttatagcactcgctacgccatttacagcctcattttgaccgattactcccttatgaagtctgtcttctaaccctactaaacgttcagactcgtattcactaatatgtttaacaggtattttagtccaattttcaattactgaagctacatcctctgcttccaaatattttatcgacgctttctcaacttcagaaatttttgattgcagctgtatttcctgaacttttaaatcagctgcttttttatagtcatcttccgcagcggctttatctttcgcatcctgggtttctttaagttcttgctgtagtttaaccagttcaatcaattcgttattatttaaattaactttcgaagcagcttcatcaataacatctatcgctttgtcaggcaaaaatctatcctgaatatatctttcagcaagaactgttgctgttcttataatatcatcagtaatttttacattatgataatcttcataatagcctttgataccttttaaaatctctattgtttcctcaaccgttggctcttcaaccataaccatctgaaaacggcgctccaaagcagaatccttctcaatatattttctgtattcatcaatggtagtcgccccaataacctgaatctcacccttagaaagagccggtttcaaaatattgccggcattcatccctccctcagcatctccggctgaagcaatggtgtgaatttcatcaataacaagaatgatattgcccgcttttttaacctcttctattatattacgaagtctggattcaaactgtcctctaaactgagttccagctataaccgacgtcatatctaaaagataaatctcataattaagcaatttctgaggtacttccccctcaacaattttaagagctaaaccttcagcaattgcagttttaccaacaccgggctcaccaatcaaacaagggttattctttgtgcgcctattaagtatctgtattgtcctctctatttcacgctctctgccaattacagcgtcaatttcaccttttttcgctttttcagtcaaattaaccccataagtatcaagcattttcttttttgaattctttttttctttagttcttctaggtccagcttttcctggttcaccgctctgactctcactgtttgaattcataaatctgctcataaactcaaacggattacgctgaatactgcggctcattttttcctcgctgtcaggagtattattttcttccttagtgttatcggaatcatcagaaacttcctgatcatcttcctgagcttcctctctatcatctgcttcagttagtgaaattatatctgcgtcgccaccaagttcttgtctaagcaaatctatactctcgccaaggtcaaaatcatcacccatttcatcaaacatactcttcatttctgtatttaagcggtccatttcttcagggtcaacccccattttgtctaagatggactcaacagggcctaaattcaattccttagcgcaagatagacaataaccttcattattctgcgtaccgtccggattcaattttgaaatatatacaactgctaagttttttttacatctgcaacatagcatattatcccctcctagttcggaacatgtcttaatattataccacataaatattaatttagcaacactttgacacaaaaatgaaccaacaaattgaaagaccgtccgatatcggacggtctctcattgggaagaaatctataaattaattttactacctaaataaattttgaatacagattattcaaattctgtatattcaactgttatatccttaattatgaacttatttggatcagctgaaccaggataaacagcaaggcaaagattatctctgtctatattagaggcttccgggaatccagtaaacatattatactcattccagctatccgctccagcaaccttagccttagcagtcaaaactcctgttttgaagttagcagttatactaacaatttgatctgcataatttgtagccgggaattttcctcccgcacagttaagccactgatgttcagtatttgaagaaccgcttcgtcttccaaccccaacgtcaagcatattcatttgatcccaacgtccataacttgttctagcgatacgtattttattttcatcgctattatatgttccaggaattccgcttaagagatctaccgtagcacaatcatcagatgtactatagcccttttccattgttactgtaaatgttacagtaactgcgtctgtagattttattccatcagataatgatgataaattccaatatgcaccgtctgaggtttttgagctgctagaaactgtatattcaccattgttatttgcaactgttgcaccgcttcccaaattcgttgggataccggttaccgagtaagtcttattaacaagtttagcaactgatgcatccgatgttacagattcacctttagctccagtaatagtagtttttccattttcaggattaagaatcttatatccgtctgttaaagtatcaaaaactacatcgtactcacctaccggaataccctcggcagtatatacagcgctggtggttcccttagcaatctgtgcagatgtttgcttgattacagcatttcctttatagaaattaaccgtgaagtcaacatcaacatcaggagctgcaccgtttagtgaaatagttcctgtagctgtaaacacattttcagtatccgttgtcggattaattgttacaggaataaccgcctttgtacctatagctttatctgatgattccctaatatagagtacaagtgttgtttcgattggcgtctcgccattagccggtcttattacagttacctttgtaccatcattgtttactatggcatattctgatgctgattcccacttaaattcgtaaccgtcaggagcctgaggcagatcaacttctgtacttgttccttccggaataacaaatgttgtctcacttgcaactttattaactccggcatatttttctgtcatgttcatgggatcccaattatctgtccacttatatctagctttaaaataatttataggattaaactctaaaatctgccaatcatcaagaacagaaccaaaaccattagtgcattttactctcttagaaaaatctactgcttctccactcttatttgtggttccgtattcatagaaacgagcgtcttccttcatattgcctgacatatctctccagccttctgctgttattcctgccgggcttgctcctgtagttgcattgtcgtctataactgtattatagaatgtaatctgcgcgtcctgtctccatggtcttccatacattgaatttgttatattatttcgggtattatagagttcgcagttatagaacagatatccataatcattattaccatcagtatttgccgcagttattgttgcgccgtaatccttatcagtcattccagctgctccaagcttacagttatcaaacactgccgttgcattaccatagatatagtctgttccgcctattaaatcacaatttttaaaatatattcttccttcactaatatatactgaatcctgattacctcttgcgcgaatgttttcaagtatacatctatcgccatttattgaaactgcatgacctctttcattgaatcctgatgaacgagctaaatatgcgctttcttcaggggtaaatgtatagtttccatcttttgttttttctatatattttgctttacttacggttttatcagaattcaacactgattcaggtgcaacttcggctgtgtcttcataacaaatgctcaaactatcacgctccggaagcatatcttttaactcattatccgttttgccgggaataagttttctatctgcctgaggctttactcctgcttccttttcaccttttgttaccataacaggtatactatttattatattaaaatctttaactgttatgtcgcttgcagactttcttactacaagcggagccatatcactaaagtttcctaaatgagaaactctaactgatacatccttatgagcaactccgtctaaatcataatatgaaatagttgaaacaccatttaacacctgacctacttcatatttggtaaacttttcatcagtatctttataaccgttccaggtttcttcttttgaccagttaattttaggatcatagtttccgtttaaatctgctgtgcctgcgcaataacctgtacaataataccatgaaagatttactttaccattagtaccgggagtctgctgaagagttacatactttacattatcaaataatacctgctcttcatagaatcctggatctacattaattacaacacgttcagcctcagactgtggatttaattcagtcgctttagctacagcgtctcttattgtagaaaactcaaagttagctccgctgctttcctgcgtcagcgttgctttattaacggtcggttcacttgttggaccgggtgttgctgacggtgattcagtaggtcttaaaacgtcttcaacctcaaaagtttttgacaaaggatttaaggtatcaacaccgttccaaatataaagtttaacaattcctttatcaggcttgctgtaatcaagtccttcaaccgttgttccctttatgtcatagctctttgcatccagcattatctcgctgtctgcttcgtcatatgctgctgcaagaagttttcctgttgggttttcttctgttccgttgtactttaactcaacgttcagctttccatcatcaccataatatgcttctgttatttcataagcatatcctaacggctcggtcgttggtacaacttcaggtgttggtacaacatcgggtgttgctgacggttcagtttctcctccgcttgtaaaacttacatctatcgttacattttcctccggcatcacaaaagttccttgatttgctccggccatcgttacatctaccgcgcttcctgatgctcctattacgctcattccctttgttgtcattcctgcttccggaactgcgtctatctgcacggtctctcccggtcttgcttttacagataccactggtgctcccgacatatacgatattccgacaaatcttcccttagatcccagtactcccatataataggtctttcctgcttctactggtatgcttgcgcatacattctcttttgccgttgctatatggtaatacgcagagtctgtcttcgttgctgttccttcttctgtaattgctacttccttaccgcttcctacatctactacgtataacgaaagcactcctgaagccggtgctacgaatttcattgccgcaccagttatcattccgttttcaaattttccgtttgtttcaccatgtgaaacatattttgtaaacgactctccttctattgtcgcttttgtgctccctgttacatccaatgtcatcatcggcgtcaaacttccgcccatagctgccagctcaggcataagttcctgaccttcttttacagctccgtttgctctccaccatacttctcctgcactgctcaactctgctgattccagttctgctgtttcagctgaaatttctcctaagtttgtcagagctactgttccgccttgaattccggctgctgtttctgccgtatacttctttgcaggtattactacatttgtgcattctgcggttctttcaacactcagctttgttgaatcagcgtcacttgttaccacatacatgttaactgattcgccgaactcaagcttcatatcaagtccgcttacttttccgctgccgcttacatcatacttctttgtctctgttaccgttccctctgatgattttctctcaaccaccagtttgtttgacggtgttccttctccattatacttcagctctacactcagcattccgtcatagtctatatccactgcgctgaactcataatccattgctgtatagtttactgccttatacactaccggatttttgtccgttccgccatagttggtcggtactgtcggctcctgattttctgtctttatgttctgctgtaatccgaacaggaaaaacagttcttttgcagccttagctctcgtcacttctgcctttggctccaactctgttccgttcatcatctttgttctgctaagtcctttttcacttctcattaagcccaaattatatacttcatagaacttttctaagtactctcttgatatatctttagtatctgtaagatttccccagcctaccaacggataatactgtgcgctctctcctgttaaattcggatcatactccggatcatcaggagatacactcgaaccattgtaatccgtcatatacttcggcttgttccattctcctgtttcagcgtttctgccgaattttaatgaatatgcgtcatatactattcccgccattgtttcacggttcagcgttccgctgttcatatactttgcaaaatctgctgtttctaaattccaaattgtgcatattcctgctataaagtcatttgtgcttattgacttctcaggattaaacagattattattatctgtatccatagctcctatttgaagcattttttctatttgatttctatactttgaatttgaagctgaatatccgtttacttttgcttcagttacatcctttgctctgttttcgggatatacttcgttccaatttccgcttgtgcatgctgcctttactttgtcgttcaggtatcctgctaattcttttatctttgcactgccagccgcgctctgagcataaatatcctctgcaatcagtttgctgaacatctttcctgccgcttctttatagtgcgttccatctattttgttatcaggatgtccgtttgcatatgagccgctgtttgtttttcccggtgactctccggcttcaagactttggtatatatccattgtctctgctgagcctatcttttcaaaatatgcctttgcctttgcaaacaaatctacaaactctactttattatcagcctttgccttatcttccataaactgcggtgagtttggattaaagccccttggtttctcactgcttaccgatgcaacaccattacttgttctcggcattcctgacaccaatatcggagttactcctctctcttccattgcagcacaatacatatccagccattttggatacgtcactttacttgaacctcttccaaatctcatagctgaatcatcagtttcatcattatgtgcagaatgaatcagtacaaaatctccttcttttgcattatacagaacattgttaaatcttccttctgtatagttcgctctcattgaacgtccacccattgaataatttacaacgtttaccttgtccaaatcaaacattttaaaaatattctgcccccatgaactcatgctgtcttcctcaaatgtataagtcttctgtgttgagtctcccagcacaaacactgtcggctttcctgacgcagtattattttctattctgctcagcgaaattgattctattcctatagtagttcctgctgccgttggctgtttgtttggctcaatttctatctctatgtacggccagcctgtcacatagtcatacttccacgttgaaccttcccatgacgcataattattatgtgccacaagtccagcagtatcccaagcacttgaactcgttattctgcttgcctgcattcctgtcggagctatccatgtattacttgatgttgtttcacttgtacagttaactgttattccataacctccaagtttatctacatcaacacggaatattaatccaccgaaattatcattatttccatccttgctttttaccgttgttgcgtctgtctcagttatgctgcagccgttttcatcctgctttattttactgggatctacggttcttgcaggcatcgcactgtttattttcacaaatccatatccctttgacgcgtcatacatgtctgtatttttaacatttatggctccgtctacttctgccgatttaaagttaaatgtcttgtatacttctcccatcagttcagatgttccctcttgtccggcaccttgctcagccgctgtcgccaatgtcatacccgacaacatcgtgagcagcatcattatcgccactgccaaacttatacatctttttctcatcctttttcctccttaaacttttagttattttttaatgtatttttaatcttttctctttaattatatataaaataaccaaaagaaacaatagccagaaaaaaatattttaaataccaaaagacaaaaagtattgaattactactgatattatgttataatgttgcaataattaggaggagtttattatgtctatatatagttttataaaaaagaataatggtatacccctttatgtgcaagttaaacaagcctttataaatgacataaataccggaaagctcgaaaatatgcaaaaacttccatcaagaagaaaccttgcaaaagatttaaatttaagtaccacaacaattaataacgcataccaggcattagtagatgaaggttatgtaataacaattgaccgaagcggtttttatgtaaagtctaatgatatacaatacggtgaatatgatgatgttccatgggaaagcaacacagactatacttataattttagttataataattgtgaaatatccaacttagatgacacatattcaaaaatgctcacaaaatatattcaagcaaatgatttttccagcttttacatgcatggaaataaacgaggggaattagaatttaggtctgcaatttcaagatttttatataataggcggaatatagattgctccgtaagtgatatatttttaggtgcgggtattcaatatcttcttactgttgtagtgatgatacttggaactgataaagtttatggatttgaaaatcctactgattataaaatgtttatatggttaaaaaatcttggtttagatataagactggttgatatagacttagacaacggatttaaatgtgacaaactggatgagctcggtattgacgttatgtttgtcatgccggaaaatcaacttccaaccggacattgcatgtctaaaaagcagcgcagagaacttgcccagtggtgcagcggaaaaaacagcagcaaatacgtaatagaagttgcaactgacggaaatttaaattataccaataatactcctaatccaatttattcaatatataaaggagaaaatgtaatttttattgattcattcgacttaactatttctcccaacgtaaagacttcgtttatggttcttccacacggtttggtcgaatcagtaataaaaaaaattgaaacatattcgcctctcataacaattcttgaacaaaaaatatatcaagacatgattaacagcggccaactggaacgtttaataaaacgcaacaataaaactatgaaagacaaacgcaattatcttatttcttctatacaaaaatctaaacttggcccacgatttaagtttattaattatgatacgggaatgaatttgcttggaatatttgacagccaaatgaatggaacagaattaacaaaacttgcatttaataatggagtaaagatttttgaaatgacaaaatttttattaaaaccaaataatattatgaccaaaaatgcttttgtatttggttacgccggattaactattcctgaaattgaaagcgccgtgcaaaatctcgaaaatgtttggtacaaattaaaataataaaaaatttcaagtccatggtattaattaaagacataagttaaatatgaatataaaagtaatttttaaacacatttatgattttataaacaccaacaaatttatataaaatacatctttatagctaaaataaaaactggaaaactttaagttttccagttttggcggacagggtgggattcgaacccacgtgccggagttaccgacaaactgatttcgagtcagccccgttatgaccacttcgatacctgtccatacgatgtatatttaacttactgcataaacaaaataattttagcttatgtccattagaacatatttattattatctcagtcatgcacaacaaaaaatattatagcatatttaatttatatttgcaatagtttttaattattttttattttctaagcagaacttataatgatatcacttacatattaataaaatatttatcacgtacatttattttaccaactataaaaaatataactatttttattaattggcgtcatataatctttttttatatctcattttataaacgtttaaatatattgtcaaaatcaaaaaataaataatattgaccgctttaaactttgatttaaatatttaattaaacagaacaataaaagcggcgtgcagtaagaaagaatcctcaaaagaaaaaatataactaaagttttagtcaaaaaattatttataaataattgtatcgcaaaaaccacaaaaccaggacaaggtatataaacagttcggatataataaaaatcacataacacgatttacaaatgttattaattctcgacaggttattttattgacaatcaaaaaattataatataacaatatcaaaaaattcttcacggtattaaaaacaaattttattataaaattaacaccatagaaattattgatgagtataactattttatatccaaaaacatacagttaaaataaaactgacaccgatgtaataccgatgtcagtatattattaaaaattatggtttaccattgtcacttttttacactgcgcatacatttttgacaactttataattcatattatacttcttgtaacacaaattatattatcgtcttacttattagcacctgcaaacggcaataagtcctcaatagtcataacgtgtattgaacgcttgcctgtcagcggatgacctatcgtttcaatctcgtcacaccaccattgtgatatcatctgcgcaccgtaatattgaatatgtgtgttatctgaacctccggatttatactgtgaatttgcaaaatcaccaatctgatcaattgtactctttcccagtgaattcttaaatgattccggaagtgaagctccttttacaaatctagaatcattattatttataaatgcaaatatatcttttgatttctcagttccaacatcatttatatatttatttgttttggcatataaatcaaagtatggcaatcccagttcctgagctaaatcttttgcagcatttacatatgcctcatgccctgcatcacttagtttatttcggcttattgatgtggttataagcggataggcgcctttttcaagtgcaggctttacataatattcatatagagaatttttgtatgagccatcggtaaatctatctcctttataatcggtatgtctatctgcctcagacttttcatcattatgaccaaactgaattatgaaataatcacccggcttcataccattaattattgttttataattagcttcacttctgaaacttaaagaacttctgccgctgagcgctaaattgtttactgaaactccatctgtgaaaaagttacctaaaacctgagcccatccggttcttggaaaatcatttttttcgccggatgttttataattacatgctgtagaatcaccggcaacaaatatagtagcattattagcaactgtctgaccatatgtataaggcgatttcattaaaggttcaacagaatttgtgctttcaaaagcaaacacttttatttccgaattactgtcgaccggcacatcttccggattcagatagagtattgtctcttcgcctgctttctcagtcgtttcctttaagttaaacaacttacatgctgtaagcgctccatcattactcttatcatataccgcaacaaccagtgtttcttcaccggttctgtctgcttcagaaatactgtcagtatatacaatatgacttacatatccaccgtccataggagacataacaactcggccctcagcatttgaaatggcaaccctgctaatttctacagcagtataacccggtacaaacacttctatttcctttgtatcttttgcctctcctcttgaaattgttgctgtcaatacgactttactgtcagttcctttttgacgatttacgacaccatctgctgaaacgacgttaggattgctgcttatccaagtaattgttgttccgcgtctgcctttagcaggtaattcaatatttgacttaaccatactagtatcgcctatattgagagcttctttcgcaacagctactgcgccctcatcatcagtatcagcaggaacttttaaattaaaatctttagtaatcctcaagtttggataatcctgaaatgtacaaacagctatcattttgacatcatgattatccttatcagtattaacatcaccactaatcgatattacatcgggatttgatgactcccacgctacatctgcgtatccaattgaaaaaccaaaacctgaaatcaaatccaaatcatcagtaatattattttcagttgtattaacgcctttaatcatattaaaagtgattccgtcggtttcattctgaactgacttatttataaaatcaacgcttacatcaacattcttctccggcattacaaaactgcactctgtgtaatcactatttatatttagtgaaatatcagaatcatcaagtgaaatattcccaatccatgcattattgtttggagttgacttaacagttaccatatcacctggttttgcattatatatttgcttctcgctaaaattcataccacatagcgtgccggttgtacctaccgcccacataatatattcatcacctgctgtgagctctatagattgattacacaatccaaaactgccgtcatcactgaacacggttattttaccagtcatcggagtataagttccatcggcatttttcttagaaattttaagatccttaccatcgcctgaattatattcaccatttgcaatctgacgtctgtaagcatatgttagcgtaccgcttttatttgcctttatcactaatgcagtagaaccggctttttcagccaaatcgctgccggccggagcactgtcaagcctaatctgaatataatgtgtataatttactccgtttatattatactttgcagacttcaaagtagtattaaacacggatgacacatttaaattattgtcatcaatatacacagaaccggcctttgtgggtgttgacgaattaacagaccaatcggtaaccgcctcaagatttgcattcgactgaccggttgaaacttctaccgcacctaaatccgaatcataaagaacaccaacctcatattcaccctctgccgcaaatactcctgccattggtaatatacaaaataccataacgcaagcaactgcaaaacttacagtcctttttaataaattttccatagtcaactctccttattaattaattttcattattaccacatatatgcttttattataatactaatttgtatattttgcaataataaaattataattttttacatctcaagcatataaaataatatattgttataaattcaggatataattctatcaaaagtttataaaattcttatccaacttaaatcattacgtttatgttataattttgtgttttgataaatctgctgtttaaaataatgtaggattttaattatattttttgttaaaacaaagtcagaatttaaaccatgaaggttcaattctgactttttataattatctgaagtaattaatttttatattttttaatttataaatttaataatatatttttttcaagacgaataccatacaaattaacttcaaaatcaccatatatttattgtttttgcatttcctgcgtaagtactttacactcatcttttcatttaactcatatttgttttcttttccatcattcataaccgcgcttcttacgccgtctgaactctgaattcaccgtaaactataaaaaatgctgtaatgtttgctcataatttaaagataattctgatatataatcaatacaataatatgttatagtattaatttattcgcagttcaccacacaatgggacttgactttcattccaaagaagcgctttggatttctcgccgcttggaatatcatattccttagtctcacctttatttatgctataatttgtgctgttttttagtgatccgtcaagattgtattccgcaatccataattctgcgtcttcaaacggtctatcgacaatgagtttgccgctgtctaaatacattagttctctcatagatacgctgacattgtcgatatatgttctatatacaccaagacgctgaaagcttatgcttgaaagctttattgttgtatcaaattcaaattcatattcaaatacggctgaggaccaattcataagaataatgccatagttaaaaatttcccaccgcgccgacaataagtctattgagaagagaatctatcactgcaaatctttctttgtcttttaatacttttgcaagtctttttgcctgctttaaagtatatataaaactgcctgcgctccagcctgtttattcagttcatcagtccaatctataaagtgccaccaaaggtcacagcatattttttattcgatttttcacaatccaatacaaaaaattttctcctcatccgatattctgttttatagtctgaattatatcgctgtttactgtaaaagatttattatattcagtaattaataaaatattataactcagttttaactcctaaaaatattatttaaagttacatagccgaattctaataataaacaccaaaaaatataaatccaacgtataatgaattacaaaaaaataagaccgtatgctaaacaccacatacggtcttgcttatatttagaaattaaaaattagcttatacaccagcttttcgctttttcatcgtatccaaataaaccgcaaatacaattactacacctttcagcaaaagctgataataaaatgggatttgaagtaaattcattccattgttcaaaacaccaattatcaaaacaccaatcattgtaccgccaatgctgccgctgcctccggtaaacgaagtgcctcccagcacaacggcggcaatggcgtccatttcaaacccctgacctactgttggcagtgctgaatacattctggctgaaagcattatacccgttacggaagccaataatccgcttataacataagcgagcacctctgctttaaaaatcttgatgccagaaaattgagccgcattacggtttccgccgattgcatatatgtgtctgccaaatctgctttttgaaagcaacaaaccattaaatatcatcagcaccagcattataaaaacaggaaccggaaaaaagccgccaatataaccatttcctataaagctatataaaggatcattaaagtttatcggcaaacctcctgtatagatatacgctattccacgcgcaatattcatcattgcaagggtcacgatgaaagcaggcatatgagtttttgcgattaccaaaccatttataagtccaagagctgtaccggcgacaattcctataaaaatagaaataataaccggtagtcctgaaacactcaaaccaattgcaaatgtacccgatactgcaactattgagccaatagataagtcaattcctcccgaaatcattacaagcgtcataccaaaagccagcaatgcgttggttgatacctgccttaaaatgttcattccattactgactgtaaaaaacttatctgttaaaagcgttacaataatacaaatagcaatcaaaccaataaaaatatacatattccttttaaaaaaggaataaatactatgcccgatatacctaaaaaaatcttttatccggctgttattttccgctaaagacttactatttgtcatcatttcacacctccaactgcataatgcataatattaatttgatttatctgctctttttcctttatatccgcagttattctgccctcatacatgactaaaacccgagtgcataaattaacaatttccggcagttccgacgatatcattaaaatagcgattccttcatcagccaaactttgaatcatacggtacagctcagcctttgttgccacatctattcctctggttggttcatctaaaatgagtattcttggattggttgcaagccattttcctaatactaccttttgctgatttccgccgctcatattaacacagatagtatcctcacctgaatatttgattgcaagatcatttatcaatcggttaattatctgccgctccacttttttatttatcttaaacctttttatatactgttttaaaatagtaagcgtcatattgaatcttaccgtattaatcaaaatcaacccttgttccttcctgtcttcaggaaccaacgcaatcccttcagcaattgcttgagatggattttttatctctgtttttttaccataaagaaaaagctctccgcagctgatacggtcaataccaaaaattgccctcacaagctccgtacggcctgcacccactaatcctgacagtcctaaaatttctcccttatgcagctgaaagctaatatcttgaaatgcgttttttctgctgaatccctttacctccagcaccacttcttttgaaatattatgtttatctgctttatagaattcagaaaccggacgccctgccattaatgtaataagttcatccctttcagtacttttcacatcttttgtagtgatatatcctccgtctctaaaaactgttactcggtctccgatttcaaatatttcctccaatctgtgtgagatatagataatagatattccttttccttttagttcactaataaactcaaataaattttcaacttcattgtcagttagagaagatgtcggttcatccataatgataatacgcgcttccattgaaagtgcctttgcaatttcaaccatctgccggcttgatgtttttaactcagaaatcaatgtctgaggcttgatatgctcgattttcagccgtttaaaaagctcggcggtatcacggttcattttctcatcattcattatatgtatgccggaataaaccggttctcttcccaagtaaacattttgggcaacacttaaattatccgctaaacacaattcctgatgtataatactaattcccaatttcttagaatccgtaacatcgcgaatcataacctctttattatcaattgtaatttttccactatccgcatgatagataccgcccaaaatttttataaaagaagattttccagctccattttcacccaaaagacaatgtacctctccctctgctagatcaaaatggatatcatgcaatatcttaacacctgaaaaggataaattaactccttccgcttctaaaactgttttttttaagcgcatactattcacctctatttccagtcgcagcctaaaaaacaaaactctactttaaaaactcatccacattagatgaatctacaaaatccacatccaataatatctccttagggtattcttctccgttaagaacgccaaagcctacctcagctgccttcactcccattttttcagggaactgtgcggcgcttccaagatactcattgtttttaatcagttcacaaacacgctccgatccatcaactgaaacgattttcacatctccaatcttatttgcactttttgcagccgcatatattccaagaccaatagcatcatttgttccaaaggcgccgtttatatcaggatgtgcctgcagcatattttccatcaatccaagtgcatcctccgtgctgcaagtttgcgcatcctgatattgtacaatattgataccgggataatttttcataacctctttaaatccggtagatctgtcacgggccggacgaatcacatccgttgtaataacaattatatttcctgaaccgtttaaagcttttgccatcgcctctccgcaaagttttcctaacttaatacaatcagaagctacctgggtaactacaagatcagggtcatccaccatagtatccacatccaccaccggaatacctgccgctttacacgattccaaagccggtttaatcccttttgaatcaacaggaacaacaaaaataagatccacttgctgctgaattaaatcctcaatatctgaattttgtttgttctgatcaaattttgcatccagttctattagttctccgcccagttcttcaatctttggcttaattccattactcattgatacatagaaaggatcgttcatcgtcatatatgtaatcccaaaagttttcttttttgtctcattcctgccgccaaagcaggaactcagtgaaacaacgcttgcaaacataaacaaacaagcgatgataagacacacagcacggcttgctttaattttctttttcatgatttttctcctttctttgtgcaccacagttaattctgtgtgacaaacgtaattctgttaggcagtccttccagtttttcagtgcttttaaaacgtgtcggccaagctagatcgtgagcggggattacattattaatatttccatctgccagcattaatatcttttcaaaagactgaagctgatccagctggtcaattccatatcccataggcgtcatggtaataatattctccaaagtataggctgcgtctccggtgactacataccttccatttttagttttaactctcacaacttgcgtaccgtatgaatgcccctttgccaaatacaaatcaattcccggaaaaatgttttccataccgtcctctgacaatataagccggccttcctttttcacctgctcaagcttttttaaatcctccggatccaaataacagttaagtaatttataatcctctgacagacctgcagaccactgccacccctcaagctctgtcctttgcacatatactttagcatttttaaagcaatcaatatttcccacatggtcataatgcaaatgagataacagcactgcatctatttggtcaggatgcaaatttaaaggcttaagataagtctccggtttcaatacattttctgcgttataagcttctataaattgaggatttttaaatcctgtatctacgagaatattgtatccgccgccttgaagtatcgttacattacctggctgatcctctggaaaatctgcatttttctgattatgtgcaccataaaatgtctgtccgcgtccaacatctttaaaaatacagtgctccacaacagtgattttccaacaaatttctttcatttttttcacacctttccatacataattcatcctgtttcaatcctgttcttccaatagatagtagtataaaataaacgacaaatcttgtctgtgtgctcaatctcaaaattatcagcaacagaacatcattatatctgcagatagttattccagcgcttacctaatcccatagcagaaaacattacttctatagaaaatcacaaatatgtattaatagattaacttgtatacgttaccgcaatgttcttcagatgctcataacacacccataaaacaatcctgcattatgtcttaaatatttgccattccatcaaatcataatttctaactgaatccccttgaacgtatcatatcaatcatgtgctttttcatcattgctatcctccttccttcgttgtaatttaataattttattttgtcagccaatcagcaagattacaccaaaacgtatcataatatttccaactcataaaatcaggtgatgcccaatgaggagaacagtctgatgtaaatgcagccgactttcccataccaaaagaacctactgatataaatggatctccgtctatcttagcaatcgttttgcatgccggcaagcatctagcaacagtcttgttgtatcccaggaaacacggccactcctcgttaataccttgcattaccggatgcgtatcatttgacacagtcggaaaaactccttcaggatgttcacatctatcatcataaggcaatatctttaccggaagtacatctgcaacagccgtcttcccatatcttgctctagcatctattcctgaaaaagaaagataacctcctatcatacaaagtgaccctccggcaagcacataatctcttatcgccgtacatttgttattctgcgtatcaccatatgaaaacactctatccgataaaagtaacgtgtttgagccaatgtctgataaaaacacagcgtcatatccgcgcagcttttctactgtgtcaggaaaatgttctcccgcataatgattagggcaaaaatccacttcatatccgccatttttaagagcttttatcagtctgtctcccccctcctcataacgtgaagttgtaaaaatatcaaatcctttaatatgtgttgtaacgcttgtccaagattcacctgcaagcaaaatttttttcattatgaagtctcccttcatttactctttgtaaatatacttcaaactacagcgcatgtactttctcttactactaacagcggcttaaaaactatcttattctgataatcacttttttgtattttatgaaccaacattttagctgccgcttctcccattttctgattcggctgtaaaacagatgttaatgttggaaataaaatctgagtataatctgtatcatcatatccaatcacatttagctgatttggtatttcaattcccatttcctgtgccgctcgataagcaccgcatgccattaaatcattctgtactactaacgccgtaatattattttttaacagtttgtgtgttgccttatatccaccctgatacttataatctgcctgacaaattaattctgactgaaatggaatagaagcctgagctaaagcgtttttaaagcctataaacctgtcatgcgcgcttttatttaacaacggtcctgtaacacagccaatttttttatgtccataatcagttagatgttttaccgctatatatcctcctaaaatattatcaaaagaaacactgtctatttgtgtgttttcctttgaaaatattctgtctaaaataacaaatgggattcctttgagtattgttgtatacgtaatgtctacacttgaacttaacaccggaattaaaataatgccgtctacacatttttgcctcataatatcaatataggctttttcgcgttcgtctgaatcattgcaattgcatagtatcatattatattccatatgccttaacgcaatctctataccttttgccatttcagcaaaatataaatttgaaatatccggcaggattaatcctattaaacctgtttttttagtaaccatactcctggcaactatattcggcgcataccccatttcttttataattttttgtacccgatccacggtttcctttcggaaattttttgtctccttattaataatttttgaaacagtagaaaccgacacatttgctcttgaagcaatgtccttcatctttggattcatcctaaccatctcttttttattagataattaaagttagtaaaacgttttactaaaattatagtatcactcttatatgagtttgtcaatagtgatttgtgtaattttaccaaaaaaaattcccaataaaatcaaaatatattttgattttattgggattttttactgtgtttttatcattaccggatgagccgtactgcttcttactttcaaactgggattcataaccacatgttcatatcttttttcattgattaattccaaagcgcaggatactattttttcgctaagttcatctatcggttgtactatggtcgtcagaggcggctccagtgctccggtcaaatatacattatcaaacccaactaccgacagctgctcaggaatttgaaaattcatttttctgctttgcacatatactcccaaagccatcatatcattacatgcaaataccgccgtaataccgtatttgagtaattcctcaatacctcttgaaccgctttcaatatcaaactccccatgatacactaactgcgaatcataagaaattcccgcattatttagagtctctttatatcccttaagccgttcctgtgaaatttttgaatcatgcggtccacatatacatccaatacgagtatgccccaactcaattaaatgttttaccgccaaacatccacccattttctgattaactgaaactacgctttcttcttttcttaataatccacggtctatccataaaacaggcgtatttgaaaaatcaaaaaatgaattcagcctttttttctgtgcttctgtcatagcataatcaggatatacgattacaatcgtatctacattacgcttttgaaaaatatgcagatattccatacatgtgtcaaaacaagataaggtattaccataaatcacattataattcttctcgctaaacttcctttcaatttctttagcaaaacttgaataaaaaagatcacttatatccggaagtatcagaccaatcgtattagtccgcttcgttaccatacttactgccacctggtttggctgataatttaattcctctactgccttgtatattttatttttcgtctcttttgaaatgtgttcgcccttatggttaagcaccagcgataccgttgtaatagaaattccacatttttttgcaatatcttttattgttactcccatgttatctcctactcattttttattaaaacaataatacaattattaataagttttatattattaatcttttaaatttctaattctatgttgacttttccactttattaggtcataataaaaccaagtaaaacgttttattgacaatcttataaagaaaggatatttattatgaaaattttgaattttggttctctaaactttgattatgtatatcaaatacagcattttccttcacctggcgaaacaatatccgctctgaatagaaaaagattctttggcggaaagggacttaaccaatcgattgcagtacaaagcagcggctatccaatatttcacgccggtcaaatcggacaggacggaaatgatttaataaatgtattaaaaaaacataaaatagacacttctttaatcaatatatgtgatattcccacaggacatgcagttatccttatagattcctccggtgaaaactgcatcgtattggacggcggagcaaatcaaaaaattaccaaggattacgctgattcagtattagagcattttgaaaaaggtgatatactgcttctccaaaatgagatcaattgtcttgaccatattattaaccagtcagcaaaacatggacttaatatagtttttaatccggcgccattcaataaaaatgtattaaaattaccactggagaaaatacagtacctctgtatgaatacaactgagtgtcttggcatttccggaaaaaaagatattaaaagcgcaatttcatggcttttaactaattttccggaaacacatcttttaattacattaggaaagcatggatgtatatatatatacaaaaatacagttctttcgtatggcatttataatgtgccggtagtagatacgactgcagccggtgatacttttatcggttattttattggtcggcttgctcttggtgattctattaaaaaatctcttgaaaccgccagccgagcctcctctttagttgtttcaaaagccggcgcctcaaactcaattcctacaatagaagaagttttcagctctgatattaaatatcaaaaacccgatatactgccttttaatttttaataaatccatgatacacaatttagcattgtatttataacttaacaaataagtttcccctccataattttatatcaaaaatactcgtacagattatctatacgagtactttttatgctttaattataatttaataaaattatttcagagatactattaagcaaactcttccttacttctactctttaccggagtatatcacatctttcattttatgtcaacagatttctgcagattgatttcaattaaatggtatgaattcctttaatctttatctaatttcttatcctatcatccttttgaatcaagttcaaatctacgtgacaatatcctcccggattcttatctagataattctgatgatattcctccgccggataataacataataaaggcaaaacctcggtcacgattggtctgctgtattcacgctgcttattttcaataaattcttgaatagtattaatgtctgcatcgtcaacataataaataccgcttctatattggcttcctatatcatttccctgacgatttttggtcgttggatttatagttttaaagaattcagtaagcagcttatcaagtttaatcatcgaatcatcatattctatcataactgtttccgcatgtcccgtattccctcggcacacatcttcataagtaggatttttcgctgttccatttgcatatccgcattgagtatttacaacacctctcagcaaggagaaataggcttgtgtcccccaaaagcatccgcctgcaaaataaattttcttcttcatgattatttcaccgtcctgatcttagtatagcaataataggaatttactattccttgatatgtgacctgtaaaaaacaccgtaaagacacataaatattgatataataaatgacatagtaaaaatccaaaactcaatgcttcagattcttactatgtcacaaattcattccaattttaaatctcaaatccgccctcgagaataaattgtctaagtaatttatccatctttatatttactttcggaggaacgatttttttgccctcttgttcctcaaaatacaactttgctttctccttattaaatgttttaaataactcatcaaaacgtccgaactcattaatatcactcaatgtaagacctaacgacatcatgttgcggagttttttctcatctaaatcgaatgtggctgcaaactgatgaacttgagcgttcttcgcacgatatagatattcggttatataatctcttaacgattttccttcctcaacggaaacatcacctctttgaatatcatgcaaaaagatatttgcatatttttgttcatcctgcgtgagtgccgcgaacgtcttatgaagctcatttaaggcttcttcctgtgcctcggcggtagcatcatcttgatgaattagtttcatatacttgtcaaagcggctgttcatataatcggcatcaatacgtccggtatctatttctgtaatataaccgaccaaatcataaggaacatcaacttcacctgatcggtcacccggccttctttccgttaattccttatatctttgaactaaaacaagatattgagtttgtgtgaactgaggcatgacatcaagtgttttgcccgtttcttcatctacatacgagtgtttatcccaattaaagccttgaaccttagcagcttccaaacagccgttaaaatccttaaagagtgatgcaaactttgcctttaccgatttttcatccggaagcttttcaaaatcaggaatacccgcatttgtaaataattcggttaactcctgataaatcccgttaagtttttctatgttatgtcccagcttgtcaacaaaaaggtcaaccggtctgtcgccggaataaagcttaacagccgcttctatatttttctccattgtgtgaggttttctgtaatatcttattgtgccgaaaggcttttcgtcttgtctgaaaattcgatttgttcttgaaaatgcctgtattatattttcatactcaagcattttatcaagatataatgtattaacccacttggagtcaaaacctgtaagcatttggtctacaacaatcaataaattaagctgcttttggagtgttttgtcaatcaatttatattgctccttgtgtgccattctgcaggaaatatcctttttgaacgctgcatgcgaagcaatagaaaagtcttgtccaaacgccttgttatagtcctctatgatttcaataagtccattttccttaaaaaaagctattttttcacctttatattctttataatcgccgtcctcattgctgatattcgggtcaaataagcaagtggttttcagctgaggcatttccgacttaataagtctatagtaatctatagcttcaggaatactgcttgtggcaaaaatagcgtgaaatttgctgttacggcttaaatcctgccatttttcttttatatcttctacaactttcttttgatgttcttcggttctgtactgtgaaaagggtatgtaatcctcaatacctttaatatattttccgtcatctgttttatagcctgccataggaacttgtgacgcatccatatatttatagtatatcgctgacttatccgggttattaaaaacctcatcagcgtcttttgcttttgccttctccaatgccacgtgccggcgaatatcggaatctttaaaagtcaagaccttataagggtcaaatcccaacacattaccgtcgcgaataccgtctgcaatgctgtatctgtgcagctcgtttccgaatactgttgatgtagtgttcattttcttttgattttcttttttaataggtgtgcctgtaaaaccaaagaaaatagcgtttggaaatgtttctttaattgtaagcagcatatcgccgaatgttgacctgtgagcttcatcaactataaataccaagcgttttttattgattatatcaatatcatgggcatttgaacaaccatcttcagatttgatgttgctcattttctgaatagatgtaacgataagagtatctgcagaatcaatgcttttcagctttgaaataagcacatatgtattttcggttttttgaacactttcattctcatctgcaaaattgttatactcattatatgactgtgtgcccagctcgattctgtctgtcaagaatataaccttatcggcatctcttgaatttgcaataagctgtgctgatttaaaactcgtcatcgtctttcccgaacctgttgtgtgccatatatatccgccgcgctgattagacttgtcccattttgttttggaaactttatcggatatagcgcttgcggcataatactgatagcttctcattactttcaaaacgccgtctgagttatcggcaacagtgtaaaagcctatcatttgatgagccataggaatggatagcagcgatgaagctattgacttccaattatttatcggttcgttatcaaaatccgcccaattaaaatagtaattcggattgaaactgccgtccggtccgggattggcaaagtatttgctctcctccggcgtcattgcaacaaatatttgcaccaacgaaaatagtccggtaaagacaccctcatgcgaatatttttctatttgccggcaagcttggcttacaggaataccgctctttttcagctcaatatgaataaccggcattccgttaatcaaaagcattaaatcaccacgacgatcattcaatatttttgactttgccggaaaaacaggctgctgtactatctgataacggctttgacctgcggcgatttcccggcggtcataaattttcaagctgatttcttttccgaaatgctgcttatcattgggattatctctgataatagataccgttttaccgtttataaatccgtttagcttaagcggagtacgcaaattattgatttgttccataatctgctgcatttcgccgtttgtcagcggatagttattaagcctatcaattccacggttattttcaaataaaatgtttgcccaattatcaatcaagtcctgttctgtgggatgacttatcacttcattctcccaacccttgtttgaaaggacttttataagggcctcctcaaaatcggcctcttttgtgaacggcataatctttctccttccttaatttaatgaggaattagcaattaggaattatctatattttgtcgattttgtaatactcgatagaagttttaataattctgtgcagtcgctatcaatgctattatattgctctttgctcaagtattcagttttatatagtaactcaagccaatattttgtttccgaacactctttaaatgcaatatacatttttgcaagaaagtcttttttactgaaggcacattccgcctctgcaatatttgcaccaatgctcgttccgcttcttaaaatctattttgacattacaaactcttttttattttcatacatatatttataaagttgaatgattctaacagcaaaagcctttgatttttcaacaactacattttctttcattactaattcctcactcctcattcctaattatcaaacgaacatcttttcaagacaagatttcttgatattttgcagcttttctaacttacgctgatgaagggcgatgagattgtcaaagtttttaaaaaatctgcctattttcctttgtatatcaaccgaacgaggaatgagaagtgagtaattagcaatgttttcttttgacaaactcggtacaccggttgactcatcaagcttcttccaatcaatcgtttgaaaaactgcatatataaaatttaagtcaatgttgttttgcggaatgcaataaaatagcgtatctaccgtccaaaatggtgcttttaatacatatggtctatcaattgtgcctttcctgccaatccctattgcatcatcatatgacaatgcttcactaacactaagcatatatccgcctgttccataaacaggaatattcccatctgaaagatgtttgtagtccttaccattgccaatgcttactatatcgccaatgcttactatataccattcctcactcctaatttctaattcctcattatcattacgctgttcccaatcatcagtaaatccggcaaaacgaatttcgggcactttgcgtccatttttaggaaacatcttttcgagcatggatttttttacattcttcaacttatcacacttacgatgatgaagggtgataagttggtcaagttgcttaaaatatgtgccaattgcttcttgttctttgcgtccaggaactacaactacctttgtaagaagttcatctttggtaagcccttttatagaagttccttgtacggaattgagttcgctttgcagttttttatagagcaagtaggaagtaaaaactatatcagttttcagcttgcttaatgacaaaaaatcctggcttgtagcataagaaaacggcattacagcaagctttccaacgaccactcgagtaataatagcaatggagttctctggtacaattttggttgccgaacttagtactgcctcatttgaaatatactttctaggagtcaccccaaagacttgatgttcggacaggtcggatgattggatccacggtattgtaccattccaaaatctgtcgtttgatgtggttggagtaccgcctccatatgtatcagaagctaattcgccaaccttacgctgctcccaatcaccggtaaatccggcaaatctgacaaccggtttctttttttctgacatcttattcacctagaagcagcgatttgaactcgctgagccctttcatgtcaaattcatttcccacaagttcgtcaatcatttctgccagtgttgactctgtttccttgatttgtgcctcaatctcgtcaagtgtagtatcatatttggtctgtaatgcagagattttacttacaagtgtgtctacaagtgtgtccggtaatccttttagcccctcaataagcggttcaatccacttcttttcaagcaacatatacacctgttcatcgctcagattttcaatagttatctttgttttcttctgcagttctgctgacttcttttttattgaggattttaattctttttcttcctttgcgagcttttcatatgttttaagtttttcgataaatttagctgtttcggtcgttttctcctcatttttcaatgccttgagctttttggttacttcctttgcgacaaagctgtcaccggattcattaagaatatcactttccttttcctcttcagtcaggctttcgagcagctcctcatattcagatggaatttctgaaagacgattctcatcggctacaagctcagcatagtcatcactgagtaaagtttctccgacaagctcaaaaggaataacatgacctgtccaaccgtcctgtatttcttcatccttgccatttttcttttttattatcagctttgggtcaaccttttttgctgcttcaaagccttcagtctgaatgatttccaagtcgacagagatgcctgaccaattatcatcaagaatttgatatgcttcataacggtcaatcaaaggaatatttttaagcctgtcaaaaatattttcgctcaaatcaccttcagtctttgttatggcaagcactgtcatttttgataagagttcatcttttagaaagtcagagaagttcgcaaaggtgtctccgaaagctttttcaaactcaataacatcagcatgattttttatttgcgatttaatatcattcgctgcaagtgttacatatggactgccgttatcgttaaacagagtctgtttcaaattcgggaacgctttccaatactcacacaatttgtctatttcggacttcggtattcctccgaacatagaagcataaatatcccaagactctgcactttcggaactatcaacataacgtgggatattaagattataatcattttttcgtatttcatcttgagttacaactcttgaaaatttcggataatcagctcttgcagcaacagcgtccgatatacgtttaatatcagatgcacgaagcttgttgtttttgccctctttaataaaaccctttgaagcgtcaattatcaagacatcggtattttctcttttttgtttaagtaccattattatcgtcggaatacctgttccgaaaaatatatttgcaggaagtccgattattgcgtcaatatggttgttttcaataagatttttgcggatttcgccctcctcaccgccacggaataacacaccgtgaggaagtacaatagtcataattccgtcaggctttatatggaacaagtcatgcagcaaaaaggcatagtctgcttttcctttcggtgcaagaccgaagcgtgaatatcttgcgtcagactctttattggacggatcccaggcctgcgaatacggcggatttgataccaccgcatccacatacaatgtctcgtatgtattaaccgggtcgttttcatcaaaaaacggccaatcttcttcaagcgtatcagcacatcttgtcgtgatgttggacggattaattcctctcataacaaggttcatacgggtaagattatatgtattttcttttagctcctgtgcataatactttatattatcggaatttggcatatactttgaaacactcttgccaatattaatcagcagcgaacctgaaccgctagtcgaatcatagatttcaatttcatttttgccttttaaatggtttgcaacgatttcggacatcaataaagaaacctcgtgaggtgtataaaactctcctgctttctttccggcattggctgcaaacttttcaattaagtattcataaataaaacctaaaacatcataatcctgtttgccgtccatgggaatatccttgataagctgcaaaagaccgctgatagcttttgttcttgcacctgaactgtcgccaagctttgataagcctgtttcaagcgtttgaaaaatcttctcaaatacttttttatgcgagctgctgatatttctgttgaaagccgaaagtgcatccgtcacatttgatacatcaaaatctctgccgatagatatccaagtagagaaaagattattataagatataaagtatccgaggttctgctgaacccatctgaccgtttcgtcatcatcttcagtcaccgtaggcagcagctcatccgtgtagtcgttttctattaaaaactttacttccttatcagataagtatttataaaaaataaagcccaagatataatctttatattcgttggcttcaattttagagcgcattttgtttgctgattcccaaatacggtttgcaagctgttgtttattcatctaaaagtccctttctgattgtatttctactatgatatgtcatttttactatcctaaaaaatagactttgctgtattgtccgcagcttttttgtcgggaataaactccataatatcatccgtagtgcaattcaaaaccccgcatatttttccgagaacctctgttgtcacattctcgtcccgtccaagctttaacattgcatatcccgataatccggcagcctcctgcaaatcttttttcttcatatctctgtcaagcaacatatgccatagctttttataactaacagtcattttgtcaaccctttctctctgtatgagtataagtgattataactatattatagcatataattctcggtatttcaatgattttgtcgaaaaagcaaaactgttttgttcgctctattaacttttcttaatgattattaacatgctatgacatcaacttagtacagcgtaataataatgaggaattaaaaattaggagtgaggaatggtattgagtaagcataggcactgataaggactgcaaataactttcagaagagaatattcctgtttattaacaggtggatatatgcttagtgttagtgaaacattgtcatatagattccctttccttgaaattaatggcgtttgatatccttgatatatccttttttaatacagcataaccatgcacaaaaacgaccatcattttttatacatagtccaaagggggttacttttaaccgaaacgatttaggaaataaaaaccacagaaaataaaaaaaccgaagccaaaactgactccgattttttctcctaaaacgcaaaaaatgatagtagctatccttgaaaatcggcgtataaatgcggacattttagcagagtatgtagtggaatagacacaaaaatatagggtttgagaaaccgcataaaacctcacttttttaacactcaaaacggttaaaactcaagggggtgcgtatagcatcattccaaccatcgaaaaactacttccatttttccacgcacaattatcaaattattctttttgacatttcgggcaatacacgctgcttctgccgccaattacaatgcggcaaagcgtttcaccgcatttgaggcaaggctcgccatcgtgcccatagacttgcaggaacggagtattgcgatattctttgcctttggtttcgatatattcctctgacgttaattcattcttttctataaaatatgaaagacgctcggaaataatcgtcgccagccgttcccactccttggttgtcaagctgcttgcgctcttagcaggataaatttccgccgtaaatagtatttcatcagaatatatattgccaatgcccgctataacgctctgttcgagcaaacattccttaatcgttttttttcgtttttcaaaatgcatacttagatattcagcgttcagcttatcagaaaatggctctatgcctaaattatcaattccgctgtatatatcaggttcgccatttttaatcagccaaaaccgcccgaaacggcgcgtatcagaaaagcgaagttccattccgttatttaatgcaaagacaatatgcgtatgcttttccggcggtaaatccggcggggcgagaagcaagcagcctgtcattcgtaaatgcaaaactatataatcgccgctgtccattgtaaaaatcaaaaactttccgcgccgtcccattgatgaaaagatttgtcctgtaagctgttcgcaaaatttactcgcagtggggtgcgctattacgtcgcggtttacgattatgttttcaatcgtcagaccttgtatttgcggctcaatcacattttttattgtttccacttctggcaattcaggcattttgtatttttcctttctttgcagattttttgatttcctcgtgataaaagaaatttacgacaacaggcggcgcgtcaaacggatttttcatactatcatcatctctgacgtacttcaaaccgttggttttagcataagaacggatttgatcgtccaaatttctccaatataaacgactgcctctaatataaatatcctcatatagcggaagtaaatccgcgtgcttctctttgataaagtccattataactgatttataactgcctcgcaaattcaggttttcaatccatacgagattacaatgcttctttactctgtctattatctcctttacgtcagtaattcccggaaagattggcgaaataaagcaagtggtgcggataccctcactgtgcaatttttccatggctgatagtcggcgcttaatactaacagcggtatccatatcatttttaaagccttcatcaagcgtatttatgctgaaaccgactcttgcgtcaggaaaagtttttatcaggtcaatatcccgcaaaacaaggtcggattttgtttgaatactcagctttgctccgctcccctgtaattcttggagtaaagtgcgcgtccgtccgtactgttcttcgagtggctgataggggtctgttaccgagccgataaacaattccttgccagcgtatttttcaggcttttttaaggcattccaatacttcacatctacaaaatctccccacgcttccgcatggttggtaaaacgcttcataaaacaggcgtagcagtatttacaagcgtgttcgcagccgacatagggatttacggaataatcgctgacaggcaaatttgattttgttaatacgctttttgtttcgatttcctgtattatcatagctgatattactccaatatcaccatttgcctgtgtgaatatgactgtcgggcgtactgtcatactgctccaaaacaaactcgtcctctttaggatatccaataccgataaaacaaggcgtcatccagcctttgggaacgccgagcttgtcaagcacaacgtcgtgttctctgttcagcggaatacgcatggagtaaccaagtccttcgttaatgacggcaagcataatattttccgcaacgcaccacgcggtagtaagcggatttagtttgctgacccattcggcattgagctttgaacacttaaacaggggaacgattacgtacggacaatcggtaagcattgtgtactgacgcggcatagcatatgcgtacatttcctgcgctaaattcagctttctgttttcatatctccctatgtcaaacctgtttaccacctgtcttgcatagctaaaagcattctctttttcctctttggtatgcaaaatgataaactgccaattccggtagtgatcccacgacggcgctttcatacccgctccgacaattctttttatggcttcaaaatcaacctctctatccgtccattctctgcttgtttttcttttatttataacctcgttaaattccatttttaatgctcctttataaacgatttctgtgcgccctgttgtacggtgtcggtttcttttaactctcccaacaataacggcgatgcgggattgtgatatttataattctcaaacgccttttggggatttttatttgcgtaacaatatttacaaccgttcatacaagtgtcatacgcacctatgtcgcgtgtttcaatgcaatgacagccctgacgcatacccttatgtttcagatttctgaaagtgatgccgtttgcgttacctaaaatatcaagcgtcatacagcctgattgttgaataccatagcgcgtaaaatcaccgtttgtgccgcaagtctgaattgtcataccgtatttagccgcgatttttcctaagccttgcgctaaaatatccatatcctcaaccgacatcataataatctcaggcatatttgcctgcagttttttatacatctccacaaagctgaaaatacagcggtcaatatgcggcgcaagggttttcgacattctttcaaatttttcaaaatgacgctctattgtgtaatcctttgttaaaagcaccgggtcatacctccacgcaacgcgctgcgccccgacctgctccgagagcttaatcagtgtttccatacttttctctatcgacggtacgcccggctcaatatccttgccataggcggtaattgtatagtgaaaatatgtattgaatttatctgtgatctcactaagacgcggcagtatcggcttataatttttcgagcagaaaacaaccgtgtcaaccctgtcaggcgtcagctcgtatcgagttaccttattcggaaacagtggattgcgcgagagaacataaccctccttaaaacgcgttaaaagccaatcggtataatattggacagtatcagtccgtccgcctgtgtttataatcattgtactacctcactatattttcctctattaacttcccgccgtcatagtaaatatcatcgtcagatgttatctctcttttgataaccgccggagttcccattgcgattacattagcaggaatatccttcgttaccacagagcctgcgccgatgatggagttgtcgcctatatgtactcccggcattaccgtaacatttgacgcaagccagacatttttgcctctatatacaggcttgttacagccataaccctcgcagcgcagcttgggcgacacggggtgcgacgcggaagtgattgttacattcggcgaaatcattgtgttgttgcctatgtaaatattcgcgtcgtccacaaaaatgcagttgaaatttatgtacacgtctttacccaaatgaacgtgctgtcccgcgcacattgcgtgaaacggaacctgaatgtatgcaccgtcgcctacctccgcaaacagcttttgcagatttttctattttttcttttcaccgcgcttagtgtagcctgccgcattgtacttttccattagtcgcagcctttttagataatcggtattatcgcttgtgagcgtccacacattatatatttttcccgaatttaaaatttcctcatattccatcattcatttttcctccgatattattaaatctctctttcatacaataagcaaaaagtgttgtaatgcgtaccaattccgcaatatccgtatcagacaattcacccatagcatctatttccgcattagctgcgggcggtatgattttctttgcgtattccctaccctcatctgtaaaacaaacaattttgtttcggcggtctgtttctgactccgtcagcgacagataaccctgcttccaaaacttttttataatcgcgcttatagtctgctttgtcgcggacagtctttcgcaaatttcagattgcagacagccatcgggtgcgaaccatattatgtccaacacaaacagttcttttgcagtcagattgtgcttccttgcatataattcataagcggaaaattgaatatcccgcagaacgcagtattgatttacatagcttcgtacttcttcgcgtttcataaaagcctccataaaatatttgatagtctaatattgtacttattgtaaaatagatgacatgttttgtcaatggcgagtatagaaattattattctaaatcaatgataaaattgatattaaatatattgcacaaaaaaatgtgaagctacctacttcacatttttgttctttcgtctgttatatcctcaaatatttggtctttatcaaataccaaactatcatatatcagcttaactccgagccgaaaaacgagcttaaaattttctaaacttccgactgcggttatttcatcgtgagcgtttataaggtcgataaatatttttgcctctttatcctctaacagctcattcagtttattttcgcaagcgtaaaatcgtttaagcgcttttacgtattgagaatttctgttatattgcttttgattaggttgtatattccgataatacaattcctctataaaattcatcttgtgtcctcaaacaacagttttcttgcaatcgttaattccgcattgtcaacactcggtacgtcccaatagcaaaagtcgcccacacggtcaacggcgagattctaattcggatttacagattgatgaatccttgtatacgcttcatcaagagctgtgttgcagttattgtcgttctgtacatctgtaattatatacaagctgaattgaaacagcaaggagagcaatccgaaaacttggaacgctttattgaaaagatacataaatattttgatttgcaagaactgatgccggccatattaaatgatatagaaaaatgtgttcacgtccacgcgtccaaaaaaattgacgaacatagaacgcaaaaaattgatatttattatgacttggtggactttttgcctttactgaatttgtattacggtacaagtcaatctcaatatttccgtttaaaacagcatataattatacacaaaaaatgaccataattttttgtacatagtgcaaaggggtatacttttaaccgaaatgcaaaaaggggtaaaaatcactgaaaactaaaaaactgaagctaaaactgactccgaattttctcctaaaacgcaaaaaaggcttgaaaccaagcctttttcattgtatcaactttatagttgaaatatggctcctccagttggactcgaaccaacgaccctgcggttaacagccgcatgctctaccagctgagctatagaggaatatatcaaactcaacggataatagtatactattttttttatccattgtcaatactttttttaaaattttttaaatttttttgtaggattacaatagatgtgttacaaagagaaaaaaagaatacggaaaactcataaattgtgttatagttatatcaccataatatcacatacacaaaggagtcttccgtatatgaacactataacacaaactatgagatttaggcaagtattaattgaatattcttttaaacacggcgtgacaaaggctgccattcgctataaggtaaatcgtcagtatgtctatcgctggcgaaaacgttacgacggtacgctcgcctccttagccgataaatcacataaacctcaccatcatcccaatcagcataccgctgatgagttgaaattgattactgagcgtctactgatcttacatatccgtctccgtttatgtccgccgtatgcgctatcactgtattggctgtctctccctccattactgacagtctgtccttaacttcctgctccgtaattgttgttccgttgttcgatacaaatgccgcatatcctcccaggccttctgagtaatacatttctattgctgctgttccggctgactgcaatacatatttggcattttcattctttgctgtcgttactactaccaaatcttttccgctcggcgccgcattgtaactgtcgtgcgctacaatctttaccgttcctgttattactcctgcatatatctggatattctctccaaacatctgatatgggattgtatatactccgttgcttcctgttaagtatcctttgtttcctccgtttactgtgtaatatacatatcctactatatcaccgctgtttgccggctctacactgaacgttatatctgttccatatgtcgcttttccgtctgttactcctgtctctcctgtatacgctccatttgtcacagtattaaatgttacgctatactgggcttctgtatatgccgctgtcaatgttgcgtctcctgtcacttcatatgtactcaggtctatctttacatctccgctcatccagccatccggattatatcctgcttctgcttctattgtcggcaggtctgactgcagcaattttgagtttacatcctttgctatctctgtcactgctcccgctgcaaaacttccgtgtgttcccggctcaaatgttatcttgtattggcgcactgcctgagctgtcagacttgtatcttccgtatatgttcctgttgtcaaatctgtgcttgtataccctgttcctccgcttgttttccacagcggttcctctgttgtatcttttgccaaacggtagttctcgtttgcagttaccagtccctttatttgcgtatctgtcactgccgtagtataactgtcgtctgtgtatagtcctgctgtattatactttgtataatatgctgccggtgaacctgaaacagtgtttccatctccgcttgagagtgttacttttaggttatacagattaacggtttcagctgttgatactgctgctatatcagtatcagctcctgttggtgcaaaatatccgtccttcgttcctactgatacattagccgctgtttctattcctctatttactgtatactttactgtcattatagttacagcttcgcttgatacatcaaccgagctgcttcctgacgtatacgcaatcttattttgctccgctccttctccctgcaccaaattatatccgtttgtttttatagcgtctgacgcttctactgatgtcaatgtcatttttgtgctgtcatagtcaagagctatattaaagcttccgaaattagtcggttcactggacttaacttttaccgctaccgctatctcgtcaccggggttaaagttctcgtttgacggcgttactaattctgtaaccaactcatatcccaaactgtcagttattgcatatgtgctcaaatgctttaactttgttattacctttttgcctgctgtgtcatatgccgacgctactcctgatttttctccggcgtcatttatatacactactgatacttttgaaggatttgttactgccgcctcggtttcatacggcacttttagtgtcaagtttccgtttgagcctgctgagctttccggcaacaattctgtagttcctgacatcaattttacgtctataacttttgctccggacattatcatattatttactgtttcattgctgctggcttcaagcaaatcaatttttaggctaactccctcgcttccagctgtattagaaactttttcaaaggcaaccttatctaattcaacttctgctacatccgtattgatagttacactatcaggagccgcactgcttatgctgtcaaccaaatcctttggaatacttacatcactgtttttaacttcactgcttggctcatcggttgttgacgcatttattacaggatttcctgtatctatccctgttactttactatcatcaacaactacagtctgagtgaaaaccgcagtgattaaaactccgttttcaggcattacaaaactgtatacaccatcattaaacggaataattaccggctgagctccgtcaatggattcagtatatgtcaaactgccgtctgcgagattatatcccacatcaggagtaacagtaacgactacagtatcaccaatattagcatttggattttcaatgctgactgttcctccggtaatacccgaatcaatggtcacgccttttgaaattgaagaaaatgctattccgttataataatatgttccggcatcaagttttgtatcaagccatgacgcgccatcagcatttccaacaatatatctggattttttatctgaatcaacgcttccggttatatttgctgtactatcgctggcaaataattttgatgaatttccaaaatcaaatgttgaatttacgctcttaaaatctttaaaaacaaagttcttaatatcaaacgcatttgtaacattttcaaaagaacaattcatgttctcaaaactaaatcccatagcagtaccattggttgctccgtttaaatatacaccgtctgaaatgtttttaatttttaaattaacgttcttaaactcgctcattctatctgtcttgtaacgggtaacaattgcagactcaccagtgttattcatatcaataacaagagacggtgaaccgctgtttccggcactaacaccttcaatagttgaaacacctgttccgatagcatgagcagaagcatttgtacctgtatactttatagaattatttccacaaagcattattttaacattatcattattagacaatattattgaattattaactttcgctgcctgactgtctgcaactgtaaccttttcagtttcaattgttacgttattcagaatcaaaacatcttcatacggcagccactttataccatatgatgcaaggtcagattcactcattgtatttaatactgaacctaccgtatacatatccaaacaatcggtatatatttttccatttccgctttggacagtatagtattcgctgtcttcagatactccgctaaaattccagcttccggattcaatattgtatgtaccagccggtattttattgattccatatagatatgtatcagattcaaactttatgtttcctgattcacttgaaacaaccggcaattttgtaaaagcttgaaatcttatgttactcagcgtaatatttccgcttatagcgatattcttgtcggcctgagtagtctcaatcgcttttgatacattttgaatcaaagttgtgccgcctataatattaacatttcctgtgtctgaactaattccattagaaattatttgatttccgtcttttattgctgcagtacaattattaaagtttatatcacctgatgctgatattccatattttcttcctgtaatgttaaattcagaattctcagcattaatatttcctttaatttttactgccgcactgtttcccgaatttcctgtaacagtaatttttgtattattaaaagatacattgttatttgttacactaataccatatgaaaacaagtttgtaataacaatttcagaattttcaaatacaggaaccatattggtgctcttgatatttatagccgcatttagactagaattttcttctaatgaaactatatttacatttgcattcttaaatcccagttctgattctgttgttgctgtgaaatatattccatagccgcagccgcttatattgagtacgccggaagttactttatcactggaaattattccgcttttcatatcaatgccgcgaactgaatttttagctgtatttgtatttttcacattattcgttcccatcaaaactatatttgtattatcagggagcataatcatctttccgctggataaagaagtttcaatatttgcgttataaagtgtcaaagtatggcttccatctgtgttatcttcaaaatatattccataatccttttgctgctgctctgtcaaaggattacttgaagtaaaatcaagttttgtttcacactttactgtaccgggggttttagcctcgcctgccggctccttatcagaatttggatatgcaaatgttactgctaaatcaagtatattgctgtcccccaacgatttaaaatatccgctttcacgtacgtcagaatatttatatgcaatagctgggcttttttcaaatatacgtacttctactccaaaatcttctcctgttgataactgttcttctgtatatgtctgtaccggatgtaatgttattgtctctttatcaaaatcttctaatgttactccatcttttaacctaaaataaaaactcattaagtccaaagagttaacagctttcgacactggcgttgtccatcctgctgtcattcttactgcttttcttccttctatatcagcatgatataattcatttgctactgctgcgcctgcttttgatgctacttccagcgcacctgacacagttattctattatcttgatccggttctgtatataataaatcgctgtattgatcatttgataaatcaccaatcgcatataccggctgtatcttagaatcgtcgtaatttaatactgtctctaccatctgtaaatttgccggtgctgataaattacatactatcttatatatttgtttattatcagattccctaactcctgcttcctgccaattgagtgcaacttccggcactgtcacgtcagccagctctgcttcactgctaccgtctataatttcttcattgttttcttcagtttttatttcatcaacactgtcagaaatatttgcatcagacaaattattatcagcaaatacaaaagtcggagataaactgaacaacatcaccaacgccaacaacaaacaaccaagattctttttaatactcatttttcttcctccaaaatattttataatccataataattttctataatgtaagtcttatttagtaaaagaacgtcctacaacagtataaagaactgcagctatatcacttgtgtctaccgcgtcgtcactgttataatagtttgcttttattctcatttcgtctgatgtgtcccctattcggttgttgtaatacaggtcgtttactatcattgcgtctactgatcttacatatccgtctccgtttatgtccgccgtatgcgctatcactgtattggctgtctctccctccattactgacagtctgtccttaacttcctgctccgtaattgttgttccgttgttcgatacaaatgccgcatatcctcccaggccttctgagtaatacatttctattgctgctgttccggctgactgcaatacatatttggcattttcattctttgctgtcgttactactaccaaatcttttccgctcggcgccgcattgtaactgtcgtgcgctacaatctttaccgttcctgttattactcctgcatatatctggatattctctccaaacatctgatatgggattgtatatactccgttgcttcctgttaagtatcctttgtttcctccgtttactgtgtaatatacatatcctactatatcaccgctgtttgccggctctacactgaacgttatatctgttccatatgtcgcttttccgtctgttactcctgtctctcctgtatacgctccatttgtcacagtattaaatgttacgctatactgggcttctgtatatgccgctgtcaatgttgcgtctcctgtcacttcatatgtactcaggtctatctttacatctccgctcatccagccatccggattatatcctgcttctgcttctattgtcggcaggtctgactgcagcaattttgagtttacatcctttgctatctctgtcactgctcccgctgcaaaacttccgtgtgttcccggctcaaatgttatcttgtattggcgcactgcctgagctgtcagacttgtatcttccgtatatgttcctgttgtcaaatctgtgcttgtataccctgttcctccgcttgttttccacagcggttcctctgttgtatcttttgccaaacggtagttctcgtttgcagttaccagtccctttatttgcgtatctgtcactgccgtagtataactgtcgtctgtgtatagtcctgctgtattatactttgtataatatgctgccggtgaacctgaaacagtgtttccatctccgcttgagagtgttacttttaggttatacagattaacggtttcagctgttgatactgctgctatatcagtatcagctcctgttggtgcaaaatatccgtccttcgttcctactgatacattagccgctgtttctattcctctatttactgtatactttactgtcattatagttacagcttcgcttgatacatcaaccgagctgcttcctgacgtatacgcaatcttattttgctccgctccttctccctgcaccaaattatatccgtttgtttttatagcgtctgacgcttctactgatgtcaatgtcatttttgtgctgtcatagtcaagagctatattaaagcttccgaaattagtcggttcactggacttaacttttaccgctaccgctatctcgtcaccggggttaaagttctcgtttgacggcgttactaattctgtaaccaactcatatcccaaactgtcagttattgcatatgtgctcaaatgctttaactttgttattacctttttgcctgctgtgtcatatgccgacgctactcctgatttttctccggcgtcatttatatacactactgatacttttgaaggatttgttactgccgcctcggtttcatacggcacttttagtgtcaagtttccgtttgagcctgctgagctttccggcaacaattctgtagttcctgacatcatgtctaatgtgcgtgtagatatcttgagttaattttatgtctttgtgtcccattaattcttgagcgtcttttgcttctattccggcctcaaaaagcattgtcgcataagcatgccgtaattgatgagcggttaatgttaaattattttctttgcgcattttgtcccagcgacaagcaagctgttttttggttaaatagtcttcatgctcgttacagaaaattatgccatgttttttattcggcaaatattttgcaactctgtccaaaagtataactgttcttgttccggattctgttttagtttcgtatattaatattgggttatttccgtcatgtacaatttttttgtttacatttataattttattttctctgtcaatatcttcgtaattcaaagcaagcgcttcactaattctaaggccggtatataacagaaagtaggccaaaaatccaaatccctcatgtaaggtgttaacgatttctatttctttggtgtcgggcattttacgtattgatttttttaaattctttggtagtgaaacagatgtaaccgggtttatgttagcatatccattaactatagcaaatttaaatatttgattaaaaacacttttatatgttgccactgtcttctgtgcgtaatcttttgcggcaagccgctttaaaaatatatcaacgtcatgcgatgtaatgttttttatccgttcatttccaaactcttgtaatagagataaatatgcgctttttccgcattttttaaaagtggtatatggtgtgtttaataaatattcgtcgagccattcctcggcaacagttttaaaaatttctcctttttctttggtgtcttgataggctaaaatctttctgttaatttctctttctgatttgccgtaaaaggatttaatttttccgttaatccgtatctgtttacagtaccttccatcggctcgttttttcattgtattcacccttcttacatttgtgatgcttttttatccaaagtgtgggaatggttgttgcactttttgcaacaaccaattattttaacttctcctgcagcataattaacgcacccaggaggacataccattacatcatatcaatatggcggcgataacgtcttggtatatcaataccaaccatataaccgatttcgtttaacgctaatggtatgatggaaaatccgtctttgtaaaatctttggatacgttttgatttgttggtcatacggccacttatttcaatccactcacccgtatagggtgcgaccctaataataccttttggttggcttcaccgaaatggtcggtaatttcttgatgactgtttttacacgcttccattgctttataaataacaactaaaaaattctgatagtctttatattcaagagcttttgcaagctctcttgctgaccagaattctgcaccatatttgttaacatgttttattccttcaaagatacacattgataactcatcctttgcgacttgtatatctgttgctctcttgctggcgcaggggagctttttatatttatgtattttatacgtgacggctatgccttgagcaagtcagctcttttttcttcattcaatcatctatattctgtcgttatataaatcaaaatagatatcatatccggcttcactgttgtcacctatatatgttttcacttctatgcagtttccccagaacaccatcacatattttacgggtccgcctgttccataggcttcatcggaaaaattccaactgccgtatccgatagcggtgttgggactaacgaattcagcaatagatgaattataagtcaccgagtgtcccggcttttgatagtcaaaatcaaaatacacaataccgtcacttattgaatttatcgttagcgtatgaccgaaccaatatcgaccgtttggttcaatactcttgtagaatctacctatacatgggttcaatgctagataatcagtcaaaatccaaccgacaagaccattatatataacttggttaaaactattatcccaaccaatgctttcaacttgcgcgccaaggggcacctgtatcaactcttcagcatttacgctcggggatgttctcaatgtgacagattgttggcaattgaccacatccattgtctcggcacatgtcgtcatcgccacacttaaagtcattataataacaacgattaagctaactatttttttcatttctaaatcctcctttaatattcataatatatatatttattttttcttctaaatctgaaattctttttctttaaatataccgcttaatccaattttgaccaatgcctttctaataatatagcaaaatatttttttaaaatttatttattatttgaaatacagatttcacaaggttgatatcccgcctgtatggcttcatcagctgtcatatgtattaaattagttttattttttatataactgcagtttgggttatgatacttttgtcctgtttttgtaactatcacgtccgttatttgaggagcaggtgtagcttcctgagttttttgagtgtagtctatattctcctgattatttttatagtctgctgttattgtagctgttattagtaatattgctgttattattgctacgacaatatatttgatttttatagttttatcttttatttcgttaaattgatcacataatttttcttcatactctgtatattttttgtgcttacgtacttcatcagccactaagttgcttcgtttatcatctagtaacgttgttgctgatataagctgaggcgtatttatatgcttttgtgacaaaatgcatacaggtgcaagaaattcgagtgcaaattcatttgcttcgtcttcctgcccctcatcaattaatccacctggtttatatcctaatatgttgttgctagacatatgccccaaaattatatgacctaattcatgagctaataacatacgtttatcattagcagacaaaccggagcgaataaatacaattttttctgttttacgcttataagtaaacgcttttgtccgttttgcaattgcaaaaatgttgtattgtttgagcaattcaatttgtttgccgttgtttacatcatattttaagatgctccagccttttgcctttaataagtcttctataagatttatagtaattggcaatttgtttattttattttctaacaaagtaattactgcactgtatcttgcaaacactatgatacctcctgaaatcaatttcatataaagatatcataatgctatatggtttttatttcaagtggcaataactgttaattactgttcatcatcgacaaatgatgattcttcaccatatgccgctgtttgtgaagaatcaatgttttgaaattgttcagtaacagtttcttcaccatattcctttgtttgtgaaaaatcaatattttggagttgttcgttgatagtttcttcaacgggagattctatttgaattctattacatatatcttgagggggttgaaggccaatgtaatcaacggtattaccgctaaaaaatacgctcaatattatagaaattatctcaatataaagtgatattttgttatatttttcattttctttttctgcttcttcgtataaagaattacttttttttaattcattaatttcttgttcttttaaagaattactttttactaattcgtcttttacttctttaaaaagtgaaacaatttcatcagaagtgtcattactattgctcagttttcttatagcatttatggtgtattcagtatttgattccgcagattcttcacattttatataatcttcatttgtttttgtttcaacaaaagtgtcaataaaattattttccattgaaataatatcgtcaataaaagattctattgtttgttctggcaaatttgaaaatatagaactaatggaatttttaaagttagaatagagagtatttgatatacctaaacttggtaatgatgaatacaaatctgtagtgttttgaatatttatttttgtaatactgtcattaatatttatagtatttaacttgttgcttagcttatagttcatgttttgcagtttttttgcaatagaaaaaagagtagtttctgatagaatcgaaacaacgttattatcttttattttattaatcatttccatcctaggaatacaagatttctctaactcagttttaaatgacatatccgttgtaaaaggactttcgcaaaatggtgttagtttagttttaactccagtaatatagctcaatgcattatcaatattgcgtattttcgattttaataaattttcttgaattgatacaattttttggcattttattaatttatcaaaagagtcattaactgacatctcactaattctccttatcctttataaattcattttcgccataagcagctatttgtgatgtatctaattctctgaattgttctgcaatagatattggctttgttgctttattaaattccttaacatttgttcgttctaacaaataatcagcagaaacgttaaaataatcgcataatatttttaaactatcatatttaggcagttgacgaccatttttccattgactaattaatccttctgttatacctgtctctcttgacagtttatatgcagtaacgttattttcttgtaaaagttgtacaaataaatccttaaacatttgtgcaaacctccaaactttacaaatgttaagtaaaggtgttgactactttacaaatgtaatgtataataatattaacttaataaataaattaagcatataaaaacacgccagctgtaaaagcggctaaatatatattttttaatcgacaaattaattatacaatatttggttcgcttttgcaataggtttgtaaatttttttgaaaggagtgaaaaaaatggttaatgggattgcagcaatattattaagtgcaaatttgttgatattagcctgtttttgggtaatacctgaagggataactacatggactgctttatttttatttttcagaaaaaaacgcgcagaaagaaaatttaaagaaaaaaacacagaaaaggagaaataaagatggaaaatctagtcaaaattagacttttaaatttagggaaaaagcaagtggacctgttgaaagtaataaggtcaaaaggctattcgaatttacaaccgccgcaattgagttcttacatcaatggtgccaatactacgccacaggctcaagccgtaatgaaaatagtatatgagactttggagcagtgggaagctgatttatcagcctagaacatcacctaaaaaaataataccacgaattgagtaaaaaaacaaccactagatattgtggtggaagaaaatcagcctaggaggtgtaacaatgacgatcaatttaaagtttagagttttaaccgattggaacgacgaattgaaaacaattcttgatttagttgaaaaaataaaagaacgtcaccccaacgaccaactatttattgaagtgacgttcgaaaattaagcttttactatttcaatacgtatttagcaaagttgcaaaataaagtatagaaagaaggtgagcaaaatgccgagggagaaggcagcatatagggagaacttagaaagcgttttacagtttcttggcgataaatacggagatagacgacatcttttgtgtattaaggatgttcaggactatacagggacttgttatgattttgcaaaacgcacatttttgggtggtaaaaaatatatttcggctgagacgtttgcaaaaaacttgagtgaataaaaaaactaactattaaatgttaaatggtagttaaaaaaattaaatttgacctgatatagaaagaggtgattgaggatgtataattttttgattaaatataggctaaagaccggggcgcctgcaactaaatatataactgtaaaatctgtatcggcaaagctggcaaaacagcaatttaatgaaatgtatggttctgccagttttgaaatactgggagtatataaggaggtgagatcaattgtataactggattatacgaatatcgggagcggtggttggcgttgtattgttagttatggttaggtcgcttgagtggtatcccatattttacgcagctccgcttatgatgatacttttggcattttttaattgcgcagaggacacagctgaagaacaacccatagctgacgatgtgcgtaaggtcgtaatcaagccggataatcggcggtgggacttttcggacgcggagtgcagcagggattataaaaataacagtagcaaaagaatacataaaattgtaatgtgaggtgattattataaaaccaatagttatatgtggaaattcaaagtttgacaggcttgttatggactgcaattttgcggctatggcatatatggacaaggacatcaatgaacagtacagagaatttaggctggaggatataaaagtaaagtcctatggatatgatggaataggacagctgataactgaaaatgtagtttcgcccaaagaagatgaatgggattataataatacatattatcagtatgacacaagaggaaacaggatattaaagtcaaacagtgatgtgtatgaggaagcgtcggagatagaatataaatatgacaagaacaataggctgaaagaggaaagggagacgaatccgataaacagcatgtatgagaagataacatcatacgagtatgacaacaacggaaacctattgtttaaaggaatagaagagtatgacggagtaatagagggagaggaaagagaaatagagctgggaaaaggatattttggaaatgaggaatatgtaaggtattatagctataacggaagaaaccagctgataggaatgaaaagcgacaggacggaagcaatatataaatatgacccgataggaagaagagagagcaaaacggtaaacggaaagacaacgacccaccgctgggatggaagcaatatagtgagcgaagctggagagaatccaacggtatactatatgggaataaacctgatagcgcagaaagataatgcgggaataagttattgtcagtataatgcacacggagacataacaggtttagaaaacacaagaacaaagatgctgacgagatacgagtatgacgcgtttggaggcacaaaggaagtaccgggaacagtatacggacaaagagacaggattgatatacttaaggaaccgttattatgacccggaaacaggaaggttcacacaagaagacccggtaatggacggactgaactggtacgcatactgcggtaataatcttgtgaacttcgttgacccgtttggattggatagtatagaaaattattgtactaatgaagataaattaacattagaacagaaaaaagcaatgaactcagctataaatgcatatcatgatggagttttatcctatggagatatattagaaaatttagcacttaacggaggaactataagtgaattggcaaagggacctgctgtagtagcagaaatggtgggaagtgatttgaacataacggtttatgcaaatatagaatctatagaaattatggcgaccttggattctggagaaaaggtaaaaggaatttatacgcaagaaaactattcaatgatgttaaataaagatgacctaggtgatatagagtacttaaactcaggtggaattacatttaaggaaattctttgtaaaggcatagaaagttggtctggtagtgttaatggaataaatataaatgtaaatgttgtatatggaaaaagtaatacaaacaagacagttaaggccaatttcgtatatggaaatagggatcaaagttcatctccgggatatagttttaatatttattatcaaaatcgcattgatccaaacgatcgtgcattaatagatataataaacgtatgcgcacatgaaggcggaggacacagtgcattcaaaattaaggatgcttattttgacatagaaaatgtgggtattgttccaactgttatgaatgatgctttaattccggttacagatctagatagaatgatgttgattaatgcatacaatggtaattttaaacaaccactgtactacacaaactacccaaatcttttgaatatatatgcacctggatggataaaaaaataaaaaggaggagtaaatttgttaaaacatataaatgctattgtttttataataatgttaaatttaatagttttaccagtctattcgatgaataattatgaggagttttcaaaaaaaactgatacaatagtagaaaaaatagatataaactatactttaaaaaatgcttctgtagttagtattatgaatactgataaaaatggcgtgattttatttgctcaagattatgaaatcaataataaagataattcgaggtatatatatatagactataatggaaatattacagaatataaagattattatgattcctgtagtgattattataaaataccaaatatattttgtgaaggaattgccagaataaaaagtggaaataaacaaggatatataaataaagattatgattggattacagataaaaattattattatgcttcagacttttcaaatggctatggggtagtaaaagaagtgtccggaaaaagttatttaatagatattaatggaaaagtttgtctagcggcagatgacttctattttaccggtcaaaattctgacaatccgggaacagtgtttagaaatggatatgcggcatacttaaaaaataatgaaatattttatttggatacagatttaaattccgtaaaaattgatattggaaatgaatgtgattttaatgatggcgagtttatttttaatggtggcactttagtgcatatgtaccctgaaaaaataaatggagagtatacgcataaacaaatttatcgtatatttgggcatgatggcaaagaatcttatcgatatgaattacagcttcctgaattagaaccagttaatgatttttattatataaatgtattagcaaatggaaatgtcattttttcagaacctgaagattttagccgatataattctttagcaaatattaagcttgtttcaaatgaaggcaagaccttatcagaaacaaaacaattttatagatctagtagtaaattgttccgcagtataggagataagatatgtagtataggaaccttttatgatgaaaattttaataaattaggaagtataaatgtatatgatgaagaggcggtaaacaaggatggaagtgttgttgtcaatatagaatctgagtcaaacgttgaattaaatgaaatcatattaaaaagtttatatattgttagtaccgataaaattaatataatgaagaaaacaaatttagttaatccagataaaataaaagtgaatcagtctagcaagccgaaaaatattacagtatatataaacaataagcagttaaattttgatatatatccaataacggaaaaagatagaacattagttcctatgagagcaatatttgaagcattgggagcagaagtagaatgggaaaatgaaacccaaacggcaacagcaacaaaggatggaataacagtatcagtgacaattgacagtaataggatgcaaaaaaatggagaagaaataaaattggatgtacctgcaagattagtaggagacagcagaacattagtgccattgagagcaatatcagaagcattcggctgtcaggtagaatgggacgaagaattacaaagagtagatatttatacaaactaaaattgttacggagggcgtaattatttacgccctccggtaaccccaaaaaagctggacaagcgtaggaataaaaaactgaaacggtatattatatgctgataacactaatattttagatagatattctctaggatggtattataaaagattttatgaagattaaaaatttattagaaaggaagataaatttataaatggaaaatatatttaaaaaaatattggtattggtagttgttatatgttcatttttttgtagtaatgtgtttgcaagtgaacgggttataagaaatatgacaattgaggatattgtggggaaaaatattgagttagattggaaaaatgttattccaaaagaacagtttagtcctggaatgtatatttgttcaggtgtatatgactttggaactacatttcactattacgatatatcgaatgatatatcaaatgaaatatttatagattatgatggtaatataacattgaatccaataatttttcagggtggtatcgcaattataaaaacgacagataaaaatttagacgagcataaaacaaactataaatatggatgtataaatagtaaatatgaatggataattccaccaaaaataaaaagttatatagaaaaacaatatggagaagcgtttgcaatgacaatagaagacgcttttagagctgaaaagtcttatgaaacaagaagcgaaaatacagatttagtaataggaacaaatggatatggtcaatttccatatgatttgacagtaacaagtaattctgttttttcaccagaatcagatatgggtgatttaaaagaaaaaaggataggtgattatgtatcagcagcaatattgagaagcagaggacccaatatagtagaatatttattagatgtttataactaaagtattatataactaaaaaaataaaaaggatgtgtaaaaatgaaaagatcaataggatgtatgattgcaatatgtatattattatcaagtataacagtgaatgcacaaataagaccattttgggctgatggagattttaatataatatgtgatttaggaatagtaccaaaagaatatagagaaaaagatataaatgatttagtaacaagggcggaagttgttcatacactttcatgtcttgtttttgccgataattatctgattccgcaggataatcaagatggaatatatgaaaatcttggttggagattcgaggatattgaaagtaactctaaagattgtactatagcattttggggagcatctatgagaatatttaaaggagatatagaaaatggagtacataaggccaatcttcaagaattagcaacatgcagagatgcagtatttatgtccttaagagcgttatatagaaatctactttttaaagacgatgatgaagtagattattttaatttagcaaaagaatgtggaatgataaattatgggactgtaatatcgtcaacgtcagtagcaattgattttgaagagttagatgacaatatgacatgggaagaattctcaaaaatagtaagaactattttatatattccaaagactgtgacagcatatggaggatatattaatcaatattacatagatgattggaaaaaaggctatagagaataaaggttcctaataaaacaataaattaagataactttgaaaaataatgtttagtaagtaaattttgagggcgtaaattaatttacgccctccggtaaaccaaaaaaagttggacaagcatacgaataaaaaattgaaacggagtaaaaaacaccggaaagtttttgaatatataaaaattacttgatcatttgaaataaaaatccattaaataccttatttaaatagttaagaaatatatagctccatttcagttttttatgcgtaagtaaatttaggtaaaattatagaagataaaatattgttaaggcaacttattttgcctgatccgaatcaaataagtgaaaatgctttaagaaaagaacaggggttaggtgcaagagtatatcattctacactttaaaaaaggagttataaaatgaataaaaatataagtaaaataatagtttttattttaattacttctgtgttatttcaaagtatttcagtaaatacatatgcggaagagagaacagaaataaatactgatgaactaacagaacaattaatattgtatgaaaactatgaaaatgatagttttacaagagaagattgcattgttaatataatgaaaattataggtttgacggaagatgttattgaattaagtggaatatatttaggcagaccttttatagattatgatgctaaattaaatgcgtatgattataattatatttcttatgcgtggttaattggaatggttcagcttgaattaaaaaataatgctgcgtgggaattaagaccaaaagataaggctacaatacgagaagttttaacttggtccgtacgatgtttagaaaggtctggagaagggtgtgataaaaaacattgggattatatttttacagatgaagaattgtatgataaggcgtcaaagtataatttaattgacgaaaccgaaattcaatttgataggttaaatgatttaataaatgtagaaaagtacaaagaaataatttcaaatctattaaaatgtcaaattaatatacactatgcagataatgagtcatatcctgaagaatcgggatgcgatttaaaatatgatggcaaaacttatggagaatatataatattgaagaatggaggatttgaagttagaaaacgagaactttttttcagtataaatgaaacggcttatgataatccaatatttttataccgtttatacaatgatagaattttcatggactatcttactataaaatatagttttttttataatttaagtgaggaagaatttgataaaataatagaagacaattcaatagaaagatatgaaagaaaatttaaggatagaacaaatacatatgtgtcaataagagaattctgtgaagcaataggatataaagtagaatatgaggaaagtagcaatactataattttaacaaattaaatataacaaagaaaactttattatacgagaaagtttgttaggatgtaatttaattacatcctaacaaattgacaagttgaagagtgaagaacaagagtacgcataaaaaactgaaacggagtaaaaaacaccggaaagtttttgaatatataaaaataattaactatttaaaataaaaatccattaaatacttcctttttaaatagttaagaaatacatataactccgtttcagttttttatgcgtaacaggatgtaataagtgaatataacctaatgggactgccaaccaaacaaacggacaaaaacggaaatgaaacagtaaatacgtataatgtgtatggaagcgttctgacgagcaaggtgacaggagatgaagatataatcaatacatacagcaagaataatcttctgatatcaaccaaacaaggaaaggaagagataaaatacacctatgacgactatggctatatgaaaacagaaagccaatggaatattcagaatacatatagttatgacgtaaacggaaacaggaaaaattatacacaaaaagcaggaacaaatacaatactgacagggtcatatacatatgacatattgggctttcggatattcaaccgttactgttgttccgtcaggattccttgtggatatctgtctgcccaaattgtcatattccgcatatgtcacatttccttttccgtccgttgtgcttactgctcttcccagctcatcatacgtataactggtggttacacctgcaaccgttttcgtcagcggcagcgacttattcagatacgttatattctgctccgtatactccgttccggtcttatagcttctgaccgtacttgggttggctgagttattgtcatcataggaatatgtctcttttgcaaccaaatttccgttctcataggtgagactctgagccggaacttttgaatccgccgacagcactgtttcctctttaaccgttgtgcttccgtctcttttgtattcctttgtcagctgagtatgatacacatcatcgtatgtatacgaggtcatatgctctgtattggttttatctccgtttgcatatgcgtcccagctcttcaccaggtctctgtattcattatactccgaaatcgttgtactttcaatactattttgttcattatcatatattatgtttgttactgtttccgggtatgttcttttgtagtatcttactgtttctccgccataaattgttttggacagatataccgaattctctccgttcatataatatacttcgtctgattcttttaacgtaaactttccactagcattactgcttttataactgtaatacttgtcattaggataatatgaagatgtcgattcataacatggtgcataattatgctttgttattacaccgtcagatgttgtttcggttgttgaataagcgttgttatacataaaagaccctgaataatcatatgcaataacattttcttctatcccgttaacaatatcataacgtttgataagtcttgctgattcctgtcttaagctattataactatacatagtttttgaatattcataatgtgttgacgcacctgttggatgtataacatcggtcaaaatataaaaatttctatttataaaatttgttacgctatatatttcatcttcgttatttccttcctgatatttaaatgttgtttgtaatccctcctgatttgtgtaactatccagtatttgggcatatgtgtccatattggctgtattcatagttgacctaatattatatttttgagtggttccctctatttcggaaccatcgcttcctaacacttttactgttatttcttgaatataattttcttttgtttttctctctacaattacctgtctgccgcatgtatctgtaatcacacatttattatattcctgtcccagctttgtaaaatcatcatttatttcatcaccgtttgtataatatctataatatatagcgtcaccaaaacgattttgggttttcataactttgccgtctgcatcgaagtattctattcttccatctttgtaatacaatttaaaggcagagacaactcccccgtcagaatcaatatattctgtatttttttcgaactttaaatctgcatagctatatcttccatccaatgttaactcaattacagaagaatctctgagacttttgtatgagatcgtatgcgtactgccgtctgaagcagtcaatatcgaatctgttctatatgacgaaccatactttctgtttattaggtttatagagctaataccgttaaaactccatcctgccgcaaagtttactaatggagtttcatatttataccaccctacagttgtcgctggaaggctgcctatatctgtgggagatgagtttgcagtattatagcttgcgcttaagttcaaatcaagcccatttttacccggcaatgacagtccgcttaagttatatcccaatgctcctgaggattcattaaaggtttcattgttgtttctgtcaaacgtaaacggtgcgtcagggtatttagatgtatcatatattgtttcatcttcatcttccataggcatcacttcacttaagcaagacatgattgaactatattccaaaaactgttcttctgtgagtttagtttctatctcctcataactcatatcagcatatgaagctgtgccggctgttccaagcatagcggataatgctgccgtctgcaaaactttttcagatgttaatccgcttatgaaaagacttctatattcagcattttcctggatttttaaagctggaacagaatatttgaaatttgcaaatgatttaagctcatcaaacacttgttctttactttcgaagttattgagcattatcttatattcacttgcagttataccggcattctgaataagcacaccgaattcaaaagtgttttgtatgtcaaagccttcattttcacaatctgtgaacacatcgtcacgtattccgtattgtttctgtgcttccgctttctcatcatcgctcagttcagaatattttaccccgttatttattgtttcttctagatttatttcaggcataggagtttctgttgcttcaggtataactgttgtttcaggctcctctgattcttctgattcaggcaatgcaccttcttcctgttccacagacggcgtttcaacagtttcctgttccgatgctgttgattcatcatttttgtcttctgtttccgcgttattatctaacggttcttctttagtatcttcgtctttttcatcagcattttcttctattaaattattctctgtttcttcatttattacttgttcttctgatactgatgattcattgtttttttcaacatcagcaaacaccattggtattgatgtaaacagcattgatattattattaattccgatattattctttttagtctactcatttgttttctccctcctctgtattttctacgcttttggcggtcataagcgatttaacttttggctcctctccgattcctccatagatattctcaggcacgtttcggtatagtcccaaagatgaacgttcatttgtgccaaatgtgtatacgtttccatccacatctaccgctacagtatatcctcgtcctgctgccgctttttttattgccgggattcccaaaacttgtcccggaacacggttattacccagcgctctgccaagctgtccgtcattttggtatccccatgtccataacgttccgtcattttttattgccagtgcgtggttatatcctgctgctacttctcttacatttgtaagtccgcggattcttgtcggttttgacatattttgtttatgtccaagccccagctgtcctgcactgtttcttccccaggtatacacatttccggcctctgttactccaacacaaaaatccgggcctgccgatacttgcttaaatactccccagtcttcctcatcctgcggattttctaatctggtcggcgtatatactgtgtctgtatggccaagtcccaactgtccatattcatttgctccccatacataagtatctctttcatattccccatcctcagttgttgctaccgcaaaactatctcctgctgaaacagtctctatatctttctgcaaaattacaaccggttcactttcactaacactgctttctcctgttccaagctgacccaagtaatttctgcctattcctacaagctgcttttcaaatatagcattatatccttcaaatccaatacaatgtcttctaactactaaagtaaagtcatttcctgccgctattttgagcggttcgttctcaagataatctgacgcgttataattatctccctcttctgtataaccgcttaattctataactctgctgttttctattacgttcttcggcaagaactttccaagttggttgttagaattactcccccatccttcaacaacttccgctgaaatgataacattatgatttttacctcttgctatctcgtcagcactgctatatttatcactctttttcggatatccgtatacttcctctccgctcttgcctgttccaaaccagcctcttccccacacaaacaaatttctgtcactattaaccgccaatacctgatcctgattcgcatctactttttcaatattttttagtcctccgattctaacaggctccagtgcagtatttgtttccatatatttttggtcatatgtggaaattccccactgccataaattattgtcactgtccataccaatacataattcatcagcatcaaactcttttacaccggtgactgacataacttttttaggaagataatttttactccatcccatataaccgcactgatacaaatatccgccgttaaggaagcttgtcagattacctcctgcctttatactttctgtgccgactaaattatttgactgtacaggcgctatggcattttcaactgtcaattcaagtcccaactgtccataactgttacttccccagctatacacagttccattttcttttactgcaacagcatgatttgcacctgccgttacctttgtcacaccgtccataacatatgtgtatgtttttttcatactttctgttgaattgattcccagttgtcccgatgtgttctttccgcacgaatacaattttctctcactgtctattatataactctgataatctcctgcggctatggctgacgctccttcatacacttttgcaaaacgtctcttcgtacttgttgaattgttgccgagctggccataagtattatttccgctcacccaaaccgttgcgtctctctttaagataattgtatgcgcttcacctgcgtcaacatcaaccacgttttctgccagcaattcaggcgtcagaacattttccatacttccgtttcctagctggctgtttgcattctgtccccagccataaagattatatttgtccgttattacgtaactcatatttcccgatgcggctacgctcattaccgcctcgcccttttctgtccacggcgtattgactgccacaaaatcatcagactccgcagtgcttccgtttcctaactgaccataatcattgttgcccttagacatcaataccccgtctttatacacaagtatatgtctttgtcccactgctacgttatttctgtttgtatatattttttgattactgtatatgtatgttatttccagtcttccctgcattaccccatcatgcatactatcttttattgtatatatcctttctcctattatcgctgttcttcctgccggcaaatccatttccggcaatgtatccggcagcaccacccatatatctttatccggcatatatgcgtatctcaccttgctgccactgtctgagccataattaataaagattaaaaattcgcccagtttcatcagtttaccttcttgattcgaaacagaaccgtaactatagcttgggcgtatctgtcgctctgaccatacattattacttgtatcatatacgtatgtataattgccatctccactgtattttgcagtgcagtatattttgtttcctacagcaactcccgtatacgatccactattaggaaagtattcaccacgtgtccacgtttgatttactgtatcatatatatatgtatctcttgattttacactatgattaacatcatcatagccaccaaaacaatatatattatcacctatagacaccgcttcaccatcaacaaatccaaacggaatctcttgtcccacagaccaagtaccggtctcagtgtcaaatatatctactttatcagttacttcgtttccaataataccgccgactaaatatatctttcctccattttcaactgctgaatattctgatctcaatgaaggcataaccggcgcgcttgtccagctatttgctgcagtatcatatatttgagtagaatcccagccaaaacaatataccttgtttccacactccaccatgctcacattttctcccaccgctgtatcagaatatctactcctaatcaccattgggtcatctgagaaatattctgcaatctgatctgcataattctcttccgccgaaccaacaaatacaaaaccacagcatagcataactgctgcaagaattgacgctgtcactttttttaacataacttttcctccttattttttatttatttttatatattttatttgctatcgtgatatatacactaccacacagcacaaacatacactaaataccgtataggtaaaatttaccataacgcatttcacttgtcaacaagattttgcatattttttatttttttaggaaattaattacaagtaaattttagttatatacaataacaaaacaacatatcgtggcaattaaaacaacgatataatacaaaaaatcataagtgaatatctgttgatttagataaaaatttaattgaacagtttgaactaaaatttaaaggtgataatattatttctaaagctgaatttattcggagatcaataaaaaagtatttagatgataagtgaataaaaaagatggtaggcactttttgtgtctgccatctttctgtcaataccattaaaacccatcttttatattatttaattttctaatattattaacaatagaattactacgcaatcaaaacacctattaccatagcagcgatacccaaaatacttgcaattgtaataccaataattcatttttgacttgcatccattttttcaattaaatcatctttaagattgtcaataacatcattttgtttaaacatcatatcttcaattgccggttaagtttgcgcagttctattatttcctgctcttctgcagaccggttatctttttcgtgaaaaaagccgctagctgctgactgcttcagccatttatccagcaatgaagtggctatatcatatttacggcagatatcacattttcgttttccatcatggtatagctgaactaactgttgtttgaattcatccgtataggatcggggctttcttcttttggtcatcatagtttctccttttatattttctattttacatgaccttatttttttatccagttttttgtagcctatccaaacatcttatattattacgtttagcaggatttgaagatatagacttagacaaatattttagacttgtagtaaataaagatggtgctgattggacctttgtatgtccaagtaattatgaaaatatgtccaacaaattaaaacgtatccaaagattttacaaagacggattttctatcataccattagcgttaaacgaaatcggttatatggttggtattgatataccaagacgttatcgccgccatattgatatgatgtaatggtgtgtccgcctggatgcgttgaattactctgcaggacaagttaaaacaatgggttgttgcaatttttgcaacaaacaggcctcaccatccacataagcgcatggataaaaaagtatcacgaatgtaagaaaggtgaaaaatgccaatatacaaaatgaaggagtcgaaaaacggaaaacaaaaaaggaaatggacttttacacggcggatgaatataaactatacaccaaatctgcacttgaacacgctgaaacttgttcaaatttgaatggctggaatttttatgtgttcttctatcgcattttataccggacttaaaaaaggcaaaattcacgctttaaaattgactgatattgacggaaaatatctgaacgtaacacgcagcatatcgcaaaaactaagggtcgaaaacagagaaactgctcctaagaataaaagctcgattcgcacacttcaacttcctataccattaattaaaatcttagaagagcataaaaaacgctggtctgagtacaaaggattcaacgacaatttcaggatttgcgggagcacacgtccgctcagagataccagcttagcaaaaatgaacgaacagcttgccaaatcagcaggactaaaaaccataaggattcatgatttccggcacccttatgtcaagtccacgacaaaaaaatatggagatttttttcaacttctaaaagccagttaagaaccgcaattcctaactggctttatcaatataccctgagctgttatgccaggtcattttttatttttagcacgatctcaaccctcttgttagggtaaataaagattttttcaatcagcatatcaacaagttcagaagtcagtcctttgttttcaaccaaagactgtaatacatctttttgctggtgctgacgttctttttcctgttgttcagcctccagtcgtgtcattacaacagcctttgtattctctacttcaagcaatcgctgttcaataagtgctttctgttctttatagaggttaacatcaatttgctttattacaagcgcctcatacagtttacgcttttcttcctgcagctcaaagatctgattatcaaattcagctcgtctcactgcaaccttatcaacaggttttaattcattcggcccatcaatccccaaagatacttcaaactgtttacaaagaaattcatatactatggattccaattcgctttcccggatcgtcataccatagcaaggctgtgaagaatccatataggaaaacctgcagcgataaatagtctcattggaacggtgcatagcatgtttgcaggagccgcaaaatacctttcctcgaaggggataactatgctgttttcgttttggaattttaaaccgcttaatggaagcattagctttctcgaaaagttctttgctaaccaatggggtgtgatgatttggaatcttgatccattcgctttcatcttttgtccgcatacggtttccgccgatttctgttacagtcttttttcctatcacataagtgccgatataacgttcgtctgctaacagtctcaaaatggttgaattagaccatacaccatttgtccttgatacatcgtgatacttttggcctttgagagccttgtattcgcccggtgtaggaattgcctgactatgaagctctctggcaatctgcgcactgttcataccggacgcagcatattcaaaaatcatctgaataacgcaggaggtctctggatcagggaccattcggttattgtcacctttacaatatccatacgggcagatcttactttgatattcaccgcggcgcatcttcatatactttgcggttttggtcttaacagacatatcccggctgtaatattcactgataaggtatttgaaggcaacctccataccaccggtatcgcctttgagctttttcgtatcaaaatcatcactcacagaaataaaacgggtatgaaagatcgggaatacccgttctataaagtaacctgtctctagactgttgcgcccaaatcttgaaaaatcttcttgtgtcaagtagggactaaaaaaattttgagaatttacaagccgttcataggtggacaaccacccatgaacggcttgagttttctctacgctcttgtgccgttctttgtgcgacgcttcttatacgccgccgcaaatgcctccaacatcggagtgaccggaagctcgttgtcaggcttggacagatactcgaaccggatgccgttctcccggaactttcgctcaaacctcatgaaagaggaagtgtcccggctgattcgcgaggtgtcgcgggtgaggatcgtaccgatgtcctgacgcttggcttcgttcagcaggaagttcatgataccttccgtatggacggcggagatgccgtctgccgccacagcagcagccacctcatagcctttgtccttcgcatagcgttccagctcttcccactggtctgctgccgcaagctgatccgcacaggcaacgcggatataaagaaatactttcatttggcttctccttctgatgtagtgaggaagtccttgaacttccagacgatttctatgttgtcaagatcgtaaatgtagaccgcagaaatgaatgcgtgggtcagctcataggtcagagctttgcagtcggcgtactgttcgcagaccgcatccagcttttcatctgaacaggcggtctcggagtcaagctccttcatccgctcgtgaccgcgctggattgctccatcgttttcagcaatcttcacatccgctgccgccttctgctgaatgtacgcctccttcgtgatgcttccggctgcatacttctcgtagagcctcagcttggacgccttgttctgctcgttctgcttttgcagagtgcggattttatcagcacattccttgatggcagatttccgcagatcaccgacttcgcggttctgtattgcttccttctgtgccaaagcaagaaactgagtaagggcatggaagacaaccttctcaatatccatttccggaaagctcctgccaaccggacagtctgtgtttccgttgttgaccgagtgaatgcactggaagtaccgaatgccagccttgttctttcggcgtgtcatagcacgtttacagttaccgcagcggacgagtcccttgagcggatagtcatgctgcttgcgcgtgggattccgtcctccgcctcgaatgaccttctgagcaagctcaaagtcttccttgctgataatagcttcatgcgttccttctacgataatcggctcattgacaacacgcttttttgagccgacaccgcaggacttcattttgcggctgaccagtgttccggtgtaaacaaggtttttgaggatgttatagaccatcacggtttcccaactgattttctcgctcatgttactgaacttcttcttgtcgggatgcttgctcttgaagtattgccccggcgtcgggatgccgtcatcattcaggctgcgggcgatctgagaggtgttgctgccttccagcgcctcgcggaaaatacgacggatcacatcagccgcctccgggtctacggcaagtttgttccgaatggtgggatgcaggacgtagccgtatggggcgtagccaccgacatacttgccctgcttcatcatctggatttttgccgatgtggtctttacggaaaggtctttgctgtatgcggcgtagatgatgctgcgcataaccacttccaggccgcccgttgtgcctttgtaatcgtcactgtcatagccgtcgttgatggaaataaagcggacgcccatgaatggaaaagtgcattccagatagtttcccgtttcaatgtagtcacgagaaaagcgggaaaagtctttgacgcagatcagattgatttcgccgcgcttgaccttctccatcatctgcgtgaactgaggacggtgaaagttcgtgccggtataaccgtcatccgcaaactcagaccgctgacagtgagacaactccggatgattgtcgagaaagcgattgatgagcatacgctggttgccgatgctgtcactttccgccttgctgccataaccggtatcttcatcagccattgagaggcggatgtagatgccgatgttgtattccttgctcatttacatcgcctcctgcacttccttgatactctgaatggtcagagcgtaaatatcgccgtatttcatgaccagctcgattgagccgtcctcatggactttcacaagctctacggactcgtcaaccaactcctgagagagcttttctgcaccgctgacggatttcatcagcgtgagccacttgttgtcctcggacattgcctcggcaaactttaccttctgctgaaccgcttcatccaaccgccgtgaaagatcgacatactgctcatcgtaggctttcttggcaaaggcgtattcctcttcatcgagaacgccttccgtgaagtcctcatagagacgggtacgcttcttggaaataccgctgagtttcagattcaggcttgtaatgagcgcattctgctgatttcggatgctgcgttcaccttcgctgtttctcagtttggcaagcagcttgtcgtaattgagagccgccttgacttgaagctggatcgccgcaagcacatcggcttcgagtttgtcctgccgcgtatagtgtggcgtacagagattgccgcgcttgacggatgagctgcactcatagaaggcgtaccatgcgccgtccttacgcttgtcaacgcgctttcgatggaaatagagtttcctgccgcaatctgcacagatgattttgtcttcaaagagattgatcagtgtagcacggattttctccgtgcgctccatcttctcaatccttgtccttgcagcagcgtcgcgcagctcttgtaccttttggaagtcctcgcgggaaataatcgcctcgtgagtattgggaaaaacaatccattcctcgcggtcgatatgctgattcttgacgcccttatagatggcgttcagcgtccgtccgagaacggtatctccgacgtaatggggattatccagaatggtagtcagtgaagacttgttccaaatcttctttgccgtagcattgcctgtgcggacgccgacctgatacttctgaaactccggattgggcgcgttcattgcatcaagccggtctgcaatcgcaggaagggacagcccttcaatcttccattggaaaatcttccggacaatcggtgcggtttcctcatcgaagaccatattgctgtgttcttcatcccagcgataaccatacgggagattgcgcttcttgaactctccactttccatctgcgccttgagcgcagtagaaaccttgcgggagatgtccttcgagtagagggtgttgatcatgttttgcagagggatgatgaggctttcgccggagctgtccgtatcaaagttgtcgtagttttccttgatggcgataaaccgaagcccgatctgcggaaagacccgttccagataggttcctgcctcgatgtagtctcgcccgaaccggctgagatcacgaaccacaaggcacttgatcctgccggtgcggatgtcgttcatcagacggttgaactccggtctatcaaaaaccgtacccgttcgtccattgtccacataggtatctatcagattcaggtagggacgctctgcaatgtaggacttgcaaatctcaatctgatttgcgatgacatccaccttttcggacttgccgctgttttcaacggaaagacgggcatagatggctgttgcgaagacctcggaggaggcagattcgataaccggatcttcgactgcaatttgctttctgctttttcttgccacttgctcatccctcctttatacggcaatgtccagctcgtcggcataaccgagaacgtattcaagtgtctgctggtattcgtccttgtacttgaagacaatttcgattgcatggttttcgtgaatcaggatgcggtcaaccaacgacatcagcacacggcggttcagctcttcgacgttttcatactgcttaaaaagcgttacccagttccgttcagtcgtgccggttgtcaccgtctgcttcatttcttttttgacccgcagaagcgcgtcctgcttgttctcaatggttttggtgtagctgttgcggaactcgaagtattccgatttatcaatgacgccgccgatgaagttctcgtaaagccccagcttgagcttttggtaccgttcaatctcttcctcgattttggcgatctgagcttcgtaattgaaagccttacggctctgagatggaagccgttctatcatcgcaagcgcgtgttccagattgatgacaagctcaatctggtcatgaatggcacggaagaccttctcttcaacctcttttgcggcgatgctatgcgggctgcacgtccggctgtgcttattggtggagcagacgtagtagatatactttttcgtcttcgacgggacggtcttgcggatcattggctgctgacagtctccgcagaacaagaagccggaaaacaggtgtgcttcgttttgatcgggtgagcagcgcatatcccgctgcatcatgaccttgactgccatgaagtcctcgtaggacacaagagcttcatgcgcgttctcaaccttgacccactcggattcatccttgctcttcacgacgcggactttgtagttgggagtgccgcgcttgccttgagccagaacgccgatataaacctcgttggtgagaatacgctggacggctttgtacgtccattttgcggtatcgccggttttgaagacggtatcgaacttcacaccggcggaatgcttgtattccatcggggacaggacgcccatctggttcagacgctttgcaatgcgcccaatggagaacccgtccttgtacatggagaagatcatctgcacatattcgctgaccgcttcatccacgatgagctggtttttgttctccggcgatttcatgtagccgtaaggcgcgaacgagccgacgaactcaccacttttctgtttgacttccaaactgcttcggattttcatggagatgtccttgcagtaagaatcgttaatcaggtttttgaacgggataacaaaggagtcggactgcggatcaccggtcagactgtcatacgcatcattgattgcgatgaagcgaatgccaagctgcgggaaaatcttttcaatgtagcgcccgccgtcgatgtagtttcttgagaagcggctgagatccttgaccacgatgcagtcaagcgcacccttgcggattgcctcttccagctttttgaactgaggacgattgaaggaaacgccgctgtaaccgtcatccacaaacggctcacagacaagctccaaatcctcataccttgcgatatagtcctcgcagatggctctctggctggcgatggagttgctttctactttgtctccatcttcacgggacagacggcagtagatcgccgtgcggtaaaccttgtctggcataaaaataacctccgtttttctgtttggtgtggtacatcaaatcagaaagacgaaggcttgcttcaactcttatgaagaggaacacgaaaacgccacatgaccatcagggcaagcagcttaatccgtattcttcttttttgaccgatttcattataccacaggctcaatcgcttgtccatagaaccgggtgaaaagattcagactgttcataaatcagagacctctcagatagtgttccagacaatcttccattgtcgtgtccgtcgcggcgaagctgatcttcaccacagttttcccgtccagataacaatagggatttctgatctgcttgatgaactccctcagcctgtcctctcgcggtgccgcaggatcaagccggatgctgcttctctgaacgagtgtgcttcggtcaaccgttttcggactgacgcttttcattgtttcaatgcccatcatattctaagcacctcctgtttcgtgaaatattcaggacaaaaggatatggcagagcatcttgtgaagataccctgccacatagttttcatcctgaaactatatagtaagtttcttttgggtttgtttcattgtccggcatatttgcagctcgcgcccctgccagaagaactttgcagttccgggaatgctgcggactaccaatggtcaatcggtatcatgggactctcacccctccgaggatcgctccgagccgcccattcaaagaaaagacggaagtatcattatacccggcatctgcatcgtcgcaagcagccgcaccacacgactgttatagctctccggaggtcgctcactccctttcgggaggtcttggcgtcggaagctgtgttgcttcgcagaagcggaaagatccgcagcactgaactattcagttttcaaggagcagtgaagtggtctgattgaccctttcactttacaacggacatctttttgccgtttgttgagtaccgctcaaaaaattttttgaaattttttctgcaccgctgctttgaggtcaaatgcagctctgatgccaatgcctttcctccgggcaaactctcgaagagtcagtccttcacgggtcatcgcaagatacaattcgcgctgcttctcggtcagaatggaaagaagctccttctctttgagggcggtgatcagttcctccatgcagtcgcgggagtctgccagccatgcagcggacttcacatcgtcctccggcatagcgtcaagggacagcacggtatcagaaattttctctgcgccgtcctcatcctcagaggtgttgtcagagccatacgagcgtctgatccgcttttcctctgcgcgaaggattctcataaccttgcggtcaacctcggaaacttcgccggttcgtttcacgcgcaccatgcacttgtcgtcctccgtagtccataggtcgtaatcgaacgcgataggggtcttagggattttcattgttcatcctttccgctgcgcgggagcagcgggaagggtgaagacagaaaaagagccgcatgacggtgaggtttgaatcccatgccgataaaacagagcaattaaactctgtctcatgcggcattaggatgacttcacctatcaggcggctccacagctcagctatgacatatattttattttagaacagaggcttgtcctccggttcttacttggtacgcggtcgcagtcttctcatattcagcacatcaaagactgtgatccgcccgcatttcttgcacttggattctacatgacctctcgtgtcttcgtagacagcaatggcattatgctgacaatagggacatttcaggtatcggggcttctgctgggaaatggcaactcttgccctgcggattttttcgatcagctccggcgtcggttcctgaacccgaatggatgctctcttcattaccacacctccaatgggtcaacatactcactgaatggacgatctaccatgtagccgagctgacgaaggcggatagacgccgttgtcttggagacaccgaacaaccggcagaaaaggcgcagcgttaagtgatcaccatacgaatacctcccctcgtaattgatcagcggcgtttctgcaaaccgacgcattgccaggtcaacctctttttgaggaagcaggatcgccgcgcccaagacatttgcttgccactcgttccagtcctcgcgggttttcagctctcgcggcgtataggctgtccgtgcggaatatttcatttcgcaggaagcctttacctcttccgattccagttggaagagaatctgatgggcgcactcgtgggcaagggtaaatctgcgcttggcgcagagccgctgcacgttgccggatcgaatgaagctctcgtccaagatgacctgattacgcttcaaagccagtgtgcgcgtaataccaagttccgtgatcttgtactcagtgtcggcataggcagtgacaccgcagatgcttccgtccggcgagagacgggcgaatgatacgcgaagaccgagatagttctttgcaaactgatcaatgggtgttggcaaagctgatcggtcgggcttgtccgcctcatccccgaaaaagaaccggttgaagtccttcgttgttgaggctgcaatttcttcaagttggcgctgggataaaatcatgagcagttgtcctcctttgcttcgacgaaccacttgtctccttcgtggaaaagaaatgactcctttccgcgaatctgaactgtgtaacggatgcctccgcccccaacctttttggatgtggcgcggcatttgtatagaatctggtcgatttgaaagattacaccgttgtcccaccagataaggcgagggaggattgccccctccttgtccacatccagcgtaaccgggacgtatgcttttctgtactgtgtagccatttctgtttttctcactcctgttccctcataccggtgtatgccggtacggatgatcttcggcagcataaatgcctgtccatttgaactgctcaaaagatgtaactttttcgtgtacaactactcatgccccttgacaggatgagcaattcaggatatactatgagtagttggattgctcagtcattattatacgcacttcaagtgcctttgtcaatagacttgcgcaatttgatgtcgcaaactttttgtgaacaggagtgattaccaaaatgacgtttggagagaaattcaaggctgaacgggagaagcggaagctgacccagcaggaagtagccgatgcactggggatcaacaggcgtatgattacccggtacgagaacggcatttcctttccccgtaccaaggacgcttacagaaaaatcgcggaatacttcaaggtggatgtgaactatctgctgaccgaggacgaagagtttgtggttcaggcatccgagcagtacggctcccgtggcatgaaacaggcaaaggacctgattgaagggatgtccggcttgtttgcgggcggtacgctgtctgagcaggacaaggatgcggtgatgaaggcgttgcaggatatatattgggaatccaaagcccggaatgttgagaaatacacgccgaagaaatacaagaagaccggtacggacgcagaggaataactgtctgcgtctcggtttcttgacggatttactttgactgttttcaacatgaaaggggtgaaggtcccgtgataattcgctccgaggaaatatacaaaaaggcgaacagcattgtcaaaagctgtggaacaagagataccttgaagattgcccgtgagctgggcattcatctccattttcttgacaatctgaacgatctgctcggaatgtacacctaccgccataaagagcggcatattcttctgaactccaacatggagtatctgatcatgcaaatggtttgcggtcacgagatcgggcatgatacctttcaccgtgatcttgccaaaggaaacgaaccgctcccggagttcgtgctgttcgatatgcgcacaaaacacgaatatgaggcgaatgcgtttgcctcacacctgatcattgacgatgatgagctgattgacctgatgaagcaggactacgatgtggtgcagctctcggctgcaatgggaacaaacatcaacctgatgctgatcaagctcaacgaactgaaccgcatgggctggcagctcaacttgccttatgtaccgcactctgacttcctgaaaaatgtcagaccggaggggtgaatgaggatgaaggatagtaattagatgaacaacgacgactataaagaagcccttttctatgccgcttccatctttaacgaacgcttgggggcagagttcagtgaggacaaccttgtactgcgctgctttcagacggaaaaccagcaggaagtctttgagcagttctgcaagcagtatttccctgaccggctggaagaccgatatacagaggacggctattttgactttcacgcctctgcattcgtcggcacaggagacggcgcggacggaatccttctgcgcacagacatagcgcgtcatccggcagagttgaagcacattcttctgcatgagctggcgcatatcttctgcacccgcaacgagattgacggagataatttctttgagcgatactgcatggacgataccatcagccgcgaagaggacggaaccattaacgccggttatgcggtctggcgggaactgattgcggagctgattgcatttgagctggatgacaactgcgatgtagttccgcttcgacgcaagaaagacctactcagctattacgaaggagaactcctgaccggcaacggaaaaatgggcgtcagcatgattctctgtgaggcaatgaccagttctgagggcgaagcgtctatgacatgggacgctgccaaaagcaagtttacgcggttcaagccctttgatgatccgctgtacagggacttgctggaactggtttttacacacgttagagaatactttatcgtgatcgaccgcgactttatctatgaaattggagttttgtatctgagcattgccgcacaagcgatgattgcgtccctaaagaacagatttcaggaagaataggcagaccgaaagagagaaaggacgggcaacgatatgaaatataagctgtttcgctcccccggtaatctggacaaggcagtccggaagcacgaactggttgccgtggagaccggcaagaacattgatgatgtggcagaagcgcttatccgtgatgttcgggatgatcttgcggaaatgccggagtatgcgcactgtgaaaccgctgcgtatgcaccggaaccaattcaggagcatcgccgcgtaagacgttatcagtatgagatgatgggtgttgtttacccgcagtatgcggagaagaacatcctgattgattatggcgtgattgaagaggcggagtaatgtcaaagagatatgccagacaactacatagtgcagatggtttgattgccgccgtcgaacaatacggctttctgcccttctttcggaacgagattcacggcttctccatcgaggaactttgcccacctgagttatggtttgcggatgatgtagatggtccgtgggaatggaaaggaccggctgcgcggagcggcaaatgtctttacggcaaacttttcaacaagaaggctggatttgtgagtcgggagtggattccggactttgcgaacttccggcgtgacggctatgactttgacgcccgttgggatgacggcttggcgtcctacaaggacaaggagctttatgaagccatagccggtgaaggcaggatgctttccaaacggctgaaagaggctctgaactaccgcaagggcggcaacaccggttttgagacgtgcatcacgcggctgcaaatgcagagctatgtctgcatcgcggatttcgtctatatgcaggacagatacggaagaccttatggctggggtgtcgcagagtatgcgacgccggaagaacttttcgggtacgaccttatcacatctgcctatcagcgagacccgcaggaatccaaagaacgcattctaaaacatctgcaatcacgtctgcctaacgcgaccgaaatgcagcttgagaaaatcataaaggggtaacgcaatggacgatattatctttgagaaggattaccgggaaaccgagtctgccgaatacgataaatggtgcgatgaggtgtttgaccgcgcagttaattgtggtatgctgaaagcgtactccgaagcaatggacaagataccaaagatcattgtaccggaggacaagaagaactacgagtatcttctggaacgctgtgatgcgtttgtcaagcaacaccgcgggtatatcaagggaatcgtggactatcatcgttggcacgcggaaatcaatatgtttcttccgtttgcggagttcgatgactcagaagaccttgcatttttgaaagaaattgcagaaaaatcgcaaaccgtctgcttctccccggacgaagaaggtggcattcgcgttcatatttttatcaactactttgaagaattgatgtcagccgaacacaagtcatacatcgaatacgatgctattatgcaggacaagaaactatctgagttacttggcataccggagctttctgacgaggaaaaagaactcgccctgaaaatgaagggcatacttgaccgcattgatgatgaaacaaggattgaccgtaccacggcttttcgagccgtgcttgataagatgacaaaagagccggaagaaaactggtcgcttcattatatggcaacattgctggaagctctgctatacttcatgctgaatgaaggaaatgaaaagattgatgaggaagaacacaatgagtaagaaacttgtagcgtatttttctgcgtccggcgtgaccgcaaaggttgccgagacgctggcagaggcaatcggcgcggacatctttgagattgagccgaaagtgccttatacggaagccgatctgaactggatggacaagaaagcccgcagcacgattgagatgaacgatcctgtttcccgtccagagattgccataaagcgggacaacatgaaggactacgacacaatttttgtgggcttcccgatctggtggtacgttgcgccgacgattatcaatacgttccttgagagctatgatatgactggcaagacgatcatcccgtttgcaacctccggaggaagcgacattggcaagacgaacgaacgccttgcgccgagctgcaaaggcgcaaagctgatggacggcaaggttttcaagggctgcgtcgggcatcaggagcttgcggcgtgggttgaaggacttggactttaaggggcagacaaatcggaagttgtggaggtgctttatgaacgagagagaaaaaattatccgattatggtttgatatgtggattaagaaagcagatttaggaattgacaatatttttacagatgatgttgtatatactgagagttggagtcctaaatatgaaaaccgcaaaacggtaaagcactggtttgacgaatggaatacacgcggaagtgttcttgtctgggagattaagcaattttttcatcaaggcaatcaaacaatcgtggagtggtattttaaaaacaaaatgaataatggaaatgttgaagaatttgacggaatatctttaattgtatggacacaggataacaaaataaaatcattaaaagagtttggttgcaatcttcataattacaatccatatcgagatagtgatattcccgtatttcgagaagaaaaagcaaattggttttgagaggactataaattccagtttaacgaacaggagatgatgatcgcatgaaaatcctacatgaactttcttggctatgggaaacgctgggcattgcgcttgttgctgcggctgtctgcatggcttgcgctgcgctgattggcaaggcagcgaagaagaagctcgacaaaaaggtgttggcggtcgtaggggcagcggcatttgtgggcgcgattctggcggtcattctgatcgcccggacaccgatgccgctttgataggacggaggattgaatcatgccgcttcaaatcgtcagaaatgacatcacaaaaatgaaggtggacgccatcgtcaacgctgccaacgagtcgctgctgggtggcggcggtgtggacggctacattcatcgcgctgcaggaccagaactgctggcagaatgtgaaacgctccacggctgcaaaaccgggagcgcaaaaatcacgaagggctacaagctgccctgcaaatatgtcattcacgcagtcggtccgcgctggtatgacggtcggcacggtgagtgcgaactgctgatctcctgctatcggacatcgctcatgctggcgaaggaatacggatgcgaatcgattgcgttcccgctgatttcctccggcattttcggctatccaaaggatcaagccctcaaggttgcgattgacaccatcagcagtttccttcttgaaaacgaaatgacggtgtacatcgttattttcgaccgcaaagcctatcagatcagcggcaagctgtttgccgacattgcagcgtacatagacgaccgctatgtggatgagcataccgatcctcgttctgagcggctgcgcaggatgaacgccttccggatggaagaacccatgccttgcgaggcatccgtttgtgaagaggcaatcgaacagctcatgcctcccgtctttgcggcggctgcccccaaaaaggcggcaacccttgatgacgcgctgggacagattgacgagagtttttccgagatgcttctgcgaaagattgatgagcgcggcatgacggacgcgcagtgctataagaaggcgaatattgaccggaagctcttctcgaagatccgctcggacaagtcctataagccttctaagcccacggtcattgcatttgccatcgcccttgagctgccgcttgtggaaatgaaggatatgctcatgaaggctggctttgcgctctcccattccaataagtttgacatcatcgtggagtatttcgtggagcgcgggaactataacgtctttgagatcaacgaggctctgtttgcatttgaccagagtttaataggagcataaggtctatggataaagtatttcagaaatttttgcgaagtggtattgaactctctgtcgtaggagtggagtgtcgtgaagataacaacccttacttttgcacgcccaaaggtgcatctatttttggctgggctggcgtggatggcattcacttctgctttgttcgaggcttcggcagtatggtattttccgtcagccccacgaactcggctccggatttcgttcatccgctggcaaacaattttgcagactttctgaggctgctccttgcttgcggtgattcggcagcgttggaacaggcgtggatgtgggataaagcccaatttgaagcctttttgcgggacaaccctccaacgcatgaacagaaaaaagcgctatcagagcttgccgagaaaatgaaattgacgcctatggaacaaccgtgggcatacatcaaaaagctgcaagcatcctttgattatagcaagatcaagtacaccgaggactattatgatgttgatatgaacccggaagcagaaccgaccatacctgaatggaaggtctactttgatggagacttctggggacattcaggaaaagaccgttccggaacggaactccggttgaataagcaatttgactgggcaggacatcattgggttattcctgcggcgtattcttgcagcaagggactcgtcatggacttttgtatgcgcaccccagaggatgacatccgcaagttcatgacgaaatgggatttgcaccccgaaaacgactcctgcgaatacttcacgcaggagcagcaaatgcaaattgatttagacaatccgctttgccttgactttattcctcgtttggaattgaacgggaaaacaatgcgaatctcccacggctgctcggtggtttataatccgtgtttgccggatgggatgatcaatgaattggaagcaaagtgggcgttggaacactatgacttggatatatcctatggatggatgatttttcgggcagcttttccgtgggcaagcaaacgccgtactgaaataaaatctctctcctttacgatggagcagcggtcatgccgtgtcccaggaccacattttaagacacacgctcccggcgattcgttttctttcacccatccggtcagcggcacaaaatacacattaactgtacaggaattggagcggcagacaatttccgaaaagcgtttcggctctgaccgctggttttatccgacgcattttaccgccatgagctatacgctttctcctgaaccggacagcgatatttcgatctgtgattgtgctgagggggacaagcctttggaaattgcgccatgctctgaccgctatgcaccggaggcacgaaacgatatggcttgtatcggcattatcggcggcgcggacggtccaaccgcaatcgtatgtggaggcagctcgaaagaaaaactccatgcagcttgttccgctctacactttgagccggtggagggtgatattgaatggcgtatcgtattcaacatcaaaaactccaatgaaatgtcattagagctaatctgagaagaaatcggaggcgcagaagatgaagcagcgcatatacattgcaatcgacctgaaatccttctacgcctccgtggagtgccgggagcgcggcttagatcctctggacacaaaccttgttgtcgcagacgaaagtcggacggacaagaccatctgtcttgccgttacaccctccctcaaaagctacggtatctccggacgcggacggctgtttgaagtcaagcagcgcgtgaaggaatcgaatgtcggacggcagcacgacgcgccgggacacaggctggacggcacatcgcacttcttctcagagctgcaagcaaacccgtctctggcgattgacttcatcatcgcgccgccccggatggcgtactacatggagtacagcacccgcatctatcaggtttatctcaagtacattgcgccggaggacatcgtagtctactccatcgacgaggtgttcatggacgtgacggactacctgaacacctacaagctctcagcacatgatctcgccatgaagatcatcctcgatgtgcttgaaacaaccggcatcacagcaaccgcaggaatcggcacgaatcttttcctctgcaaagtggcaatggacattgtggcgaagcacatccccgccgacaagaacggcgtccgcattgcagagctggatgagatgaagttccggcgtgagctttggacgcatcagcccctcacggacttctggcgcgtaggtcgaggcattgccaagaaacttgagcaaaacgggatgtttacgatgggcgatgttgcactttgttcagagcgaaacgaggacttgctttacaagctgttcggcaagaatgcagaattgctcatcgaccatgcgtggggttgggaacctacgaccattgaagcgatcaaggcgtaccgtcccagctccaacagcatcagctccggtcaggtattgcactgcccatacgagacggataaagcaaagctggttgtccgagagatgacggatttgcttgtgctggacttggtggacaaggggcttgtcaccgaccaaatggttctcacagtcggctacgacattgagaacctgaccgatccggcacgacgggcaaagtatcacggcgcggttgagacagatcattatgggaggcagattccgaaacaggcgcacggctctatcaatctcgacggtcacacatcatctactcgcaaaataatgtgtgctgtgtcagaactcttcgaccggatcgtggataagaatctgcttgtccgccgtatgtatgttgttgcaaatcatgtcctgccggaagctgatgtaccgaagaaaaacgacggtgcagtccagctcgacctctttaccgactatgccgccgaagaggaaaaacagaaagccgaagatgccgctttggagcgtgagcggaagatacaagccgccacgcttgccatcaagaagaagtatggaaagaacgccatcctcaaggcaatgaatcttgaagaaggtgcaaccgcgaaagaccgcaatgcgcagattggagggcataaggcgtgaacggaaaatacgacgagatcatgggacttcctcaccacgtttccaaaacgcgaccacaaatgccgatgtcagatcgtgcagcgcagtttgcgccctttgccgccctcaccggctatgattctgcaatcaaggaaaccggacgtctgaccgacgaaaggattgagcttgatgagggagccttgaccgctttgaacatgaggtatcagcttctcatggatgcccttgatgaagagccggaggttgaaataacctacttcaaacctgatgagcgcaaagctggcggtgcgtatgtaactgcaaccggcgcagtcataaaggttgatgactttgagcgcctgattaccatgcaggacggcacgaagattccgatggatgacatcctaagcattgacggagagctgttcttgtccttagaataatgtcgcttgccatgcgaccaaatgaagtgaataccgaagtacaatatgactgtaaggtgagacaccaagcagtcatatttttatatacggaggtacaaaacatgagaaagaacttgacggagatcgtattcatccttgatcgcagcggctctatgagcggactggaaatagacaccatcggaggattcaactccatgattgaaaagcagaaaaaagagaatggcgaggcattgatctctaccgttctctttgacaacgtgagcgaggttatccatgaccgtgtgccggttcagaaggtggagccgatgaccgacagggactattccgttcgcggctgcaccgcgcttctggatgctatcggcggagcgattcatcacattgggaatgtccataagtacgcaagaaaagaggatgtccctgaacacacactgttcgtcatcacaacggatggcatggagaatgcaagccgccgttatgacagcgagaaggtcaagaagatgattgagcgacagaaggaaaagtacggctgggagtttcttttcctcggtgcaaacattgatgcagttgagacggcaaagcattttggaattggagcagatcgagcggtcaattaccactctgaccgcgagggaacgcaactcaactatgaagttctgagcaaagcggtttccgctgtccgatgcagcgtaccgctgggtacgaattggaaaaaacgtattgatgaggacttcaattccagaaaggacgggagaaagtaatgagaacaatcaccgtaaaagggacaggcaatgtctccacaagaccggattacatcatcctatccctgaacattgaagtcttatctgaaacctatgaccgcgcaatgtcggaagctgccgagagaatcgaaagactgcaaggtgccgcagtccgcgttgggtatcgcaaggaagacctgaaaaccacgagctttgatgtccagacaaggtacgagaatgtcaaggatcggcaaggaaattacaagcgagagtttgccggatatgcttgcagctatcgcttgaaacttgcctttgactttgacagcaagcagcttgcaaaggtcatttctgcgattgcggattgtggggcgcaaccagaactcagcattgcgttcaccgtgaaaaacccggcaagagtctgcgaagagctgctgatcaatgcgacggagaacgccagggcaaaggcggagattctttgcaaagcatcaggcagtacgcttgggcagttgctcaacatcgactacaactggggcgaactcaatgttttttccagaacaagctacgatgttgaagactgcattcagcctctcatggcgatgagcaagtgcgccgcacctgagattgagccggttgatattgatgtgacagacacattggctttcacatgggaaatccaatgattttttaacttttttgaaatccggtactcaacaaacgccctttttgtgtccgttgtaaagtgaagggacatttcacggaggaatcttcggggaatacgattttgggagattagcaagcaaatccggtgagtacccaccggagaaaaatcagttaaggagaccctgcccttaacatcagatttttgcttgttgggatagtcccaaacccttctaatctttacgacggagggcacagcatggtacgaagaacacgagacattcagaagaagatttggctgacaccacaggaagaacggacgattgcaaagaagatggagatgatcggaacggagaacttcggtgcgtatgcaaggaagatgctgattgacggctacatcattgtcgtagactacacagagcagaaaaagctcgccgccgaaatcaacaagatcggcgtgaacatcaataccgtctgccgcaggatcaactcgacgggacgattctatcaggacgatattgacgagctgaaagaaaagatggacgcggtatggcagttactaaaatcaaagcaatccgaggaactttgagcaaggcaatcgcgtacattctgaatcccgaaaagactgacgagaagctgctggtctcgtcctacggctgtgccagcgagaccgcagcgcgggaatttgaatggacgcggaaaatagccgagcaaaaagggatgaatccggtcaggatcatagcccgtcatgtgatccagtcctttgaaattggagaggtcacaccggagcttgcccacgagatcggcaagcagtttgcagacgaaatcctcggaggaaaatatgagtatgtgctgaccactcacattgacaaagaccatgttcataaccatctgattttcaatgcggttgactttgtggactaccacgcatacaagagctacaagcggatttactatgatatgcgcgaggtcagcgaccggctctgtaaggaaaacggtctctctgttatccctccctctcagaacaaaggcatgggctacaaggagtacaccgaagccaaacgcggcacgagctggaagcagaaactcaagcagaccatcgaccggcttgtcattacagcgaaggattacgatgattttctgcggctcatgcaggaagctggttatgaaatcaagaccggcaaatatatctcctttcgcgctgaaggacaggagcggtttacccggtctaaaaccatcggagagaactacaccgaggaacgcatcaaggagcggattgccggacggacgccgcgcagaaaccggaggcagaccgtgccgaagggcatctctctcatcggagatattcaggagcggatcagacttatcgacagcaagggctatgagtataaagccaagctcacgatcctcaaggaagcggcacggacgctcaactatctcacggaaaacaacttgctccaatacgccgatcttgagaagaaggtcgaggatgttcacagctcctatgatcgtaccggcaaggaactgaaagtcgttgaagcacgtctgcgggaagtccagccgcttattaaaaacatctccaactaccagcgcctaaaacccgtatatgacgccttccagaaggcgaaagacaagccgagcttcaaggcaaagcatgaagccgaacttgtgatctttgaggcggcgcggagtacgctgcttgccatgcagggcgatgaaaaactgccgagcttgaagacactgcaagcggaacagcagcgacttcttgacgagcagcagcgactctatgatgaacgtgcgaagctcaaaaaagaagtaaagcaaatagagacaatcaagtctaatgttgatacgtttctcgctccttctgctgaccatgaccgtgatcatctgcgcggcacacagcgcgaataatctcttcaaaagcagggcatcttctgttgaccggagatgccctgcatccttgagagaaggttcgagaagttgaaactatttctttaatttctgcatcaacggattgcttttgagaatgaaatccggtataatattagaaacgatgttgaatgcaagcaagcgaaaggatggttgccgtgcgcataagctataagaaactatggatgcttcttctggaacgcgacataaagagggcttctctacgacatgaagtagggttgtctgccggaacatggacaaaactgaataagggggaagaagtgtccctctctattttgctgcgcatttgtgattacttgaactgtgacatcggagatatatgtgaggctgtgcgaacggacaagaactaagtccggtttttcgtacagctctttttgtaggatagtaagtgtgaaactataactttggaggttgctgaaatggctgagaataacacaagcaatatcggctttgaaaaacaaatctgggacgcggcttgcgtcctgcgcggaaacatcgacgcatccgaatacaagtccgtcgttctcggattgattttcttgaaatacatttctgatcgcttcgaggcaaagtacaaggaactggttgaagaaggcgatggatttgaagaggatcaggacgaatacactgccgaaaacatcttctttgtccctgagaatgcacgatggagtgcgattgctgctgccgctcacacgccagaaattggcacggtgattgatgacgcaatgcgcagtatcgagaaagaaaacaagcgcctcaaagatattcttcctaagaacttcgcccgtccagagctggacaagcggcgtcttggtgaagtggttgatctcttcaccaacattcagatgatcgagcatggaaacagtaaggacattcttggtcggacatacgaatactgtctctccaagtttgccgagcaagaaggcaaacttgctggtgagttctatactccctcttgcgttgtacgtacccttgttgaagtgttgcaaccgtttaatggacgtgtttatgacccgtgctgcggctctggcggtatgttcgttcagtccgcaaagttcatcgaaaatcatggcggcaacatcaacaagatttccgtctttggtcaagactccaacccgaccacatggaagatggcgcagatgaatcttgccattcgcggtatagaagccgacctcggcaagtttaatgcggacacgttctttaacgattgccaccctcaactcaaggcagacttcattatggcgaatcctcccttcaatctctccggctggggtgcggataaactcgttgatgatgtccgttggcagtatggtacgcctcccgctggaaatgcaaacttcgcgtggttgcagcacatgatctggcatctcgctccgaatggtcgtatcggcatggtgcttgcaaatggttcgctttcttcgcagtccggcggtgaaggtgaaatccgcaagaacattatcaatgctgaccttgtggactgtatcgttgcaatgccgacgcagctattctacacgacgcagatcccggtatcgctctggttccttgcaaagaacaagaagcagaaaggcaagacactattcatcgacgcacggaaactcggcactatggttacgcggaagctgcgcgaactgacggatgtagacatcaagaaaattgccgacacctacaacgcctttgtagaaggaacgcttgaagatgaaaaaggcttctgcgcggttgttactacgcaggacatcgcaaagcaagattacattctcacgccgggacgctatgttggcattgaggaacaggaagatgacggtgagccgtttgaagagaaaatgggacgcctgacttctgaactgtctgagcttttcactaagtctcatgaaattgaagctcagatcaaagaacgactgggggcgattggatatgacatctgagtggcatgaggtaccgttacgagagctggttgggtatatttccaaaggaattgctccttcgtatgcagaagaagcatccgagacaaccattagagttctcaatcaaaagtgcaatcggaatttccgaataagctatggagattcaaggttgcatgataccctgaaaaagaaagtccctcctgaacgatatgtcaaacctgatgatattctgatcaattcgacaggtgcgggaactgctgggagaattgcgcaaattgaagatgttccgtccgcaactacaatagacggacacatgatccttatccgttcaaacggaaaggtaacgcagaagttccttggttacgctcttaaagcgcaccaatgggaagtcttgcagttggatgaaggctctacgggacaaactgaactaaaccgtgaccgcctgttagatgaaattatgatcaactaccccgtgtcatttgatgagcagaacgccatcgtaggtacgcttgaatctattgataggaagttgattgtaaacaaagagataaacgataatttagctgatctcctgcaaacgatatatcaagggcggttcggcaatgacattttggcagtaaatcagggagtcctctcggatatttgctcatattcaacagacaaagtagctgtctctgagttgaacgtcagaacctacttctcaacggaaaatatgctgtcgggaaaagctggttcaaccgaggcgacaagcctaccaactacatcacagacaaccgcttgccataaaggtgatacgttgatttccaacattcgtccttactttaagaagattgtctactgtgaggacaaatgtggctgctcaaccgatgttctttgctttacgccaagccagccgtgttactcggcgtacctattcagcactctatatgccgacaagttcttcgcatttatggttgctggatcgaaaggaacgaaaatgccccgtggagataagcagcagattatgacataccctgttgttctaccatcggaagaagagttagctgggtttaataccattgcttcaccacttcttgagcagatttattctaatagagcggaaaataaacggctgtccatactaagagatacccttcttccaaagttgatgtccggagagatcaatgtctctgccatccagctctaagccgctaaattatcgtttaccgcctgaatagctctcaccagtggcgagagttttacaaaagggactgccactgaatgtcgttctcttacctcgaaaggagacacgacaatgacagaacaactcatcacggagatacagcaaaaaatgcttccgtatctcaacaacgaacagctcatgcaccttcgggatgcaatgactgcgacattagttggggcaacgatcacctatgatagtggctcaatcccagcagaagaaacagatgcagtcgaagcatttatcacggcaaagcggatcgaaggctgttcggagaaaaccctgagctactaccggaagacgattgaggctctgatttccagagttggaaaggctgtgcaacagatcaccacagatgatttgcgccgctatttgaccaactatcaggttcagcgcaggtcgagcaaagtaaccatagacaacattcgtcggattctgtccagcttcttctcttggcttgaggatgaggactttatcttgaaaagcccggtacgccggattcacaaagtcaagactgcaaaggtggtcaaggacacctacaccgatgaagcgttagagctgatgcgtgacaactgcacaacagcacgggacttggcgatgattgatcttctggcatcctccggaatgcgtgttggtgagcttgtcacgctaaaccgcgaagacatcaacttcaacgaacgcgaatgcgttgttatcggcaagggtaataaagagcgattggtctacttcgatgcaaggacgaagatacaccttcaaaactatcttgagggcagaaccgatgaaaacccggctttgtttgtttcactgaaagcgccctttgaccgattgatgattggcggagtggagacacgccttcgggagctgggaaagcgtctgaatatcccgaaggttcaccctcacaagttcaggcgtacactggctacaactgccatagacaaaggaatgcccatagagcaagtccagcagctcttagggcatcagaaaatcgacaccaccatgcactatgcaatggtgaaacaacagaatgtgaagctggcacatagaaaatacattggataggatgggatgaaaatgaggatgacgcaacttaaaaccatcgcagacatacagactggtccgttcggaagccaactccacaaagaagactacgttgaaaccggaacccctattgtcactgttgaacatcttgggaaccgagtattcaccgagcaaaatctccccagagtttccgacagcgataaagcgcggttgattaagtatactctttcaactggcgatattgtattcagccgagttgggtctgttgaccgctgttcctatgttgataaatcacacgacggatggatgttctcgggacgttgcttacgagtccgcccaactgaactggttgattctctgtacctatattattatttctgtttagaagaaaccaagcagtttgttcggaatattgcagtaggcgcgaccatgccttctatcaatacgaaacttcttggagaggtcgaaatcgccttaccggatctgaacaaccagaaacggatagccgctgttctctcatcactggatgataaaattgagaacaaccaaaagctaaacgataatttagctgcttagaggtggacggcagagacatcgatctcgccagacataagcttcggcagcaaactatctctcaatttcgcaagcgattgattctgctcttccaaagtacgttgctgtgcaaagataggtgcgcaaaagtcgctgaatttggcaagaatttcagcgtcaggaataaccgccgggacatttttcatagtgctgccagatacttctttgaatgttgacccggatgccatgccttcaataaccgggagagtgtttttcaagaagaagtaaacaaatggtgttccaatttccggcttaggcacaaccgatttgaaaccttgatttgttgttacttcaccagcggcgatagcaatataacctattggcgcacgagatgagaacaacactgttccttctggcatgattgctgcgctgctgttcttcaaaccgagttcagttatgtcattctcgccatgagaaatgaacttcgacttgttgatagataaatctttcggggttatccatgctataccggactccgtgtaatactcaggtttagcttttgaaggtgtactgcctccaacaacagtaccaagatcgctaattgttccggtagtccattctggactggcattatcaacaaataattcttgaaaataggactgtgcttgctgctctaaattatcgtttacctgatatggaggatataccatgtttgataaagttcaggagagcttgaaaagaagcaaagacgagcgccagaaaaagcggcttgaaaaggaacggcttcgtcttgagaaagccgcagcagaagcagctcgtgaggaagagcggcttcaacaggaggctcaaaagatacagactgaaaaagaacgccttctctcccttgatgacaaggggctgatggttgagctaattttggcaatgcgtggcttatacgcgcagatcgaggatattcaatttcagcagataacattaacttcgagaatcgaagatattgagtcggacatctcttccatacgcagtgatatttcagatttggaaagcagactgggctcgtccgatcagtaagactcaatgaaggaggcgcagacgtgattatttcaccacaatctcttgatacaaacctaagtcagcttttagcggaagttaagtccggctcaatgcagttgccggagtttcagcgcgactggacttgggatgatagccgaattagaggcattatcgccagcttatcacagggttatcctatgggtgccatcatgcggctgcaatacggcaatccggacatccaattcaaataccgtacaattacgggcgtaaaaggcgtttctgtgaagccggagcatttgattctcgatggtcagcagcggcttacttcaatttatcaggcaacatcctctaaagagccggtctcgaccaaaacagaaaaaggcaaggctattaagcgttattactatctctcaatggagaagtgcctcgacgatgatgaggatcgttttgatgctgtcctctccatccccgaagaccgtaagattaaagagaactttgaccgggatgtgaagctcgatctctccaccagagaatatgaatacgagaacaagctgtttccggtcaatatcgtattcgacagcaacgcagttatggactggttcatgggctacatgacgcactacggaatgaagccggaagcaatggacgagttcaagcgtttccaagcggatgtgctgaatacaatttccgggtataagctgcctgtgattacactggacaagtccacgccgcgagaggcagtgtgcaaggtgtttgagaacgtcaatactggcggtgttcctctcacggtgtttgagcttgttaccgcaacttatgccacaagagactttgacctgagaaaagactgggtgcagtgtcgaaatacaatttgcggtttcggtgacacgctgagaacagacttgttcgatgggattgatgagactaccttcctgacaacggtttgtctctatacaagctatttgaacaagcagtctggaaagacaaacacaatctcctgcaaaaagaaagatgttctgggacttccttatgaatcgtacatagcgaaccgggatgcagtgctgtctgggttcaaaatcgcaaaggagtttcttcttcgtgatcagtgcgttttccgtcaaagagatttgccctatacaacgcagttgattccacttgcggcaatctgcgctgttctcggaaaatccaaatgcaatgagccaaacacaatcaaaactctttctcggtggtattggtgcgggattttgggtgagatgtatggcggtgcgaacgaaacccgctatgcctatgacattgaggacatggttgaagaggtcaatggacgtccgaatgcaatgcacacgattaacagcgcagtcttttcttctacgcggctgctaacccttcaaactcgcttgagcgcggcatataaaggtataatggctcttctttacaaggagaagtgtcgtgactttatgaacaacacgacgattgacattgtaaacagtatgcttgagtctccggatattcaccatatattccccgaagcatattgcgagaaaatgggcatcaagcgcgaacggtataattccatcattaacaagaccccgattcttccagccaccaaccgctcgattggcggaaatgcgccgagtgagtatctgggggcaattctaaagaaggttgatggactgaccgagaatgagttgcaagcacgggtggaatcgcactttatcaactatgcagaattgaaggcagatgacttcaatggctatttcatcgacagagcaaaaagccttctaaacctaattgaaaaagcgatgaataagcccgtcactgacagagatgcagaaaacacgctggatcagttcggggcgagtctggcgtaaaagggagtgacaaactatggcaggatattttacagaatcaaattacgagaacgctgtcttgcagcttctcaatgaagaactgggctataactatatctatggaccggacgtggagcgcgattatcactcgccgctttatgaggatgttctgctaccttccttgcagcggatcaacaagagcctgcctatggacgctctgacggaggcaatctataagctcaagaactttgaaaccggaacgcttttgcagaagaacatggtctttatggactacctccaaaacggagtcccggtaaaatactatgacaagggtgaagaacgctctacccttgtttaccttgtagacttcaaaaatcctgccagtaacgagttcacagttgcgaatcaatggactttcattgagaactccgaaaaaagaccagatgtgattctctttgtcaatggtctcccactcgtcattgtggagttgaagtctccgtcccgcgaagaaaccgatgcttccgcagcataccgccagctccggaactatatgtatgagatcccctctatgttcatttataatgcggtatgtgtcatgagtgacttgaccacttcaaaggctggtacaatcacgtccggcgaagaccgctttatggagtggaaaacaacagacggcagctatgagaatacgcaacacgcatcatttgacacattctttgtaggactgtttgagaagacccgcttccttgacatcgtgaaaaacttcatctgctttaatgtggatggacagaatactttcaagatactcgccgggtatcatcagtatttcgcagtcaaaaaggcgattgagtctacaaaacacgcaaccgtgacggacggtaagggtggcgtcttctggcatacacagggcagcggaaaatcgttgtctatggtcttctatgctcattatctgcaagaagcgttagaaagccccactatcgttgtcattaccgaccgtaacgatctggacgaccagctttacggacaattcgcccgctgcaaggacttcctccggcaaacgccgcagcacgctgagagccgcaagaatctgaaagaactgcttgcaaacagacaggcaaacggcataatcttcacgaccatgcagaagtttgaagaaagcaacgaagctctttcggagcgtcggaacattatcgtgatggctgatgaagcgcatcgtgggcaatatggtctcaatgagaaggttgtggtcaagcagaaggacaacggcgaagtcgaggcgaaaaccgttatcggcactgcccgcattataagagacacgcttcctaatgcgacctacattggattcaccggaacaccgatctccacaaaagaccgcagtacacgagaggtcttcggtgattacatcgacatctatgatatgacacaggcagttgaagatggcgcgaccagacccgtctactacgagagccgtgtgattcacctgaaactcgacgagaacaccctccatctgatcgataatgagtatgacattatggctgacaacgccgatccgtatgtcattgaaaagagcaaaaaggaacttggtcagatggaagcagtcctcggtgccgaccagacgatcaattccttggtaaatgacattcttgatcattacgagaattaccgtgagaatatcctaaccggcaaggcgatgatcgttgcttattcgcgtcccatagcaatgaagatttataagcgcattcttgagctacgcccagcgtggacggaaaagattgcagtggtcatgacgcaaggcaataacgatcccgaagaatggcgtgagattatcggcaacaaagctcataaggacgatatggcgcggaaattcaaagacaacaactctccgctgaaaatcgccatcgtcgtggatatgtggctgaccggctttgatgttccctcccttgctacgatgtatgtctataagccgatggctggacacaacctgatgcaagctatcgcccgcgtcaatcgtgtcttcaaagataaagaaggcggtttggttgtcgattacgtcggtattgcggctgcactgaaacaggcaatgaacgactatactgccagagacaagaagaactatggtgatacagatgtaagcaaggctgcatatccgaagttccttgaaaagctctctatttgcagagatttgttccacggattcagttatgagaaattcatgaccggaagcgacctcgacagggcgaagctcatcagcggcggagtgaacttcatactcggcaagagtgttgcagagtacgagcttcccgaccatgagaagacacagaatgtgtttatcaaagaagccctgcttctcaagcaggcactttcgctgtgcagcagcttggtagacgagcaaactcgcatggaggcagctttcttcgagtccgtaagaacaatgaccgtgcgcttggtttcaggcggtaccggaaagaagtttacgcttccggaagtaaatgagcgcattaacgagcttttgaagcacagcatcaagagcgaaggtgttatcaacctcttctccgatgtccagactgagttttcgttgttcgatccgaagtttcttgaagaagtggcaaacatgaaggagaagaatcttgcagtcgaactcttgaaaaaactgatttccgaacaggtctctgtttaccgtcgaacaaatattgtcaagtctgaaaagttctccgaaatcattcagagcgcaatgaaccgctatttgaacggaatgctgaccaacgaggaagtcattcaagaattactcaagctggcgaaagacattgccgctgctgccgccgagggtgaaaaactcggattgacagcggacgagcttgctttctatgatgccctcacaaagccgcaagcaatcaaggacttttacgagcatgacgagcttattgctatcacgaaagaactgacagatttgcttcgcaaaaaccagacaatagactggcaaaagaaagagagcgcaagagctggaatgcgccgcctggtcaaaaggttgctgaaaaaacacaaatatccgccagagggtatggatgatgctgtccagactgtcatgagccagtgtgagatgtggacggacaatgtaatgaccgcttaactcccctacgagaaaggagtagatcatgggcaattcagtcatgttgaatggaatcgaatatgccggagaacagattgcctacaaagacagcacctatgagcttgtgtcaaaggtcgcttacctgatcggcgtcccgcttcgtattttccaaaatgaacacgagccgccgaagatagagatatacaaccggcttgaacaggataaaaatgcccgtatcattcgtaatctatgtatcatccgcaccgccattgagcgcaactaccggaaaataaatgacatcatgcgaatggagtatcgagggctgctttcaatgccagagatcatcccggcttccagtatgcagcagctttcaaatgacggaatcagctttataaaaaagtcgagtacaaagctctgccaccacattatcgagatcaaccggctgatttcagaccgcattaacaactgcaagagcctctttccaatctggattaactgggcgtacataaaagagctgttcatcatgccaaacggtttgacagaggacggaacgaaagatgctgccgatatttattacgcaagtctctcctactacccctatcaaatgtatatcaactgggtaccgatggacgagggtaatgtcctctataatgataagaagtttgctaccctgctttatcaatggcattgcgacgccttcacggaatacagtaaagtctctgatgcaggggcttttgtaaaaaacaatatctacgacttcatagatgacagcgagaaaaccgtatttgtggtggactgcgaaaactccgacccgtacaaactgtgtgccacgctcaaaaatcttgattatgaggtcatgcaaaagattacggcgatcattctctttgatgacgtacacaccgctacggcatggcggattcttgaaaactacacccgcattcccgttgagcatatcatgattgagcggatcaagcagaacaaatcactggtagacatcaagctcaccgcaagagcctgtcaggaacactaccagaagcaagtggattccttcgtcatcgtctcaagcgattccgactactgggggctgatctcttccttaccggatgccagattccttgtcatgattgagcgggaaaaatgcggaccggatatgaaggcggcacttgcagaatccgggatattctactgctatctggatgacttctactccggcaacagcgaggacatcaagaaaaacgcactgtttaaggagatgtaccgctggattgacaactccgttcacctgaacgtcaacgatatgtttgatgccgcgctgaggaacactcgaattgaaatgtctccggcagaacggcggcagttctatgagaagcacatcaagcacatgacgctgaccatcgacgagaacggaaacgtcagcattgaactgaaacgcggatagccttggtttctattccgggaggaatgtggatggacaacagattctattttggattcaatacatcggaggaacggaaaaagcgcagaaaagcagagctgtactccatgagtgagcaagtcagcaccttcttttgggatgaagccccgcagcatggattggaaatgcgtgaagggcagcaggatatgtcatttgagattgtggacgccctcataaacgaccagcactttgcgattgaagctggcgtgggcattggcaagtcctttggctatcttgtgccggtgctgctgtacagcaaacgcatgaacaagccggtcatcatcgcaacctcgaccattgcgcttcaagaacagctctggcgcgatgtccacgcggtaatgccccttcttgggctgaacagagatgtcatcctcgcaaaaggacagacccattatctctgcaacaaacgcgcagatgagtatatgtgtgacccgaaagcagacccaccggacgcgctcaaagaaggaatccagcaggggtatgaggaacgcaaggatttcccggaggttttgccgcaaggcgtctgggacaaggtaaacgtgcagcggttcagcatgaagaattgcggctcctgcgaaaagaaatgcaagtattacaaggtccgtgcatcgttaaaatacacggacggtgttgttctgtgcaatcaggactttcttacccagcatctcatgaaactacgacgcgggcaggacggactgattaacgccgccgctgatctgcttgtcgtggatgaagcgcacaacttggatgataaggtgcggagtgccacaacggagcgtttcgggcaaggtatgctctttggaatgattaaaagcgcattctatgaactgcgaccctctgaccaaagcagtgtgtccggtgaaaagcgagaggcagagagcgcaatcatcgccttctataactgcctgaaagcacaagttcaaaagcagatcgacgatgcagatcaggatatgcgctacgctgaccgctttttctttgaccaaagcggcagtgcgattgaactgcttaccgagatgaacgccgccatacacaacctttcgtccagcattcagatttattccagcatggatttcagaaacaaccgttcctttgctgcctctgatgatctggatgccgtcagcgagtccctttcagagcttcttgaccggatagatgatatgctgatctggattgagcagcacggcagcaacacggaactcgtctattgccctaaaaacacaaaagaaattgtgagccgcctatacttcaatggtgatgaaagaaccatcttgacctctgccacgctgacgaacgccacgagcgggtctctggaagaacagtattcttactttatcagcaataccggctttcccgctggtgatcgcggctgcttatccgagccaaagccttccccatatccatacgatgaacacgccatgatctactattgcgacgatctcccgcacccgaccagagaacatgaagccttcattgaaaagggtgtggagcggctgcttgagatcctgagcatttccaatggaaaggcactcgtgctgtttacggcaaagaccgacatggaagaggtctactccattctcagtgagaaaaatcttccgtacaaaatcctgatgcagcagccgggatcgtcgcaggacaaggtgctgcttgagtttaaggaagatacgaactccgtacttctggggacgggtgcatattgggaaggaatcagcattgaaggaaaaagcctttccaatgtcatcattttccggcttccgttccctgtccccgatccaattatcgagtataagtgttccgtcgcaaaggatgccctgatggatgtccgcgttcccgaaatgattatcaagctcaagcaaggtatcgggcgattgatccgcaatttcacagacaccggcattgtctgcattatcgaccgaagactgcgggacgagccgccggaacgctatcatgacattacatgggactccctgcctatcaaaaatcggacaagcagtttggacgaacttaggaagttttacgaaggtctgccctcagccaaggaatgatgatacaaacggcagtctcttcggaaacatagagcagccccccaaaaaacgacaatcagaaaacggaggtgtatcatgttgtacaatgaaaatctgcacgaagaagaacaacatctgatccagcagattgccgagcaaacagagagaggtaaaatcggctgggaactgacggagtataatccgctgtcatttctgaatgaggacaagatagacaaaaacccagcagtaatctgtcagtccttctcctttgaagcgatcatcggcggctcccgtttcgagcttgatgtcatggagaatattgatgtgccgtccggtatgggagactacaccataaccttgacgcgggatgaaaccgaaaattatcttaaaattgaggatgcgctttcctttgactgtgaccgctatgaatgcacaccggaggaagtcgcagagcgatttgcggacagccccattgtccgtctctgcaacgctatcattcctgccacgcttgggcaggaggatttagaagaggtcttcacatgggcaaggtttttcaacgagactggcatttctgcaaagctaatgaatcatccgctgaccaagctctgtgaaaagctgttcgacgaacaccgtttgatggacttccatcgcggcatcttggatgtggactatcgaaagctgctcctaaatgaactggctcataactaagacacggaaaaacgcccccgacactgtgccagacgcacagtgccgggggcgttcccgtttccagcgatttattttccctcggcaatggactgtccataaggtgacactttccgttttgcgatgccgcgaaaattcgatgtgttccatggagatgttcactgggcagcatacgccgtacacgtttccaataatcactgagcagtgcaatgagtattcgctatcgggaaatacttcacggttttcacaacgcttgattcagaagggatttttttgccttattcccgcgtgacatcaagggaaaccggattgatgacgatgacggtcttgccctttttgtgggcatatctcacggtattcccggtaccgctgggacatccattccatactgcgagaatataatcggcgtgatcgaccatgtaccgatttctcttgtccatgcagtccggcgtgtactcccgttgcagcatggtctccttgtcacactttgccgcgatattataataccgttcccgtgaagccacagaccatttgatcgcttgtgtctcacaagggattgcactttccagagtaatgtgagggtattttgatttcaaatcgagtacaatttccgcagcgtacatatcgacgccaagagccatgccggtaataaaatgcgtgacgccctcgttctcgatgagtgctacaatctgatcccgcataacagatttcaaagaagtacaacgcttatcggattcatcaaagccgaacggaagactctgcggtctatgaccggtaaacgcacaagtcttgccttgaacggattgcttttcagctttttgagcagactttctaaactcaataatgcgcgacatgacaccccttctttcactcttttggtaggtaactccattctatcaccctcatcacggacagtcaacgcattgtcgttagtaaaattaacgacggcgtgccgtggataatgacaccgccgttaggtacactaaatgcaaaggtggtgaggctatgcgagagaagaaggacatcaatattgaaatcggcggcaatattcaagtggcaagagaacaggcgggctatacgcaggacacgctctcagaaatgcttggcattacgccgaatcacctgagcgctattgagcgtggtgcttccggtatttctcttgaagccttgcagcgtctttgccgtttgctgggcgtcagtgcggaccgaattatctttgggaccgatgagccagaagcggaagcccttgcgcttgccagacgtatttcggatataaagccggaataccggcaacaggttcaagagctgctgtccgctattttgaatatgtcataatatgtcataaaaaaagagcctctgccgacacccaaactgggcatcgacagaggcttttggttcgttttccgggcattcaaacaagtgccgaaatcgacacttattctcgctctattgctggaactgtgcggggaatataatcacactgggcggtcattcctcgtcgctctgaggcttgcaatcacagactttttcgacccctaactgtctacaccgcgatgccttgcgggagaagtgcggacaggcgatgagatccgcacggaagctctgcttgcagctatggacgcagcggacgcagaagcggttatacttccggcgtccgctatctccgatgaagaacgaccactcctgccgccacttctgacttctgctcacagctcaatctctcctttgtgctttttgggagggcagcagtccttctgcttttcagcctttgcagacttgagcctgtccatgatggaagacttctcgcccctttcgggggctttgacctctgcggtcttgtcctccttcggaccgttgttgatgatcccgtcaatcatgccgtagtcatcctccatcgacatctccgctgccttgaggtagttttccttctcaagagctgccatccagctttctttgctgataccgagcattccgccctttgccgcatgatcggcaatctccttggcatccacgcacaagccctcggtattatcggaatatagacggtaaacctcgcaccccttctccaaagccttctcagccgcctcctgaccggcgggaagaacgccagcccatgcgtagccgtagtccttcatatcctgaacggagagcgcgggatcgggcatttccggcacttccttgacctcaaggtcgagaaggcggagcgtgtcatcgtcaaagccgttgtagacatcatcaaggacgagcttaccgcgctcatcgacgatgatgcaagccgcctcatcgccgtaggtgtcatgctccatcaggtaaaagctgtgaccgccgatttcgtgctggtcaatggtgtgccacgtcccgatgtgaccggcaaccgtcagaccggaggtatcggcgttcatctcaaagtccttctgctgggcgacttcctgcttctgctgctccttcgagatcatggggatcgcaacaatcttatcgcccaacttaacaaactgttccggcactttgaagaggtcagagaacttctgcatctgctctacggtcagagaaccgaagctgtcatccgtcaagccgactaccatgaatgttccggcaacaacgtcatagatgtcaccgtcctcatcacgcagagcgcggttcaggggcagaccttccagcttgccttcctcgttgcagactaaggcaaccgggtcttcgtaggggtaaatcgcctcgatgcagccgccgacctcatgctgcaaggactccagaccggagtcaatctccttcacataaggctcctttcccggctcaacgacgagaacggcgatggtgctgtcacgctcggcggcttcccctaagccggtaatccggtattcgtcgggaatatcatcaagatcgccgttgaactgtctgtcccacctctcgcttgcgacgcggacatagccttcatcggtgaagtgtccctgctcatccatcgcaatgtcacgcccatagcgttcatagtcgatgtaatttgccagaggaccgagatccttttcggagtagataccggcttcgtgggcgtaataatagccgaggtcggattcgtcgttgataccgggcatgatgtcgtagcagtccagattgaacgtcaggttgatgagatcgtcgatgtcgctgacctcatcgcaaccggcttccataatggcaacgagcttttcctgatcgctcagggaaagctcgtcaatcaaagcggcaaggtagttgagcttatcaaggctctcgtactcgccaagcatcttctgcacgccgtagatcgggcattcgtagtcggtgataaaccactcttcgtagggctgaccgaactcatcctgcttgccgatcccgatgcgctcaaagaccttctgcatctcttcttcggttgtcgggaacttcacccactcaccgaccagcataccctcgttgtacttgccgaggttcgtgacgaaggcttcaaaatcaccgtctaatacgggcataggcatcctcctttcagtcatccaccatgccgtccggcatgatatacagttcctcaaactccgtgtccgtcatggcttcgagcttccgtatggtcttatacatcagctctgcgatctcgccgtccatgtcgttcagggtgacgcccttcatatcgtcgatcagccgcttccggctggacgtgttgaagcagcacatcaggttgatttcttccacagtaaagtttttcatatcagagtaccatatcctttcctttcgatttctgcggtttcggtgtgtgggtcggctgtgccttctgtgcggatttcagcttgtcgcggatggattcacgggcagcgggtttcttggggatggtgtcgtagatggcagttccggcatcctccacatacgagcggacatactgaatgctttcagaaaagcggatcggtctgttcttgtcctcaatattggtcagttggacttcatcggcagcaaaatcaaccgcgtcgattctgcacttgatgccatccatattcagcgtcgcgccgacaggaatgtaatctgcgcctttgagttccttgaaggtctcgccgtccttgctgagaaagacatctgcaccggacttccagagcttgtgagaaccggctacccatgcagcttcacggaagccagtgaccggcatggaaggcttaccgcgcaccttcttttcaaggagctttgtgccgagaagcggtgcggctttttccgcgtccttgccgtacagctcgaaatagccgttctgggcaaagcagaccagcgcgtccggatgtgcctttttgactgcctcgtacttgcggagttctgcaacgggcagaggcgaaagcgcctccgtcctctcagtctccggcagtctgtcacggcggcttttctgcttagacagcacttccaccagagcatccgcgtccttcgggagcgtctggtgggttttgacgccgccatgctcaccgaccagagccattgctgcatcgaagctgctgcggcagggggcttccagcacaaagccgtctgcgaaggtcagccggtcatgatccggcgcaaccgcgttctgcgccacatttgcagcctgttcccggtagttgatctcaaagacatctccgaagaccttgccgcgcttgacggatttcgggacaatgacgcgggcaacgcactcgtcgtaggtctgttccgcataaaagcggaaggtgttgtgatcccgcgtcccctgaataaagacctgattttcgttgagacagtgcgttccatgcggacggcagaaccacatcagcgttttgtcttcgggattccggctttcggcagcgcggcggatgatacgcttgtcgatgtcgaagtcttccttgtagctgtctacatgactgtccacgagcttctgcagctccgcaacgatgtcaacgtctgtgtatttcttcatgcgtctcctttctcacaactccatgtcgtgcgttttgaatttgaccggagacttcttctccggctgcgttttcgcggcagctttgagctgatcgcggatagagggcttttcctgcttctgctcctgcttgacgtattccagcgtcggcatcagctcacggtaacagccctgtgttttccgcgccgcatgacggcgatggattttgaacagcggctcaccattctgcgtgaccgtgttgccctcaatcctgacgccgttccgtgccagcagattgaaggagtggttagaggcgcggtaggaagcccgcattccgtcgttgttataggcaatctgccccttgagcgtgtctatgacggcggctttgatttccttctcttccgcagtcagacggtgcgccttcggtgcttgcgctgcttcctccggcaagggagcaaagggagacttgacctccacggtttttacctcaatagaggtaatctcatcgttctcccatgcaacgacctccgggtctctttcctctgttttctcagaagtgacttccttctggggttcggtctgctgacggaacgcatccacgaaaagtgccgtcagtccgggattgggtttatccacaaggaagcgagaggcgttttcggggcagacatcaacggtcttcgcccattccttgaggggctggggaatgcgcccgtcaaagtctttctgctgaatggtgtttgcgaggacatatcggacacgctccggagagaattgctcaaggacgctttttacggcagcatccgcatccagccggttatctccgtagttggagctgatcgccgcttcaatcgctttgcggcattccacgtttgcggcgagagaagcacgatatgactccagctcatcggcttcataggcgtaattcgctgtctcgcggtaaatggggacttccggcttttcctccggaacggtttcctgctcgacggactgtgacttctctgccagcagcaccttgagcttggcgtcaatgccctcgatcatctcagccgccgtcttgcggatggtgtccagagagcttttcagttccttggtttccttgccggatgaccaaccggcgatgtaaccgaaggaatagtccgaggtttcaatgccgtaacgctggcagacggtgtaggcaacgctttccgcttcaacctccttggtgtgccgatccttcttatcttctggcgcggctttctcgtccggcttgacggcgtggagctttgcgtgggcgatctcgtgaatggcggtcttgaccgtctggatttcgctcatgccctcctgaatggcaatgcggctttcaaccggagagaagaatccctttgcaccgcccggaatgtcctcaaaggaaatggggacgggagattcctgcctgagcgcatcgaagaacgcctcgtagttttcgacggtgcctttcagctcatcgacgataatgtccggaagctccttgccgtccgtctgggaaacatcaaagacactcaccaccttgaaggcagggcgcagaacttcgaccgtttccgtgacagtttttccatctgcgccgatcaccggcttctgcgtcacggggtcaatcttctcgcgctcttcctgtgccttgtacggcgcgggtgcgagaatcttgatgcctttttcgcccttcatgacctgacgctcaaagttacgctgccacgaggtataaccggcaacataggttgcctccggcttctgcatcgcaatgagcagcgtgttgttgaaggaatagttgtagaacttggacatcgtgcggagatattccttgaaccgctcggattcaaacagctccttgatgccctgttccagcttgtccgtgatttcgcggacttgctgtgcatttttgttttcagccatttcaaacctccatttcggatttgtttcggggagaagaaacccccgtctgagatttgctcaataaacgagcctttacctcagacggggtttctctgcgtgtcagccgacgatgaaagatgttatcctccttctcccattcaatcagtctgtcaaacatatccgggtgctttgtgaccatgtgcagcagctccgagtcattggcgttgggacagaaccagcagccgtttcttcggcagtgagcgtagattggggaaagcaaaccgtgttcctgacagagcttgtaggcatccgcttcggtcatgccgtacttggcaagcagactgaccttcgttattccatccagacgagcaaggcgttttggctcatcctccgcgatgccgacatagctcacagtgtccggagaaagcgcggtattgtactttcggacgggcgggattttgcagtcccgattgactgcacacataccagcccatgcaaagccgcgaacctcgcccttgtgcggtccgcgggtgatgatatgatggaacacctcatcgtaggtcttgtccgcgtggagaatggtgaacttgatgcccagctccttttcgcagaagggcttgagctggtcataaatgaagtcccggtgttccgggacttcgccgcttgtgtctttgtcgaacatgacctcactgaacacggcttcatccagcggttcattgtgctgtgcagccagcagaagggttgccacactatccttgcctccgctgcaagaggcaatatactttgggcggctcatcggtcaaactccatcttgaagctgacgtatttgccgccgctgtcatccagacgaatgacagcatcgtagagctgaggcttcttcggcgtgtaaagcccggtcactcggcaccagcccttgtccagcagctcctttgcaatcttcttggtcagcttctttttcttgctggaaaagaacttgttgtcttcccacaggcaaaaggagcagtccttgttcgagcagtagaagttgcccttaccgacgtagaccggagatccacaacgaggacatttgccgatttcctccttacccgtgccgaaacgctgggcttcggcatcggagagaaacggataggctttcacgagatccccggtcatccggacaatgccgctgagaaaggcgtctgcatccgcattgccgcgctcaatctccatgagcgtgttttcccattccgccgtcattgcgggagaggtgatctgttccggcaggacgcagacgaggttgcagccgtcctttgtgggaatgagggatttgcccttgcgttcagcaaagccggactttaccagcttttcaatgataccggcgcgggttgcgggagtgccgagacctttcttctcggtgtcatcgtcgaactgatcgtttccggcagtctccatcgcagacaggagcgtgtcttccgtgtactgcttcgggggcgttgtgaagtgttccgtaacactggcagatacaccatccagaacatcgccctcgtggacttcgggcagggacttcatgggatcgtccttttccttcgtcttgagggaggacttgaacagctcttcgatggctttccatccgttttgagcgacggtcttccccttggttttgaactcgtagccctcgcaggagagcgagatctgcgtttctgcgtaggtgtgcttctcgccggtcgcacacagaaggcgcatcccgataagattgaggattttctgctccgactgaggaagcgccgaaacatcctgcttttcaagctggacggtcgggagaatggcatggtgatccgtaaccttgctgttgtcggttacgcgggcaatgtccggagtaaccgaaacgccggagaaaagcggaagctggcggcagacgatagaaatgacctgacgggcagtgtcctccatatcgtccgtgataaactgactgtccgtgcgcggataggtcaggagcttcttttcgtagagcgtctgaacgagatcgagcgtctgctgggcggtaaagccgtagtatcggtttgcctcgcgctgcaaggtggtcagatcatagagcctcggaggattgacggttttcgtctcccgcttgagagaagaaacgacggcttgctttttctcgcaagccgccgcaattctttttgcttcctcttcggttttaaccttttccagatcggcggtcagatcgcccttgccgacatggacgttgaaatacttctccttctggaacgtggagattttcccgtcgcgctccaccagcattgcaagggtcggcgtctggacgcgcccaaccaccagcttcttgtgatagagcgtggtaaacaggcgggtgccgttgataccgacaatccagtccgccttcgagcggctgagtgccgcttcatagagacggtcatattccttgccgtcccggagatgggtgaagccttcgcggatggcggagtcctccaacgagctgatccacagacgcttgaaggacttggtgcatccggctttgtcgtagaccagccggaagatcagctcaccctcgcgtcctgcatcggttgcgcagaccagctcggtgacgcgcttgtccttcatgagagcggacagcaccttgaactgctgtgctttgtccttcgtgacctcgaacatccagctttccggaacaatggggagatcgtcataccgccacttggcataccgctcattgtaggagctggcgtctgccagctccaccagatgaccgaagcaccacgaaacgatgtaattgccgccctccatgtagccgtccttgcgggacgtcgcgcccaacacctttgcgatggactgggcaacgctgggcttttcagcaatgactaagatcaatcttcatcaccatccgtttcagcatcctccgcaatctgcggctcttcatcctcgttgatgtacggctcttcctcgtagccttcatcatcgaagaagtccatatcctcatccttgggctttctgcccttgacgaacttgatgtagtaatacgccgcgcccgcagctccaacaaggacgaagacgataagaaccataccgacattggatttcttttcgggcttgggagcaggaacgtcggtttctgcatccttgtccggctcaggcataacgggagctgtgccggtgcattcgctcatgttattcttgcagaccgggcagtcggtgttgacctgaccggcagcacatttttctttgcagttacaggtggtcagcgcagccgcagtatcttcatccagcagcgcaagcagatcgctttcatcgaccatgttcaggaagtacgtctgatactgttcctcatcctcgttgatgggcgcatcgtagtcgatgacaatgaagaaggtgttgccgttcttcgtctggacagtgatgaactgcttgttggttgccttgtcgtatagcaagtcgcgggtgtaggcgttgccctcatcgtcaatcggctcacccatcggcttttccggcgcgggagtggtttcaggctgctgttccggctgggttgcctccgtgacgggaaggttctgatcagtgtcatcggcgtaggcaaacgccgtcaccgagaagcaggacagaaccatgacgcagaccgcaaggacggtcagaaaacgaaacttcttacgcattgtcgattacctccgtattttcagcgggcttggtgccgcccttcatggaagacagaaacgccatgatctgatccttgtccatcaccatagagcgcacggtattgataatttcaaggttttccagctctgtcttcttgtcgtacagctccttgagctgtccttcgatttcggtctttttcttttcagccttctcaatgtcagagaggaccttctgatacttgggattcatgcaaaactcctttcttttaataggcgggtcttccgaaggcgtagaaatgctgctgccaataggaagagttgatggatgtgtactgaatgggatcgccgcagtggatcatgaccccatcaccgacgtaaatgccgacgtgagacacgccgggggtgtcatacgtcccaacgaaaaagatgagatcaccgggctgtgcattcgcctttgaaaccggcgtactgatgttgtaaagcccctgtgcgcccagccgcccggtgttcacaagcccgctgttcgtgagaacatagctgacaaagccggagcagtcaaaggatgtgtcgggattggagccgccccacacatacggatagccgagatacttttccgcctcggtaatcagtgtcgcaaacttctcgtcgttcaagtattccgggttgacattgtagtcggcgggaggatttgtgatgtacttgtccacatagggagagtcaccgaacagatcctcacggttgcccagcaccgacatatacgtcgcgtacatggagagctgttcctgccccatgatgtagaccgggacatgggagagattgaagttttcgagcttcacgttgcagatgtagtagtcatacgggacgcgataggtttccgtgtgcgtgttgccgtctgcatccgtccatgtgtcggtttccgtgcggtatctggtttcgacgatgacctcttcggtgaggatgtactgcttttcaaacagcatttggagcgtaccctgcacctcatccagcgtgaactcgccctcgtggagagccgagagaatggagatcagcacataggggtcatgctcaatatcgtccagatcgaagtggtattcatcatagttgtgagtgctttcgtaggtgtcgagatagctttgcagctcttgctccatccggcaatactgcgcctccgcaccgagcatcgcgtcatcctcgctgagataagaggaagcgataaccgacgagccggtagaggtgagcatcgaacacgagctgataccggcaccgagcaaaacgagaaggacaactccgacgccgatccagatgaagaccttcttgttgttctcaaagaactccttgagcttgtcggacaccttttcgccgagcttcttgccggtattcttcgtggcagtcccggcagtctgagaaccggcattccgtgcagcggcatattccttcttgatgttctgcttctggtagtgcttgttcatgttctgcttcttcatctcaggatgctcctgctgatttctctcatattggagcttggcgtcagctacatccgccttatgttccagcttggaaaccttctcataaggcttgttgacgctgctttcccgatgatgacggaaatgcctcgcagcggtctcagcggcaatctctgttttatgcgccgcctcaaccgccgagttttcctgctcgacctcatggattttgccgtgaatgccggaagcaagggtgtcaccgaccttgcggacggttttatctgcctcaaattgcagcttgcctttgctcttgggctttttcagctcatcctcaaaatgaaggcgggttttgccctttccggtctcttcatcaaagacacgctctttcttgagaaccttgtgcgtgggcagcttttcacgggcagcatccagacgctcatgtgccttctcagacttcctttcgagcttctgcatccgcttcgtgggcgggacggcatcgtccgagagcggctttgcagaggcagtctccgccgcttgagtgagaacggcatctgcatcaacggcttcaaccgcagaggtcttgcgcagcttgtgggtgacaaccgtttcggcaatcaccgtgccggtatgcgaagaaacgccgtgctgctccaaaacagggggcttgaacggcgtttccgagggcagcggttcaggtgcattctggggtggattttctgcccttttctcttctgtgacggacgtttccgaaggcggctgtgtgtcgttatcctcggcgtgttccgcctgaaactgacgatgctgacggcgcatctgcacctttttctgttcctccgcagaaagagcttcggaaggcgcgactgtctcagcggacttcaccaactctgcttcttccagccgctttgacacacgctgctcggtgccagccgtcaggtttttctcgaccgcgccgtctcgcgtcatccgcacgaccaccttgtcgcgggctttgagttccggttccttggacatcagatttcacctccgatccgcttgtaggcaagctcggtgtacgccggattcagctcgatgccgacgaaatgacgccccatctgcgcggcaaccatgccggttgtgccgcttcccataaaggggtcaagcacaatgccgtcttcgggacaaccggcgagaagacaggtctcaaccagcttcggaggataggcggcgtagtgaccgcccttgaaagggacggtgttgatcttccagacatcgcgcttgttgcggagcggattgatgtcagcgtccttgatctcgccatgctcacgcgcgcggttgatggattgcggctgaggctgaccgggaacgggcttgccgtatttgttgccgcctttcatgccgcgcttgaggcgttctgccgttgcaggggcaatcggctcggaaattgccttgtagtcaaagaaatacttcttggactttgagaacaggaaaatatgctcatagcagcgggcgcagcggtctttcacgctctccggcatggggttatccttcatccagatgatgtcgttgcgcagataccagccggtatcgcggagggcaaaagccagcatccacggaatgccgatcatgtccttcggcttgcagccctcaaccttgttgttgagagccacagcctgaccgtttctgccgttggggttcttcgggtcaacaaaatcgccctgattgcctttcccggcgtaggtgtccgaaatgttcagccagagcgtaccgtccggacgcaaaacgcgcctgacttcggtaaatacttccgtcaggcgcgagatatattccttcggcgttgtctctctaccgatctgagcatccatgccgtaatcgcggagcgcgtaatacggaggggacgtcacacagcaatgaacgctgtcatcgggcagagttttcaggatttcaaggcaatcgccggtatgaatgatgtcaagctctatgggtatcagctccttcctttgagagccggacggctcagtcagagaagaactcgtccggctcgtagtcctcatcgagatcgtcaatctcgtccgcccaacggtcgaagatttcctcggcttccttcgccgcctcacgatagaggctcaggcggttcttctcaaaggcggcaaaggcggggacgaacttgccgaactcgcggattgccttcacatcctgcgtgcgcatatctgcgacgcactgaatgatttcggacatcgtgagcagatcgtcgatcatggtttcgtagtcttccttggcgatggtgacggtatcggcatcgtcctcagccgcttcctgcttgcggactcggaacgtctcgtggacatccttcatcagcttgatcacacagtcagtggtctcatcgaaaatctcctgcatacgctctgccatctggtcggcgcagtcctccagttcctcatgaacgtggaggtaggcgcgatggtgctttttcagttcggtttcctcgtggatgagggcaatgagatcggcgctcatgtcgatgacctcaagcagaaggtcaatcggcttggtgatgctgccaaacgtggtgtttacggggacaccgctggcttctgcgatgatgctcttggcgttctcaagattgaagttcttattcatattcaaaatcctccttaattctgtacggtttcttcgggcttggtggtcatgatgcggtagagctgcgtgttcttggggaaatcgtccttgaatggcacgatggttgagccatagaagatcagcccctcaccggcgttggaattggtgatgtagttctgctggctgggcgagatgttcagcgccttcgagagaatctgccggtcaccggatgcctgattcagaaggtagacaaaatccgagttttcaaagatgttttccacctcgcgggaagcaagaagatccttgacgttctgggtgataccggtgggaatgccgccccactttctgaaacgcttccagatttccacgctgtatgcggcggtctgttcctccttcaagagcagatggaactcgtccatgtagtagcgcgttgccttatgctgggcgcggttgatggtgactctgttccacacctgatcctgcacaatcagcataccgagcttcttgagctgcttgccgagttcgcggatgtcatagcagacgaagcggttgttgacatccacattcgttctgtgattgaagacgttcagagagccgtgaacatagatttcaagggcagttgcgatgcgctgtgcctccggctccttctgatttctcagaatgttgtagaggtcttcaaggatcggcattttctccggcttgggatctgcaagaaactcctgatagaccatgcggacgctgcggtcgatgatagtcttctcaaccggctgcaagccgtccttgccgccgacaatcagctcacacatggagaggataaagtcggatttcagcgtcagcgggttttcctcttcggagtagttcgtgttgatgtccagaggattgatgtaatccgtgctgaccggcgagatgcggatgacctgaccgccgagcttctgcacaaggggaaaatactcggcttcggggtcgcagacgatgatgtcatcctccgtgatgaggaaggcgtttgtcatttcacgctttgcggagaaggacttaccggaaccgggcgtacccaaaatcagtccgttggggttcttgagctgcttgcggtccaccatgatcatgttgttggacagcgcattcagcccgtagtagagagcttcgccgccctgaaaaagctcctgcgtggtgaacggcacgaaaaccgctgtgctggaagtggtcagtccgcgctcgatctccacctgattgacgccgataggcaaagaggacatcagcccttcctcctgctggaagtcaagacgcttgagcgcacagttatacttttgggcaatggcggcggtctggaacaccgcgttttcgagcttctggcggttggttgccgtattcatgatgaggatggtcacaaggaacagtctctcattgcgggtctggagatcctgcaacagacgctttgcctcaccgccgaaggtggcaagatcggacgggatgatgtccatatcgtagccggagcggactgcctttttctgctcttcgatcttcatcttgtcgaggtcggtgatcttcatcttgatgctcttgattgccttcgcctggtcaatcgtccggatatgaaaattgaccgtgatgttgctgtccatctcaaggaagtcggcaagcatacggtcattgagttccggcgcgaggatttgcaggaagctcactgcgccgatggttctgcccatcttgaagcacttgccttcacggaagtcaaaggaagtgggcgcgatgaagtccttcgtgctgagtcccgtccgggctaccatgtcaaaggaaaagcggaacggctcattggtgtccatgttgaacacgtcatgaagcactttcagccgctcatagccggacagcggttccgtcctcacaccaagggttttgaagttgttgagaatatcggtttcaatgcgttcgagcttcggctttgccgtgcggagggagtccgcctcaatgccgaaggtgatgtacttcttcttgatcagcccgttgttgcccttggtgagctggttttgcagcataccggaatactcggagcggatgtcgttgaaggcgtcctcctgtgccggaatgttgatgcgcttgcggaactcattgaggcttgccttctgattgatgaaggagagctggacgaaaatcgaactatcaaagtagttcagaaagtcgcaccagttctcaaagatggcagttttgtcctcgttctgcgcaagctggtagttgatgtcctcaaaggcgatggacttcgtgtagaggcggctgttcaccttgcagataccgtcgcggcacatctccacatagggaatggtctgctgggcggacttgcggactttctttgccttcctgtcctttttcttctgcatgacgatccgcttcttttcctgagcggaaagggcatcgccgtaaacgacgccgttcttgacggtcatcttaggctttgcctttgctgtgctgttgttcaagctgcaattcctcctgttctttgattttctgctgaatttcagcgtagagattgtttgtgcgatagggacgcaccttgtcccggatgaacatggactgtacgatgtggtacagatacttttcggcgggctgaccgtccttctcgtaaagcgcgaagaagatgaacgggagcatgatcaccaccatcagcattgccgccgtagacaagtcgagatgcgccttcgccagaaagaagatcgggacgccgaccgccgcagcgatggaaaagcaaataagctgccgcttggtcaggttgaacatgaccttcgttttgacgcggttaagatccttcgggaccggaacaaatgccattgactgtttcctcctttctaagctgcttttcatagcgcagcttcatttgtgcgggatattgatcctccttcggttgacgcttgcccgtccagcgaagcccacccgctttgccttgacaaatccagccggaagcccgaatgcttgcaccgttttcgctttccagcgtgtaggtgatgatgcgcttatagcccatagccgcagcagctcttgccgccgcaccgtagagaaagctgcaagcgttcttcgccccgttggtgcatagccttgtaacctccaatgtgaagccgtcatccagataccggctgacgggacgcccggcgatgattacaccgaccagttcaccgtctgcttcacagccgatggaaaacttgtgaccggcaacaggcttgtgatgccggtgatgctgccggacgtactcgttagcgtcacgaagagaaatgggtcttagccgcagcatggtgtttcctccgtcggaagatgcgctgtgcattcgacctcgttgccccaaacatcccagccttcgggagactgacgggcaaaaagctctacgcggggaaggtctcccatgagccggacaatgcgctcccgcgcttcatccggttttttggaatgctcttcgatatggctgaggatgacctgacgcacaccggcgtcaacacgcttcggatgtcccttcgtagcaaggatgcagatttcggcgtttgcccttgtccaataccccatgccggtgaagagatcatcgttcctgcggttttgcttcacccatacaaaagccacagtcttataagaaaagccccatgccgtcagcacttcgagtgcttcacagaggcacgggaatgtgatccaaaggaacagagcgcagtccttcgcggcaagctcaccgaccggaagcgccttgatgtcctcaatgcacattgtcgggtagtggctttctgccgaccgtccctgtcccttcttggagtaagtccgatacgcccaagggggatcggcgtagatgatgctgtacttcttcatgctgccgacctccttagtgcgcatggaaaatggattttgcgaggcttccggtcttgaacagcgagaagcacagaataaccgtgtacgctgccacagagaacagagctgaatgaatgttgtctgcgatgatcatgccgttgatcagcaccgcatagatgccgacgcagaccatgatgagaaagccctgaaatgccagagcgaacaagcctttcagatagttcgtgccgatgctgccccattcgcggttgctcatggttgcgatgggaataggcgcaatgctcacggtgcagtaaatctcaatcatgcgcccgtagagaatgaccgtaatgaggatcgccatgattttgaggcacaagctgatcagaagagtttctatcgacagtccgagcagttctccgacgcccatgttctccatgccggtacgcatctgcgcaatcgtcgcgtcaatgtcaatgctggtgttgccgtggatgactccggctgcaccggaaaccacgttctgcccgatgtcgaatactgccatcacgatgtcaaacgtatgcgtcacgaggtagatcgccacagccgccttgaaaaaccacttgaagaacatccaagtgtccatgtcgtgaaggttgtttttctcggtgatcatggaaatcagctcgtagcacaaaacgaaggtgatgatgataccagcgatggggactatcacgttttcggatagtccccggatcatctggtacacgccgccgttccagccggacggtgtttgcccaacttcggcggcaatcgttcctaccttctcgttgacatcggtgaacatattggtcaggttgctctcgatccatccgatcagcatatccttgagagcttgttcgatcttttctaaaatgctgcccaatatttcaccacccttcggttaagctgggcttgccgtggattagccgaacaaaccggagagcagggggatgagggtcgtgccgatcagcaccacaccgccgccagccatgagctgcttgatgccctgagatttggcgccggggttgtcgttgccgtagccttccatgaggttgacaacaccccacactgcgagacctgcgccgagggcgataacgagcgtctgaagaaccgtgacagcctgattgatgaaagccatagattttcctccttgatttgaaaaagattggttgtgtatttttgaaaatgggcataaaaaaagaagccccgtcgctgttctgctttgggagccatcaggctttacccactgcgcagtgcagcgacggggctttaatccgcttcgacctcgcccatatcatagaggtcgaatgtgtcatcgggcttgactaccagcttgtgctgccgatacttctcgatgtcaaaggcgttccgcttgtcgtagtcggagagctgccggtactttgcatgcttcgtaatgtcgtatttgttactgagaaaaggtctcacgcctcgaagctgcaaaatacacttggctccgtccatgacggcgatctcatcctgagacatcagttccttgccggttttctggtaattcaagccgtaggagttgttgctggaacgggtttctgaggtgttgtaaaggtcgattgtctccttgcccagcacctcgctgatttccttgagagtcgatttctccttgccgccaagaaaaagtgtgcagtcgcagttgcccgtgatggtgtccgccgcgtccttgtagatggtcttgagctgagactgggactgcaagatgattgacgccgagatttcccggcttcggatggtggcgatgagcttatcaaacttcgggatttgaccgatgttcgcaaactcatcgagcagacagcgcacatgaacgggaagccgtccgttgtaaacgtcatctgccttgtcgcagagaaggttgaagagctgggaatacatgattgctacgacgaaattgaaggtgtcatcggtatcggaaatgatgacgaacagtgccgtcttccggtctccgatggtgtccagctccatctcatcgtagctcatcagctcccgcagctctgcgaatagcgataggtaatcctttgatgttatctccggattttcccccgccctaaaccgggcatgaacctttcagctcacccggcttgccatcaggaacagaatttatttcatctcaataactctcaacgtggacaaggcttcttaacttattgagtttttctttctgcttttggtcaaggcctaggatttccatatactttctgataatatcagggtttgtagcatgaatcaggtgatgtacatcttcacataccaacaccagattttgataattgtccttgccgcctaaataccgtggcactttgtgatggcaatgaatatcgccaatagaaagcactttgccagatacggcgcattttcccatttgggccgaatacagtgaaagcctgttatcgttgtattcgatagtacggtacagaaccgggttcctcattaagtaatgaagaaccgtcatgtcgattctgtccagattcttatggatttcggctctgccctcgggcatataggaattgattttgcggttcatggactttgggggcttgtgccgtatgtagccaatcgggacaactgcgtgtccggctacatatcggagctgtttgcttttcccataccgttccctgataactttcggaacttcacacggaatcttcctttttctgacctgttttgcagttttaacccgttctttcagtcttgcccgcaggctcttgtggacagataaggcgaatggcgtaaggtcatcgcagacctttgtggctaattgatagtagtcatggattcccattacataaacgttgtagcggcaaatcgcctgatattcagtacgtttgccttgtgacgggaactcaatgtcgtaaatcagccgttttaagtttggttttattttcgcaatagatttctctctgatatggctctctactacatatttggcgcgtccgttgctccgtttcccacgggggataacctttaacttgaaaccaagaaactctgaatactgctctttcaggttaatcaccttcgatttttcaggactgatttcaagagaaagcctttcatggagccagcttttggttgcgtggaataacttcaccgcattttgatagctgttcgtgaatatcttaaaatcatcagcgtatcggacgcaggtgacttctttcagccttgtcctccgcagtgcggcaaatttatggctcttgctcacgcttccgttgtaattgaccgattccttgtaagggaactccgttggtatttcttcccattggctggcaagccaccaatccaattcgtttagaactacattggatagcaggggagagataatacctccctgcggcgtacccacctccgggaatcctatcccggccacctccgcttttagcatagctgatataatactaagcagcttcttgtcttggattcccattgtccagagctgtttcagcagttttccgtggttcacgttgtcaaagaaccccttaacatctatgtctacgacatagtggagattgcttctctgcatatttttgtgaacctgggcgattgcgtgctgttggtttcggttagggcggaatccataactgtggtcgtggaatttcgcctcacatatcggctccatgacctgcaatacgcactgttgtatcagcctgtccataatcgtcggtattccgagcgggcgcttcttcattgggtcatttcctttcggaatttctacccgccggacgctttgtgggacataccagtttaatttgcgctgtatggcgcatataagctgttcatcagagagtgctgataattctgtgattgtttttccatctgtgccgggcgtcgtactcccgtggttcttcttgatgttgcggtatgccagccgtatgttttcgggtaatgcaatgatttcaaccagatgtttgaaaactttgcctttattgctgtcggcatacagcttatcttgaattgcctggaagtcataatactcggcgtgccttaacttatctttcttctttgcctttcctgttgccatagtcggttacttatccccactttcgtttggattttcgcctttcttagtcctactcgaacctatgcgtgtttattgaatatgattttgtttctgttcctgactacagcccgtccctccaccgcttactttgttcacggcttcacaggtagcatggctgctctttcctcccggattaagaacggttataccgcacctcccataaaaggcggcacgattttcccgcccattgcttcatcatgcgtatccactccacatccggggctttccacgttccgatattcctatctttgcataatacccttaaccctgccctttaggcctgtatgcctgatggtgcctgtaacaccatagggaatttcatatcgacaaatcttactttaccccacatacgccgttttcacggctatggcatttctgccatatcccgttatagacctgtacattcgggcttttgtcagcggtagtcagccgcattctggacataggtactttatagacctccggcctaacacccccggccacctctggctcggctttgctttatcccccaaaggggacagtcgcgggtgcagacagccgacttcagcgtgctgtgtcagtcgcgggaaatacgtcccgtttcttccaacgcagtatcaagggaagcgtttcagggcgttaccccgccattccacttctcggaatatcagttagaaaggctatagcctttccgtcacttttacctctttgcaggaaaatcccacgcagagtttatatgcgacaacgtgtcgctgcactgtccatcttttgtgtattaaggatgttcaggactatacagggacttgttatgattttgcaaaacgcacatttttgggtggtaaaaaatatatttcggctgagacgtttgcaaaaaacttgagtgaataaaaaaactaactattaaatgttaaatggtagttaaaaaaattaaatttgacctgatatagaaagaggtgattgaggatgtataattttttgattaaatataggctaaagaccggggcgcctgcaactaaatatataactgtaaaatctgtatcggcaaagctggcaaaacagcaatttaatgaaatgtatggttctgccagttttgaaatactgggagtatataaggaggtgagatcaattgtataactggattatacgaatatcgggagcggtggttggcgttgtattgttagttatggttaggtcgcttgagtggtatcccatattttacgcagctccgcttatgatgatacttttggcattttttaattgcgcagaggacacagctgaagaacaacccatagctgacgatgtgcgtaaggtcgtaatcaagccggataatcggcggtgggacttttcggacgcggagtgcagcagggattataaaaataacagtagcaaaagaatacataaaattgtaatgtgaggtgattattataaaaccaatagttatatgtggaaattcaaagtttgacaggcttgttatggactgcaattttgcggctatggcatatatggacaaggacatcaatgaacagtacagagaatttaggctggaggatataaaagtaaagtccggctgtgcggaaccacaaaccggactaaaaaatatatataacaagaaatctatatcaatataacatataataaaagaattgtcaagctgagagaaggagaaaagatgaataagatacaaaatttatcaactaaagaaataatagagcctgatgacagacttacatatgcgctgaaccgctgtggaattgggataatcaacgaaaattctcctgactttgactggtttattaaggagattattcctgagtttttagagcttttttacagcggtaattatgctgaggctgatgagccggaggaagaactgccggactatggatattatgacaagctggacgaagaatatgagaataagcgattaggaggaatataaaatgtcacaagaaaaattgaatactgtagatataaaaggcaagccgtatgtgcttgttaatgagcgagtaaaggcgttcaggaaaaattatcctaattatggattgataacaactatcgtggaattatcggaaaagcgtgttgttatgtgtgcaacaattaacaaccctgacggttttccgattgctacgggttatgcttacgaggacgcaggaagttcttttattaacaaaacttcatacatagaaaattgcgaaacgtccgcctggggcagagcattagccaatctcgggataggtattgatggtagtatgtgcagtgctgaagaattgggaaatgcacttttaaaccaaagtaaaccagcaaaacgtacgaatgaatctatcgcaaaacagattgatgatatgattgatgatgagccgcttaagacaataaatatagcggctgtaaacaccttaaaagcaaagttagatgaatataacaccgtgtgcggtagaaatgctactgaacaggaaatttctaaattttataaatgctccaattttaatgaattcgattacactaattttaaaaattgcataacaatgcttgatgggtcaatcaaaaaagttggagcggataagaaatgagattaaccggaacgattaaagatataagcatgggttttttagacggcgagtgcaaattaacactcgccgtcaatgaaaaaaatgacttaaaacttgcttatgacgaattgtcacaatgtgagttattggacattgaactcaaaaaacaccgtaaaaaaaggtcgctgaatgctaacgcttatctatgggtgttatgtggtaagttggccgataaaataggcgttgataaagaatctgtataccgtcagcatatcctaaatgctaacgtatatcgtgttgcggaaattaacgaaagtgccgctgatacgttaatcaaaggctggcagatgaacggtgttggctggatagccgaaagggttgacaaatctaataaagacggttttgtaatcgtcaatctatattacggcagcagcacatataacactaggcagatgtcaagattattagacagcgtaattgaggattgcagagaccagggcatacaaacaatgaccccggacgaaattgcaaaattaaaatcattatggaaagctgaaagttaaatgaaaagtattatgcaacaagacaaatcgcattgttatatatgcgaaatgagcgaatgcggagaccatttagacaagcaccatatatttggcggtgcactgcgtgatacgtcggaaaaatatggtttgacggtttatttgcaccacaataaatgtcatatattcggggaatacagtgcacaccaaaactattatatcagagttaaattgcaagaaatagcccaaataagggctatggaagtatatggttggagcgagaacgattttagaaaaattttcggttgtagttatatataaaaaaatctcaaaaggagaataaaaatgattaataaagtaatattaatgggtcggttaaccagggacccggaactcagatacacgagcacaaataagccagtatgcagttttgacgtggctgtcgccagcggttatggcgacagccaaaagacggattttataaattgcatagcgtggaacaaggcggctgagttcctcggtaaatatttcaataaaggtatgatggtgattgttggtggtcgaatttcaactcgcacatgggaagggaaagacggcaaaaagaattatgttactgaggttatagcgaatgaactagactttggtgaaacaaaaaaggcgagagatgaatataacggttacagtcgccctaaacaacaaaattcaacacctcaaaaggcggctgatgattttgaggtgcttgacgacttacctaatgacttgccattttaagggagtgtagaaaatggaagaacaaaaagcgtattatgctatcattccggcagatgtgaggtatgatgataagttgccagccaacgcgaagctattgtatggagaaataacggctctgacaaacgaaaaaggctattgttgggctggaaacagatattttgctgatttatataacgtaacaaccgttacggtctctaggtggataaaaatgctttgtgataaggggtatttaacaagcaatattttttataaaagcgggacaaaagaaattgaatgcagacaattgtcaatcactggaaacaagacaattgttcagcaaaaatgctatgaccctattattaaaaatgataataccccaccaatagaaatgttaaggggtgttaacaaaaatgttaagacccctatacaaaaaagtgcgccacctattaacaaaaatgttaaagagaataatacatataataatacatttaatattacatctaataaaaagaaagaaagaagaaagaaaaccgggtatgatgagataatagattctcttgttgaaaatgaagaattaaaagatacattgcgagaatttataaaaatgcgaaagatgattaaggcacctatgacggacaaagcattaaaattactcatcactaaagtttctaaaatgggggacgtagaaacacagattgaaatacttaatcaatcaattgaaaatagctggaagtcagtctatccgcttaaaaataatacgactaatactgtcagcgtagctaaaagcaagtttaataattatacggatactaacaagactaattatgaggaaatagaaaagaaattatatgataacatgttaggggaatattgatgataaaatttacgataagcggcaggctgccgagccttaatgattatatcaacgtatgcaggcacaacaaatataaggcggcggcatttaagaagcggattgacactcagataatttctgagatacgaaaacagcggataggtaaagcaaaaacgccggtatacatagaatttttatggattgaaaaggacagaaggagagaccttgacaatatatactccggtaaaaagtatatactggacgcattgcagaccgccggagttataccaaacgacagtcagaagtacgttataggtttggtggatatggttgcttttgacaaagcaaaccccagggtagaggttacgatttgcgaagaataataaaaaggagaataaaaaatgatagatttaaaaggcaaaaaagtaatagcaagaggaattaattcaggagtattttttggaacattggtagacaaaaatggacaagaagtagaattaaaagaatgtcgtaatatatggaattggacgggggctactaacctaaatgaaatggcaaaatccgggataaaagatatagaaaacagtaaaatatccgtaaaagttgatagtctaatattaacagatatttgtgaaattatcccttgcacggaaaaatctattaagattatagaaggtgcgccagaatggaaatgttaagtgacaaaattaagatattcataaatgatttagactgtgattttagtattggccatgattatggcaacggaaacggaaacggaaacggttgtggtaatggtcatggcaacagcaacggaatcggaaacggaatcggttgtggcagtggcgatggttatggcagtggaaacggtattggcaacggaaacggctatggcagtggcgattgctgtaacaatggtcatggtgatggcaagggatatggacagggctatggctgttattatgtcaaaggcattaaaactataaacggacatgacctgcatattatagataacactctaacaatgattaccaaagtcagaaataatatagccaaaggattcatagttactagagaactacaattaagaccgtgctacatagccaaaggagaaggctattttgcacacggtggcacgttaagaaaagcgtgtgaagaattagaatataaaataatatgtaatttagatacagatgataaaataaatctttttaaagaaaaatttaaattaaatattaaatatcccgtaaaagatttttacgaatggcaccataaactaacaggtagttgtgctatgggacgggataattttgcagaatataacaacattgatgttaaaaacgacaaaatgacggtgcaagaatttataaagttaacccaaaatagttttgggggagacgtaataaaacagcttgcaaaggagatgaaagttaaaattgaaaactaaatgcactaagccgccgaaagtgccgagccctacgttgtgcggcaaggcacctgacgggatagattgttttgtttgtaagtggtatgcaaaaaatgggattgaaaaggaggatacaaaagatgataagtgataaaatagctgattttttatcatacatagaagagcaatgccaaatgtatgatattgccaaagatatgttaaaagaatgcgatgaagctacgcaagatatattacataacatggaaatagacccggttaaatataaagagcgtgcgagactagctactaaattacaatctgtacgccgccaaagaagaaccgcgaaggatatgacagaaacaacaaaaataatatcaatatgggtaaaagataataaatcaattatagggtcattacaacgattattaggagatataaggaaagcagagaaaaaacagcaaaatagaacctatatacccaggacgaatgttatagaggagataaggagaatatgaaaatgaacaaaaaaattatagggatagtaatatcaatagtcttagttatgttaattgcagggtgcacagaagcatcacgtgtgtcctacaatttgtcgcaacaagccgacaattttaacgatgtgcgccaacttacagttattaactgcattcaaggcgatgtattgttccaaatgacgggcaaaatgtcgattaaagcggatataactgacaatcaacttgaagttgttgttgaagaaaatggagagtataaaaagcatttcattggacttagcgacaatgtaacatatgtcgtagaggatataacctccggtgatgtagataagtataaatatacacttaattttaaccctaagatgtggattccaataggtgtagattctattgattgatacagacagtaaataggagaatagatatggaagcaatactgaatatattaacaacagaagatatgacagagttaagacaaggtattaagaatttaattttaaacgctgtagaaagcgaccttaatatgcgagatgaatatatagtatcacctaattttgtcattgatatagtagatgatgttgttgaatatatgcgacctaaacttgaaagaaaagcagaaaaggtaatgactaaaagaataaatgattatttaaatgcaatacagcagacaaaggagaatgaaaaataatgttacatgcagtaaaaatcgaaccggaatattttaataaaataatagaaggtaaaaaaacatatgaaattagaaaaaatgacatggattatgtagccggagattgcattgcactaaatgaatataagcgtggagaatatacaggacgttttatattaactggcattgttagtattgatgaatatcctctatacttagatacaggatatgttattttacaattaagcccgttaggacttgaagataacataaatcatttcgaaagttatgtaaatccagaaagatttaagggggaaaattaaatgaagaaaaaatatattaaaagattaattgaaagagatacgccaaagaaaccatatttagatactgacacattaagagcggttaaacctgccgttagatgtccgatgtgtgattatattttagttctacaaatggaacagttttgtccttgttgtggacaaaggtttgtagagaaaaagaataaataatattatttaaacaaaaaaacgccctgcatatgcgaggacgctcgaaaaataataaacatattatatcacataatagtgataaagtcaaggagtgttaattaatatgcagggtgtgactatagaagaaacaaaacagtggttaaatcgtggttataaactacgagagacgataagaattttagaaaaagcgcaaatgcgcgcttatgacatagtgacgggtacgacaataacactatcggaaagggtacaggaaagtcacgggaatggaacagagaataaattaattacatacgcagattactgcaggcagatagactgtcataagacagatttatttgaaatcttgaaacaaataacaaatgcaataatgaaagttgaaaacaacatctataaaaacatactcatatcaagatacattaatttcgagacatgggagaatatatcacaaaatattggatattcatacagacaaatactgagattgcatgaaaaagcgctacgaaaagttaaagatgtccttgaatgtcacattgaaagtgtgatatagtgtataatgtaggaaataaaaaatttctcctttttaaatttttttctatgagccgttaccttatggggacggctttttatattgcgattttaggtcttgtgggaatgatacatcataaataaatgctgaggggtgggcggctgtgatgttaatggaggtaattaattgtggaaataatatataaatcaacaaaagaaattaagccatatgaaaataatccgagaaataataatgaagctgttgagaaagtagcagttagcataacagattacggatttagggtgccaattattattgatagtaataatgtaatagtcgcaggccatacaaggtataaagccgcgttaaaaataggctgtgaatctgtaccatgtatagttattgatgacttaacaccggagcagataagagcatatagattggtagacaataagacggcagaatattcaagttgggattttgaaatgcttgaaaaagaattaaaaagtttagatatagatatttcagaatttgaatttcctgatttgggagaaacattggatatttcagatgatgatttttatacagatgagacagtaaaaaatgttaaagtgaaatctattaaatgtccgcattgtggagaaacttttgaactatgaaaatatatcttgctacatcaagtagtggtgtgaaaaaagaacaaagaaaagaaatgataaaatgttgtagaccattatatttactagagactttttattcaggcgaaaaatgttgcgcaatggttcagaatgatgttggcacggataattttcttcttgacagtggagcattttcatatatgaatggaaagtctataacagaaaaacaaatggaggaatatatagaaaagtacatctgccatataaaaaaatacaatgtaaaatacttttttgagatggatgttgattgtatatttggtcttgaaaaagttgaaatttggcgcaaaaaaattgagaaccaaactggtattaagtctatacctgtgtggcataagtcaagaggtatagactatttcaaacgaatggtcgatgaatatgattatatagctataggtggtttcgcaaatggtgatataaaaaagacagaatatccattaataaacaaaatgattaaatatgcaaatgtgagaggaacaaaagttcatggtctcggctttacgcgaatgaagtatatatatgattatccgttttatagcgtggatagttcagcatggtgcacaggtgctgtaagaggaggacatttatattattttgacggtaagataatgaaatatgacataataaaaaatgggaaaaaattaaatctatctataatggctatgcggtcattttcagaatgggtgaaatttcaaaaatatctaaacacaaggagagtagtatgagaaaaacagaaaagaatttatcaatattaacaatattgtttgtagtatcattaataatttcaaatgtaataacaggtaaaatcattaataccggtattccgttttggggttcagtgataacgataccctgtgcggttttatgctatcctataacatttttaattacagatgtagtcggtgaggtttgggggaaaaatgaagcaaatcatatagtaagattaggacttatttcacagatagctgctacgattataattattattgggaaatatttaccttttattgacgcagaaatgcaacaagcatatataaaaatattaggacaaaattggatattcgtgattggttctttaactgcttatctagtaagtcagaatcttgatgttcatatatttcatagattgcgagataagtatattaaaaaacatggcagtacaaaaggtggtcgctggatatggaataatgcaagtacaatgacaagccaatttgtagacacattaatttttataacgatagcttttggatttggatttggttggatatttaacaatcagattactctaataggtatgttgatagggcagtatctaattaagttgataatagcggcacttgatacgccgtttttttattttctgacaaaaaatataaaagaaataaattaggcagtgtggggtgctggtaacgccccacacttacgctagagcacctacctctaacgcagatagcccttctcggccgagattgctacctgcaccattatacatgatttagaggtgcgatgtcaaatggaaatagataccaaaataaaagaagcgttagaaaaacgtgcttatggttttgaaattgaagaaaaagagtttataaaaaataagaataatgaaaatactgggagaataaaagtaacaaaaaaatatattcccccggatgtaactgctttaagaacgattttgcaattaaagcaggcagggaaatggtgaggttatggcaaagggcaaatataaaaaatggttgaaacctgaaaatttattattaatagagggctgggctagagatggattggttgatgagcaaatagcgcataacatgggtatagcgtgttgtaccctgtatgagtggaaaaataaatatgcagagatagacgagaccttaaaaaagggtaaagaggtagtagatttagaggttgagaatgcactgcttaaacgagcgctaggttacatagtagaagaaaagaagattgaggagaatggtataggtggagaaaaaactataactactataaagcatatacctggagatactacagcacaaatattttggcttaaaaatcgtaagccaaataagtggagagataaaccaacaacagaagacaatacacaagaccaaaacataattattaatattagtccggctacaacaaacgatatggaagatagttatggagattaatttaaaagtcaataaggtatatataccttatttacaaaaaccacaatttacacagatatattacggcggttcctcaagcggaaagtcgttttttttatgtcaaaaaattattattgataatatgaatggttgtaattggcttatatgtagagcggtcggcaaaagtattaaacgttcagtttttaatgaaatctataaagctattaattatatggaacttagtaatttatatagctttaatttttcggatatggttattacaaacaaggtaaatcaagcgcaaatagtctttgccggattagatgacgttgagaaattaaagagtataacaccacgaaagggcgttatagaacgaatatttattgaggaagctacagaagtcaaaagaaatgattatttgcaactcaagaagcgtttgcgtggaccgtctaaaataagcaaatgtattgttatggctttcaaccctattttcaaattacattggatttataatgattttttcgacaataaggttgaagacggttgcaagaaatatgaagataaaaaagtatctattttaaagactacatataaagataatatatttcttacaactcaggatatagaagcgttagaagacgaaagtgacccatattttcacaatgtatatacattaggcaattggggagttcttcaaggtctcgtatataagaaatttgtagagaaattctttaatgtttacgaaattagcaaaagacctggagtagtatcggcgtttggacttgattttgggtacacaaacgacccttcagctttattctgcggattggtagacgaaaaaaataaggagatatatgtatttgacgagttatacgaaaggggactgaccaacatggaattggctccaaaaatacaactaatgggttacggcaaagaaaaaataataggtgacagtgctgtacctcaaacgattgaagaattaaggcaattaggattatcaaggatagagggagcgtacaaacatgaggttatgtacggaatacaaaaacttatgaatttcacctttattatacaccctaaatgcagaaactttataaacgaaattaataattactcatacgccgaaaaagacggagagagtatcaataaaccaatagataagtttaaccacttaatggacgctatgcgatatgcggttatcccgaaattagagggagatgtatttagctttaagtagcaggaggataaaatgtttaatttttacgaagaaacgcagagaattattaatattatatcaaaaggcgcaaataaagcgccaactatgaaaagaatagcggaaatagaattaaataaatataagcagagcaaaaagcgtaaaaaaatgcttacaggaataaattattatgatggaaaacatgagatactcaaaaaaaagcgacttgccattgaagagggcggtcaggcttccgaacagcactatttgcctaattctaaaataattaataatcaatatcgcaaagctgtagaccaaaagtctaattttctttgcggtcgccctatagcaattgacacggataacgataaatataccgacgaacttaataagatatttgacgaaaattttcatgcaatacttaaacagacggcaaaaaacgctttaaattgtggtatatcatggctatatccgtatatcaacgatagaggagagttttccgtcaaaatattctcaggtattgagatattaccattttggcaagatgaagagcacagatatatagatatggcttgcagattatatgttatcccaacatatgagggggaaaacgaaaaagatgtggagcatgttgatatattcttgcctgaggggattgaatattatatatatgaaaatggaaaattagtgattgattctgagcgtgaacctgaaccatatcttacatacaaagataaagatgataatgttatatctctgagttgggataaaataccgctcataccatttaaatataactacgaggaacaaccgcttatagaaagggtacaatcaatacaagacgcaataaatctaataatgtcaaattttgaagataacatgcttcaagacccttataatactatatatgtattgcttaattatgacggtgcggatttagaagaatttcgacataatattgcgcagtatggagcggtaaaaataaggtccgttaatggtattgatggaaatgtaagcactatagaagtaaaggtggacagcgaaaattataaagctatcctagaccaattaaaaaaagcgttaatagaaaacgcaatgagttatgatgcaaaagacgacaggcttggcggtaatgcaaaccaaatgaatatacagagcatatataatgatattgaccttgatgctaatggtatggagttagaatttcaaagagcgttaaaagaattattgtggtttgctgatatgtatttatacaatactacaggtcaggattttacgaacgaaaaagtaaaatttgtattcaaccgcgatatgatgatgaacgaaagtgaaataatgacaatgcttcaaaatttaggagtgcaaatttcacaaaaaacattaatttctcaagtgccttggatagatgacgttgaaaaggaattgagaagagttgaagaggaatacaatacaacgaacaacgatgagtataataacttagtcaatcagatgagaggtgaaagcggtgatttaggaaatgccgaagaatgaaaaaatagaaaagttacttaaacgcaacggcgaatattggtcggggcgttttttgtatcttgaaaaagtacaaagtaataaaaatatagaatactttcacaatcttgaaaaacagtacaatgaagctgtgcagacggtaacaaacgatataaataactggtatatgcgatttgctgaaaacaataaaataacatttacagaagcaaaaagattattaaatgcaaaagaacttaaagaatttaaatggactgtggaagagtatatacagaaaggcaaagaaaacgccctaaataaacagtgggtaaaacagcttgaaaatgttagtgctagggtacatattaatcgtctagagagccttagaatacaaatgcagaatcaggttgaggtattaatgggtaatgagttagatgatataagcaatcttataactgacatatatcaagatacctattatcgttctatttttgaaatacaaaagggttttggagtagggagcagctttgcaaaattagatacaaaattaattgaaaactatatacataagccctggacacccgacggcaaaaatttcagtgaaagaatttggggtactcatagaccccagcttgtgagagaacttgaaacaacgttaacacagtcagttatcagaggggagcagcctaaaaaaatagccgctaagatagcaaaacgatttgaggtgaagaaacatcaagccgaaaatcttgtattgacagaaacagcatttttcaaatcaaaatctacattggacggatttagagaaatgggagttaaagaatatcagaacgacgcaactttagataacaaaacatctgatatatgccaacatatagacgggacacattttttagtatccgagtataagccggggattacggcaccgccttttcataatcgttgccggactgttgcaataccgtattttaacgatgaatttacggtcaatgaaacaagggcggcgagggacaaggatggggatatatactcagtgccgggtgatataaaatatgcagaatggaaaaataaatatgttgaggattctatatcagataatgaccgtaagttatttaataaatatgtaacaattctaggactaaatgcgcctactattgacgaatttgtgaaaatgaggtataataaaaaagagtggggacagtttacatcttattcgagttcaataaaatccggtgaattatctcctttggctacatttgaattatataaaagtatcagcaaaaaattgatgataacttaataggcactattacaagcaatggaataaagataacagataaatctaagcattttatatcaagagtaatagggtcggttgagcagaggcgtaacggcgtaaatgtcaaagatgtattagacgtgcttcaaaatcctgcaagattaggtgatattagaaagttgaagaatggaaaaagccaaagatttattggcgacttattaacggctactgttaatcctgataccggagtgttaatacaggttaacccaacaactagaagaaaggggtttaagtgatgaatattactgaaaaacaaaaagaacttgtgaaaaaatatttgaaaaagtcatatactgaaatatatcaactcctgttagatttagatgataaaataacagaaattggttttgatgagaattacgacattaacgaagagggcatattattgcaaaggctatatgatgacctctattatcaaaattctgaaatataaataagctccgatttatcggagcttttattatgctttaaaacagaggtgaaattatgattaaatgggcgttaccgattttacaagtagtctttattatctgcaaggtgttcaatttattaaattggagttggagtatagttttcataccgagttatatttggctgactgtattctttatattcctagttttctgtttaatatttatatatttggggggcaaaagatgaagtgcccgtataaagataatagatttgaaaatacaacatcaaaatatatctatgacgaagacggaagtctaatagaaaataaaataacgacgtgtaccgcttctacttttggaaagtgtgacggcgaagagtgcgcagcatataaagatggtgtatgtcaatatgtattggtcgaaaagggaggttgagagttaatggcaagagagccaactggaaataaatttaataatgattgagccgcataaggctctttttttatgtgcaaaattcgtctttttggtattgcagacgtaaaagaacaagactgatagccgcggactataccgcgtataaaaaatgtaatcaagaaaggtgtagtgtttaatggataaagcatttttaaaggagcttgggatagaagatgaaaatataacaaaaattatcaaagctcacaatgaggaaataaaggacagttatgtaccgctttcccgatttaacgcagttaatgaggataaaaaggaagcggaacgaaaagcaaaagaattaaagagccagctggacgggttggacaatgtagatgttgcggaattggaaaatacaattgagacattaaagaacgaaaacaaaaccgcacaggaaaatcacgaaaaagaacttaggaatataaaaattgattatgctcttgataaagctttgatagacgctaaagctaaaaatattaaggctgtaaaggcgttttttaatttagatgaactagaacttgataatgacaatatcaaggatatagacgataaaatcaaagcgttagcagaagatgatacaacaagttttcttttcggttccgacgaatcgagcaagggtaaatttaagggtgttaatcctgtgcaagtaccaggtgccggaagcggtcagtctgacgatgatagtgtaggctcaatgtacgcacaaaaatataatgctaaatttggcgttacaaataacgaaaatgaataggagtgaaagtaatggctttaacaacaataaaaagaacagaaactagacctaactttttagaatcggaagtaggtttggtgcttaaaacggcacaagtagacaacgcaaatattgaagctgatgaatatggatataaaacggtgaaaggcggtacaccttatccagcgaatgattcaaccgcaaaaggtcttatttttgaagatgtagacgtaactgttggctctgacaatggggtaagaccggccagcctaatggttgcaggaagagttttagaaaatagactgcatactccgttgagttcggcggcaaaaacagcacttacagcattggggtttgtttttgttgacgaacctgtaatcatgagagaaccaattgaacccaaagagtatacagcaggaacaaccgcgttcagcggtagcgatatagcctacggaagtggtgagctaacgattactgctattgatgacagcaacactgattcggcagtagctacagttgcattgtcgtcttcaactcataaggttacagcaactaaggtaacggcaggtaatacaacggttgattgcactgtatcagacggcacaaatacagctgtgattactgtaccaatagaattagtataggaggactataaatgaatattttacaattaatttcagacaaagacagattgtcattttcgcaaaatctgtctatacagagaaactatttaggggacactttatttcctgatttgaagacacagcacttagaagctgagtattttagactgactgacggtcttaatctgccaacaatggcgcaagtacatggttttgatacagaagcggcaataggcacaagaccgacgttagaaaaggtaacaattgagaaattattgattaaagaaaagattaatcagtctgaaaaaactcgaatgtatctaaagaccggagtatctgagcaagcattggtttcatatgtatttgacgatatgggtcgtcttgctgataacgtaaaaacaagaactgaagtggcaaaaatggaagcgttatcaactggtaagctgacagttaaggaaaataatcttgattttaccattgattatggagtgcctaaagaaaatagaatgtcagtagattggagttctcccgaagctgatattttaggggacatacggtcaatgattgatattgcgaaagaaaacggtcatactgttaacagatgtgttgcaagtaataagatagtaaccttgatatgcaaaaataaggcagtacagacggctatgtatggtgtaaatggagttggaacttttgtttcgctcggtcagcttaatacaatgctcagtaatatgtttggctttacaataactgtaaacgatgatagatacagatataaaatcacaaaagacaaatacaagacaaagcgttatatagatgaagatgtatttattttatttcaaagtctagacggttctataggtaccggactttggggacccactcccgaagaggaggatatgggaccttatacagaaaagtcaagtcagcagtatattaccttgacacagtgggagacaccagaccctagagcggtttggacaaaagcgagcggtgtatttattccggttctcccgtcccctgaaagcctgattataagcaaggttaaattagcgtaaacgaaagggggaacggatatgttagaagaaatatatgcagctcttgaaagttatggttacaacgaatttgacggttctgatgagatgattataaatcttattattgataatgctgaacagcatataaaagggttttgcaacatttctcaaatacctaaggacttaaaacatacattcatacatagcgtatgtggtgagttcctatatcaaaaatataatagcggaaatttgccggatagttttgattttgaggtagcgtgttcgtcaattttggaaggagatgtaaaacttgatttcaacattaacggaacatcaacagcagagcaaagatttcttaaaatggtaaacgaactccgttcccctgattacaattgcttgataagacatagaaagctggtgtggtaaatgaggattaaaacgccaacagctatccagattcagaatgcaattacaagcatgtggaacggcagaatgaccgtgtacggaaataaaagcgtgtttaacgaagttaccaaaataaccgaaatagaaaatgatgtagtcttagccaaagatataccatgcaggatatcctttaagacaatttcaaaagtttctgaacaggacggcgcatttaaaactgcacaggaaataaaacttttctgtgcccctgaaatagaaatagcggaggggtcaaggcttgttattacccaaaacgatataacaaacacatacgaaaaaagcggcacaccagcaatgtacacatatcatcaagaaattatattgtctcttgtagaggagtgggtataatgatacgctgtaattttaatgatttaaaagtgtttagggataatctagataaattaacaaatgcagaatatgacagattagcaaaagaatgttgtaatgaaattgccgcacgactgttacgaatgacacaaaaaaatacacctgtagctactggcacattaaaacgtgcttggaatatagagccggcagagaagaaaggtaatgtgtgggtatctgttatatacaatacagctgattatgcaatctatgttgaatatgggcacaggacaaccaatcataaaggctgggtaaccgggcgttttatgctgacaaatgctgaaaaagaaatagaaaggattgtcccacaattgctagaaaaacggttattgcagaaactaggtgaagtatttgactaatgaaacaattgcaggaatatcaaataagttgtatagcttgtttggagaaaattataaaatatatactaaggaaataaaacaggacttgaaaaagccctgtttttatattgtcaatttatctgtcagaaacagggtttcactaggtttgagatataatcacgaacagtcatttgatattcatttctttcctggaaaatcaggcagtcagtctgagatgtcagagattgcggataaattgatgacaaaccttacatttattcaagtacaggataaaagttatttgtatgggtctaatatcaactcccagattgttgaggatgtgttgcatgtttttgtcaattatgacgtgccgatgaaaattgttaagaccgataatgagtatatgaataatttagaaattaatggaggtatgaaatatggcaattaaaaagccggatgaaatggaagtaaaagacaaatataataaatccgttattttgcagtctgcaaaatacaaaaatagacgtgatttgcttgatgtcttattagatgagaagaaatactatacaatttcggaagttgaaaatgcaataaaaaaatatatgaacggaggtagaaaataatgttaggtggaggtactttcacgactatgaacaaagttctgccaggttcatatatcaacgtaatatcaactggcaatgcgacggcggctttgtctgatagaggttatgtagccgtaccaatggagcttgattattctcctgaaggagtttttgaagtaacagctgcggattttcagaagaattctgtaaagttgttcggctacgagtacaactcagaaaaaatgaaaaatatacgagagatattttgcaaggcaaacactgtgtatttttataatatctgcgaaggcggcaaaaaagcaacaaatacatatgctacagctaaatatccgggcgaagctggaaatcaatataaaataaaaattgaagaatcggtagatgatgaaaaccgtcttaatgttttgacaatttataacagtacggttgttgatgttcagcaaatagaaaaaattacatcagcaagcacagaaaacaacggacttgttgataatgattatgttgattttaaaaagaatgttgtaccaaccgtaacatctgggagttctttatccggtggtactaagggaacctcgtcaggagccacaatacaaaaggctttggattcgttagaatcttattcgtttaatattcttatttgcacattgacacagacaacagataagagattgtatgtaaactatgtgaagcgattaagagacgaaaacggtattaaatttcaggttgttatacatgacccagaaaatgaaattccggcagattatgagggctgtattagagtgcctaacaaggtcgctgacggttctgaatctgcgcatgaattagtttactggacaggcggagcagaagcggcgtgccgtgtaaatggctctttaacaaatgttgaatatgacggggaatataccgttgacactaattatacacaaacggagttatctaactttattcagtcggggtttttggcgttccatagagttggaaacgaaacccgtgtgcttgatgatgttaacagtcttgtaactgtaaccgatggtaagtcggaagattttaaacgcaaccaaactatacgggtaacagaccaaatatctaatgacatagctgttctttttaacacaagatatctgggaatatcaccgaatgataatatgggcagagcctcactaaaaaatgacattgtgaaaatacacgaggatttgagaaatataagagcaattgaaaactttgcatcttctgatgttacagtcgaggcaggagataaaaaaggttctgtaatcgttactgatacaattacaacaattgaagctatgagacagttatatatgactgtttacgtttcgtaaggagggaaaataaatggatgaaaaagactataacatagcaaataatgtggtgatgaaagctaaggacagtttgcaagctaatttaggaaaatgcaccataactaatggcactaagcgttataactttatgcaagcaattaatcttgaagccaactttgaaaaaacaaaagaagaaattccgatactcggtaaaacaggtaaagggaataaatctacaggctggaaaggaacagggtcagcaacatttcattataacacttcaatatttagggaaatgatggctgattataagaataccggaaaagatgtctattttgacattacaattgaaaacggtgacccaacgtcagacgctgggtatcaaatagtaacacttaaagactgtaatatagacggtggtattctagcaaaatttgacgctgacggcgggtatcttgatgaggatatggacttcacatttgaggactttgagattactcattcttttactgctttgacaggatttttaataaacgataatagcaacaacaataacaacaataatagcaacaactaataataggaggtaaaaagatgggaacattaaaagggtttttgaatcctaagaaggttgaaaatataaaattcgtggtgagcaacagattcgttgatgatgacggtaatccgttagaatgggaacttagagcactttcggcaaaagaaagcgaattgctgcaaaccgattgtatgataaaaaaagcttccagcagaagaggggtgtcaagtcttgatttagatgctgctttatacacaaagaagatgatggcaaaatgtgttgttaagccggatttgaacgagattgacatacaggacgcttacggcgtttcttgtgcggaagatgttttgggaaacatgttgacaagcggagagtacacagccctttctaacaaattattagatgtaaacggttttaatgaaatatttgaagatgaggtaaaagaagcaaaaaactaataaaaggtggagacgcagacagtaactatgcttattactgtctgcatgaactccaccttttacctagagaatatttaaatttgtcccgaaaagaacaggctttcattgcggcgtgtattgagataaatcaggaggagataaaaaagattaataaaaagaacagtaaaaagaaataaggggtggttattataggaaaaacaatgaaaacagcaatagaaatacaggataaagttaccgcacctattaaatcaatgtataatgctatgaatcttcttatttccggatttgagagaatgcagaatatgcctggaaatcttgtagatacaaagtcaattgccgctgcacgttctgaattaacaaatgtaaaaacggtattgagcggagcagaaaagggcgctaaaaagttgaacacagcgtcaacatctgcaggaaatgctgttaagactattggtcaatcatcagctaacatatccagagtttcaagttctatgaattcagctgtaaactcaaccaaaagattttctacagccacaactcaatctattcaaggattaagaggtcttgtgacaagcctaacaaacgcaaaaaataaaattgtaagcgcaacaactactggtatatctaaatttaaacaacttgcaacatcaatgaaagaaagttcctcttctggtaatggtctggttggtgtgttaggaaaagtagcggcggctgtaggctctgttatgggagtaaaacaaattatcggcttatctgataccatgtctcaaacaaaggctcggcttgatttaatgaatgatggacttcaaagcactaaagaattgcaagatagaatttttgattctgcccaaaagtccagaggttcatatcaagatacggctgacctagtatccaaacttggtctaaatgcaaaagacgcatttgaaaacactgcacaaatcgttgattttgctgaacaagtgaataaacaatttgttatatccggtgcgagtgcggaggaaacaaaaaatgcaacattgcaattaacacaggcgctatcatccggagttcttaggggcgatgaactacgcagtatatttgaacaagcgcctacattgattcaaagtatagcgaattatatgggtgtgccaatagggcgtatcagagatatggcagcagaaggacaaataacagctgaaacggtaaaaaatgcactattagggtgtgctgatgaaacaaacgctaaatttgctagtatgccattaacatttagtcagttgtggacaaattttaaaaatagagctatgcaagcgtttcagccagttcttgaaaaaataaacgagcttgcaaataacggaaagctggaagaatacataggtaaaatagctgaagcaatggcgatggtcagtgatgtaattatgaacgtcataacatgggtattagaccatcaagatatagttaaggcggcttttattgggctttctgttgctattggtgcaatgactgtagctatgtgggcttttaatattgcttcatatgccaatccggtaatctggattgttttggctatcatagcagttgtagccttattagtggctgggatagttttagtcgtcgaacattggaacgaaataaaagatgcggcaagtgcttgctgggaaggtgttaaaagtgcttgggggaatgttacagatttcttcaaaggaatatggaatagtattgtttccagcgtaacaggtctgtggaataatattgtttcgatatttacaacgataaaaaatttttttgtcggcatttggaacagtatgtatactgttgtttctacattttggggtgctatatggaatactatttctccaatagttatggctatatggaatttaatcagtacgatattcactataatatggacaataatttcaaccataatgcagggaatatttcacgtaataagtaatgtgtggaacgtaatatataacgccgtttcaggggtgctaatctctatatggaacattataacaagcatatggaacagtatatacagtgccgtctcaggcgtattgtcctcaatatgggatgcagtgtcgagcatatggaacagtatatataatgcaatttcgggcgtattaagcagtatattcagcactgtttctagtatctggaacagcatattctcagctgtaagaaataaggttgttgaaatatataacaatgtcaaagacaagtttacggaaatacttaattatcttagtggtttgaaagataaatttttacaaaaaggacatgaaatgatagacggtcttataatgggtattgcggataaaataaacggtgttacaagtaagattaaggagttgggagaaaaagcggttggggctataaaacaattctttaacataaattcaccgtcaaaggtaatgcgtgaactcggtaactttacatttgagggatttaatcttggacttgcagaccaaataaacgctatcaaaaacacatcacttaatatgggtgcagtggttacggctaattcaatgcctgaccttaaagcaaatctggactattcaggaaaaaaagatttcagcgcaatgcgtgagactatagctagtaatactactaacagtacatatattcacgctcctgttactgtaacccaaaagaatgatattgttgttcaaaatggcgagagcactgataatcttattaagaaattatcaagaggaatggaagaaaacgcagaaattgtgtggaaaggggtattagcataatggcttattctttttttgtggcaggaacaaaattaccagtgccgccgtcatcctttacaactaaaatcgtaaataaaaatgagacgtatgaactagttgatgacggagaaataaatattattaaaaaagcgggattgaaagagttttcatttgaggttgaattaccgtgtacagaacgtccatacgctaattatgaagatggttttcttccgcctttacattatttagaattatttgcatatttaaaaagcgaattattaccgttccaacttgatatttatagagaactccctagcggtgaagatacatattacacgaacgaaactgtgacactcgaagattatacagttaccgaggaagcgactaacggtcaagacgtaaaagtcgaattgaattttaaaaaatatagacagtattcaaccgctaccgttatgcaagatgaagacggattgcattatactattgtccggggtacagataagcgaataaacagggttgtagatgtgaaagacggtgacactttagccactatagctatgagagaatttggacgggcagaccaaaatttgattgattatctatacgctataaataaagaaaacatagatgctgaatgtgcaaaaaggggagtatctccaccacagatattccccggtatgtctatacgacttactgacgacagtttcgggaatatcgatgaatacaacgccaataacaatgttggcgataataagttacaggttgaagacgtaaacaagataactgaggagggattaacagtgacacaatacgaaagtataatgcagactgttatgggacatcaaaacagattaaacgctatgagcagttatatgatatataactatgttgataagaatatgccgaaagaatttcggccaatagtaagatttttaaattataagggttggttaaaaggagatgacagcggagaactcggtttaactgatgatatgcttagaattttagcggctcttgcccgttccggtgcttttggtaatgactgtcctacccctgaagatgaaaaagactggggggattaatatgagtgtttgcagagtgtacattgaccctctgagagattacagcggcaataatgcaggagcttcatattttggagtgcgtgaacaagacatgaactggtttgtggcaaaaagagtttctgaaacacttgataattacacatttatgaactcacagaaatattcatcttttgaaactcatttaagccgggaaacaaaagaaactacgaaaagtgaagatatgtgggagagcttgcgtatacgtctgaatgagagtgaaaagctatgggacgatggaggagagcagacaccttattacatttatttggggataggctctgaaccgtccgggaataaagagaccagtacagaaagaggtataagctgtcactatgaaaagagaaatgcaccgggtattgataacgatacgtggaacgcatggagctatagtttagctgatactatacttaatacagttgtgaaaaatactgatatgcctgaatataaaatacctataacgctgacaaggtatctgccaataaatgaaaatgaaaaaataatgtgcggtgttacggctcacgtaggacgaataaataatgcaaatgacgctagattattatacaacgaagagacaaggaatgctatagctgacaatatagcggaggctatagcatattgggtagaccaggattacacaagcgggaacgtgcctgataaatataagacaccatatacagccatagataacgccaaagacagggcaaaggcagttcttgccgaaatacagaagaacgaggaattattgtctgaaatagaaagccgaatggtatacaattacatagataaaaatttcccgtcttatgctataggaaccattgaatatttaattgacaatggatttttaattttaaaaggagacgatagcggagaacttgggttgactgatgacatgatacgtcaaatttgtatttttgcccgagctggtattttcggaaaagattgtcctacacctgaaaactatatcccgttatgataaatgtaattgacaatattttcctcatatgatatattaattacaatatattatatgggaggtaattttttgaaaaaatttgtttgcggattattgattggtgtaattataagtggtttagttggagtgtatgcggtaaatcaaatatacgataatccatattcgatatatgttaacggagagcaaaaacagatacagggttataatattgacggttatagctattttaaattaagagatatagcgcaggcaacgaataagttcaatgttgattttcaaaatgataatgtaattattgatacgtcaaaagggtattcagaggagaataagcaaccggaacaattaaaaatagatgaaaagaaaatatattgtgattatttaaataatgttgaaaagattgaagttcttaatcatccggcaggtgatacaactgaatatattagtgtaaatgatttattatattatatgactgatgttaataacgacggggtgcaagatttagcgttttcatcaaagaactatcctaataatgggttaggtattttaactatagataataatagggttaccgaacttataactccttctattattccttatagtgctggttccgaaacatgtactttagctatgtatgataataaatatgggatatttaaacatagggagaattcagctgatgattttgtttttaccactattgttggaaagagtaaatttaatacaactttaagtggctatcatcatgaagatattggttatataattaacaatgaaaatgttggagaattaaattggtggtcgatatttaacaatattattccagtaaaattttatggttttgattctcttgtatctacttcaagtgagtattcaggggaagagccagacgatattatatattatgattatggaaataatagttgggctcctgattatggagcatattctggtttaaaatatgggataaataatttagaatcaatcattgattacaccgaaaaacaattagtttctaacagcagtgttattacgtatgaatatgtatataatgaaaaacaaattaattcatatatagaattattaatgagtattgggtttagtagaagataccttgaaaatgacttgtttgtatatcaagaaaagtttcctattttaatgtataaaaaaagtgatatagtgctatcaaaaaacggtaattatattactataaataattctcctgattatgaaaaggtttttgtttcgacttctcccggtaaaagtccagaagatataataaaagaggctcaaaataatatagataaactttacttataatatatactataaataaatatttttcaagacaccttagagggtgtcttttttattgaaaaaagaggtgaacaaaactggctacggcaaaacagttagtagaaatcgcagaaaaggaaataggatacactgaaaatagcggtgtatacaaagagtatgacagtaccgggcaagcgtggtgtgcatattttgtttcttggtgcttaaaaacagccggaatcagtgtttatggaactcaaggcgcagcggcggcttttgcatacatggcagaaaatgagggaaagggtacatttcacggtaaaggaagtggctattcaccaaaaatcggggatttgtttttaaaagattataacggggttgattgggcttcacatataggaatagtaagaacggacgccgcaaatggaagtttctcaagtgtggagggaaactctagtaatagtgttgcttctaatacccgcaatgtttcagattattgttatgtgacaccgccttttaacggttctagtgttggtgctgctcccttagctccgcaacgtgaaatagttattgagttgcccggcggtcttggaaaaatatatacatatgaaacgtggaaccgggaggaacatggatattctgcatggaattctgattctgcgcaaaagaaattgataaccgtttcaaaacagcgcaatgaatacagttttgacggtgagggatatggatttgtcggcaagcgttatgttgtagcaatgacaagcacattcggggatattggtgattatgtagatatttattgtgccgacggtagggttataaatgctgtaataggtgatgaaaaaagtcaaacatatgaagactgggacaataatccggctaataaatggggacatgaaaacggtcaaattgttgttgaatttttgacaaattggtcagctaatccattgcatgaaaacccgtcgtcaaatggtggggttttaaaagttatcaatctaggaaactattttaattatcccgaatatgctattggatttgacggaacgggcggtgtcgctgacagcaatagcggtaaaagtataacatcaatacagactatgtcatatataggcgccagtgtagattttagagaaaatcctcttaacagcaaaaaaatgttaaatcaaaataatatagagttatatatatcaggagcagaaggagttatatataaaccggttgtagttgatgaaataacgtgggaaacagaagcgtacggaagtccggcacagcttgaatttactattatcaaggatgcgtatatatcttttgaggagggtgaccaggttatatttaaatataagggtgctcctgtattttacggttttatatttcaaaaacagcgaacaaaacaacatcatataaaagtaactgcttatgaccagacaagatattttaagaatagtgactgttttgtatttgagggctgtacagctacagaaatagtaaaatctatttgtaatgattataaaatagcatatggccaacttgaagacacaggcgttaaattgccccttacagtttgcgataatattcaagttttcaaaataatagaggatgcattggattatacggtagcacaaggcggctatcgttttttattgtgggataattttggctctttagttttggctcctaagttttggtacaaaaaaaattatgttgtatgtgattttaccgcccaggattttgattatacaacaaccataaatgaggggacatatacaagagttaagctatattatgacaatgaccaaacaggtacaagagaagtgtatatcagagataaatctgtcgaatatcctaaatttggtgtactgcaatattgcagtactcttgatgagggggaagacggagtaaaaaaagctgaggaaattataaaaattaccaccaataaaataagaaaacttgatataaaaggagcgttaggagatgtaacggtaagaggaggaactcaggtatatgttgagcttaatttaggggacataattcaaaaaaagtggatggaatgttttagtgcaaaacacacatttaaaaatggagagcattttatggatttacatttagtaggagggcaatttatatgattgatataacggaatttacaagggcggtaaaacgtgttgccgttcaggctgttaaagaaacagttccggctaacgctgtgtttggaacagttgtttctgccgagccgttgcaaatagatgttggatatgaaaaacctataagcggaagtcttataatactaccgctatgttttgataaaaaaacatatacaactacaagcagcggtagtccgccgcatagacacacaatagaaattgataacagcctaaaggtaggagacaaagttgcactgcttaaaatgcagggcggtcaaagacatgttgtattgggggttgtgtaatgttaccaattatatctacgcctagagaaaaaattattgatactaaaatagttatatacccctctaaaacatatgaaatagattgggaaaacaaatgtatagctgggtcaattgacggcgtaaaagcgttacagcaatcaatacacttaattttactaactcaaaggtatcgttatccaatatatagttgggattatgctacagatattgaccctctatacggtatgagaaaagattttgttgtgcctgaactgcaatgtagaatacgtgaagcattattacaagatgataggataacggacattatagattttaaaattaaccatatagaaagaggcaaatatgatgttagttttgcggtgaagaacaaaatatcagatacgctctacataaatgaggtgatagaagcatgattactagcaactatgattttggagatataacaaatagaatgttgcaaagagtaccaagtaaaattgataaaagacaaggctcattgatttataacgctgtagccccggcaagtttggaatttgcaaaaatatatcttatgttacaagcaatagaaaaagaagcctttcccgatactgcaagcatagaatatttgaagagacatgccaaaatgaaaaatttatctcttaatgaagccacttatgccattgttaggggtgaatttaacaagaaaatacctgagggaacacgattcagcttacaagacagcgaattaaattatatagtaatgtctgaaagtcccaaatgggatggggacaatgcacggttatattattatttgatgatgtgtgaaacaaccgggagtaaaggcaatcaaaccggaaacttaatacccataaccgacatagaaggattaactgttgctaaaattgttggcattgctacttatggtacagacacagagactacggaaaaatttaggaacagatattttgatactattttaaacccaccttttggcggcaaccgtgctgactacaagagatatatcaggtctataaatggtgtaggagcttgccgattgataagaacgccatcaggcggcggtactgttggcgttattatctgcgacagcgaatataacgagccgtctcacgagttggttggcagtgtgcaaacgttaattgacccggttgttaacagcggcaacggttttggaatggcaccaataggacatagagttactgtatcagctgtagaaacggttggaatagaggttatttccaaaattgagtatcaagagggttatacctggaacgatataactgaaagttatcaaaatactatatcagattattttgctgaattaaacgaatcatggggagatatagaccctgataatatagtcgttagaatgacacaaatagaacaaagaattttgaatttgaatggggttttagacgttgttgatataaaattatatccttatggagagaacgcgactacaaataatttttcggtgcctgacggcaaacttgtctctaattgctctacaggttgggagccgttgtcgttaaatgcaggggtagaagccaaaatatcaaaagacccatcaggaaacggaaatgctgttaagtttttatgcggctcagacgtatatggaaacggttggtcttatgatatagctagacttcttgataaaaagccaacagatttcatagaggcaacgggatatttaactgtctcgtttgaactttttcagcctgaaaacagtaggggattaggtaatttctatattgatttgagcggtaataaaatcattaaaaacagcgacggtggaaacacatatacatacggacggttaagcggttatgaaccaaatacaactgaaataaaaattattggcggtagtgctaagacgagcgacggtgtggataaggtgcacatagcaaatgaaaaagttttgggaaattgggtaactgtagaatttaaaattgattttactacacgtcagaatttcacttgtatatataataatagagaacatattgttacgggattcccgtcaactgttgacccgtcttcattatatcttaatatacagctttctgacaatccacaacataccaatgatatagaaacgtatattaaaaatgtgtctgcggtatatataacggagtaggtgaaaatatggggaaaatatacacattaaaatatttgcctgaattctttcatgacataattgattttgccgaattatgcaaaacgtatgacgttgaatttttgcttctcgaaaaagaaattgaaaagttattaaataactttttctttaattttttaaatgagcaagggtgtaaacgctgggaagacatattaaaaatatctatgcgtgaaactgatacgttagaagacagaagatttagaataaagtctatatattttggagatacgccatacacggaaataacaatgctggaaagattagaaatgcttgtaggcaaaggaaatgttactgttagtatagatgtaaaaaattataaagttacggtcagattgtcattgagcagaaaaaaccaattagcagaaattataaaaatgattgaaaaaatggtgccgcttaatatgattatagatgtcaagctgttatataacacctatgagactttaggattatatacgcatgattatttaggtagatttacacattatgcgctgaaagaaaatgttttgggaggttagacatggctacaactacaaaaatatacggtttaaaaaaaccgtcattaacagatgtttataacattatggattttaataacaattttgataaaattgacactgttttaaatacaaaaacagaaatagaagatatagggacactgaacggcaccgaaagcgtatttaatacacgaataagtccaggtttttataaaggaatatggaataatcagtccatgaagcaaaagggagattttacgctttttgtttttgatgtctcctctactaatacggcagaagatacaaaggaaacagtagtaatgcaagttttatttcatgaaaatcaagtctcggtccgtttgggtgtgttaggtgttccggcgaattggggtaatttctctccgatagcaacaatgtctaatatatcaaacatagaacaaaagataggcaatttatcaaatcttactacaacggctaaaacaaatatcgttacagcgataaatgagttgataacgtcaatatcaaaaaaagcggataaagttacaaataacggatttgtagccggaggagcggaagccggaaaagtcggcagtatatcaattggaagcggtataagctccaccggagaatatggaatagcaattggagccggagcggaaggtacaaatgatagtgtatcaataggacatgggtcaattgcttccgggattgattccgttgcaataggagatgtagcggaaagtttggctcaaaatgctgtgcaaatatgcgaaggcagtaacagcgaaagtgaaagtctgcaatttagaaaatataaaatagttagatatgataccacagacgatgaatattatttgaaagatgttggcaggttgagccgattatatactactaatcggtcaaacatcgttgaagcaattaatgaattagacaatgaagcggaaaataacacaactgaattactatcaaaaataacggaacaaaataatagcttgataatgctgatacaaatgcttgctaatactgggattaacatagttccattactcgaaatgctgggtaacactattaccgttatttctgatactgtaactcaaatgtatcaatactctgacaataataatcctgataataaattaaaaggaattgtttatgcaccaaatcttgaaacagttgaatcacgttcgatagacgataattcaggcatgacaacaataatcatgccaaaagtcaagacaattaaaagtcaaggcttttgggctagttatggacttaaaacggtctttatacctaatgcttgtacatctcttgccactaacgcattttctatgtgtggaaatttaactaacatatatattgataatgtcgaaggtacatttggagatatagcagcagattcaagtttgcctaatttaaaagttacatatttaaaaaagtgaggtgtctaaaatggaatacagactaataaatggtatttgccatatatgcaaatataaaacggttgtaacaaatgagaatggtacaaaacttgaattttatcatttggacgaggttgaaactaatcagtcattggaactacatcagcaactcagcgacttgccagctgagattgttcctcttgatgtatcagactgtatttggcttgacggtaaagagttctcgtttgatacagaaattattcaggcttatgaaatgggggaaacagaatatataaaatatcttttggaaaaatcccgtcttaacaatgcaaatctgcttaatgaaattaaaacattgggtcaggctcagactgatttagagttagaattaatcgaacagggacaatacataacagacctcgaattacaacttttgggagggggtgaaagcaatgtatgaaaagattaaaaacagatacgaaaaaggatatgtaaccaatagtcagcttatgcgttatatatcactcggagtattgacggaaaagcaggcagaaaaaattaaggcgttggagaatgaataattatgataattgattataaagttgattcgcaaattttacgcagaaccagcagaaatttaatagtggcggacagcataaaatatttggctgtccgttttaatttttctgatgaatggaaaggcactaaaaagacagttgtttttttatatgatggatatagctataatgttcttttggatgaaaacgaaatagcgattgtgccgcatgaagttataaaaagtcctggatttaatttatctgcatatggcacgaataacggaatgcgaataacaactaacacatgcaaagtatctgttataaagagtggatattgtgagggagaaacaccacctgaaccaacacaaaacgtatatgagcaaatattagatagattagataatagcggtggaggaacagaaaaaaacggaaaatcagcttatgaaatagccgtagagaatggatttaacggaactgaaagtgaatggttagaaagcctaaaaggtcagccgggcaaagacggaataaacggagcagacggcaaagacggagcagatataacagctataaatgattccgaaacctcatcagagaccacgtggagcagtgcgaaaatcactactgctgatacggagctacagacacaaattaataatacatataatcatcacctgaacgatagtaacaatattggcaatgaggtatacgacggagcggttcttactatagttgatgatgacgggtccattgaattcttaaataattttgtgccgatatataaagataagggtgttaggtgcagttttgcagtcgtagcttgcagagcagaaacaccaacaggtacaacaacaagcggtgacccttacaaggctttaagctggacacaaataaaagaacttgtgcacgatggcttcgacatgcaaagtcacacatacagtcatgatgtgaaagtgtttcggacaggcgaaaacttaaacgaggaacaacttgaacatcaatttggtgacgctgatagattatttagacaaaacggacttgattataactgtatggtgtatccatggggtacggctcaacaaattaagaaaaaagttgcgaagcgatatgccaaatatggaatgacgttgattagcggggatacgggactaaatgatgaaataagcgaacctatggcaatatcaagattcacattgcaaagcggttcaacgagtttggcaagtgctaaatctcaaattgatacagccattgccaacaagcaatggcttattttatgcagtcatgcaaatgcaaatcaacctagtgccgacacgttgggaaatattattgattatgctattagcaaaaaaatacgcatagaaacgttttcgagagccgcaaggctcaaggctcctgtgtattatacaggcgagggagacaatatgtttcgggttatgcccaatggtgatactaaatgcaagcctgatgatgatactgtgagatatatcgtgcaaagggctacagtattaggattatttgaagacacggaagcgagcatatcggcaagttacggaaaaactcaaaacatagcaggtgacacattggataagtcgcttataacagttattgtgacaatgacgagtggtaaaacacattctgtaaccgattatgctgtagaagaaacggatttaacgttggcagagggcgaaaatacgtatcatataaaatataaaggacttagttgcacattaacggtaacagcgatagcggcggcggaagccgcagaaattacacaacagccgcaagatgtaacaacagaggtcggagaaactgcaaatatgtcaataatcgccaaaggtacaggtttaacttataaatggcagtggcttgacgtgagaggtgatgaccccgttggaatatggactaattgtgcagacggcacatcaagcatattgcaatttacagtagagccgtatcataatttacgtaaatacagatgtattgtaacaagtagtatgggggaaacgctaacgtcagatattgcaaccttgcatataggaagcaaatacaatatgttgatagagcacacctctgaatcagaagctatcgaacgaacatggtacagtatccctttatcggcaggtgcgtatcattttcgtgctactgtggaaaaagctgaatacgcttgtacattccagcttaagacagctatcaataatgtagatgataaaaatggtacggttatgtttatcgcgccaacaggcacgtttaacgccgcaagcgcaatatatacgtttgagggtgattttacgttagaatcagacacggaatacctatttttgtacacgaaaggaattactgccgggaaaacaataactattgaatattataaaactaattaggagggcagaacatggacgaaaacgaagcggcaatcagagagcggctgacggcggttgaatcctccgtcaagtctgctcatcataggatagacaacatagaggagttgacccaatcggtaaaaacgcttgcagtggaaacaaaatatctcaaagaagatatttccgatgttaaagaaaaaatagacgttatagccggacgaccgtcacagattctaacggttataataacagcactaataacggcgactataagcggtgtaatgggctttatattatcacatttattaaaataattaaggaggtgaaagagcatgaataataacataacagttggtactatagcaagaacaatagtattaattttagcactggcaaatcaggtgttagcgatgagcggtaagcaggtacttaatattgcagacgatgatatataccaggttgttagtatagtatttacaattagtgcgtctgtttggagttggtggaagaataatagcttttcatatgaagctataaaggtggacaaaataatgtcagagctaaaaggaaatgaaaactagaggttgacaaattgaataaataagtatataataatagcagataagagataaccgttaaacggttgtcaaagatttacgatattaatatagccgcaactttgaccgaggggcggctatatcgcttttatggaaacaatcacaaagaatattatgattgaaacaattacttttaataagtacttccacataagcgacacctcctttcagctgtgagaaacagcatatggagatgacaaccgtccttcaatttcctcttacctgcttgacagtattatacaagaatatacataaaaaatcaagttaaaatagcattacggaatgtcatctaggggcattctttttttgttataatataatagattggaggaataagaatggcaaagatatacatagacccgggacataactgcagcggagcggatacaggagccgtggggtatggattgaaagaacaagatgtatctgtgcagattggagtgatactaagagaattactattggttagcggacaaactgttaagatgagccgtgatagtattaccgatacagtatcaagcagcttaaacggcagtcttgcatacagatataacagtgccaacagctggaatgcagatgtatttgtatcaatacattgcaatgcggcaaacacaaaagcgtatggctgtgagacatattattgcacaggcagcacgcagggcagggcgttagcggaatgtgtacagccgaatatggccgcggagacggaaaggtataacagaggtgttaaatctgctaactttgcggttataaaacacacaaatatgccggactttacttttatatcctccagcctaaattctctgtactgttcattgatgtccttgtccatatatgccatagccgcaaaattgcagtccataacaagcctgtcaaactttgaatttccacatataactattggttttataataatcacctcacattacaattttatgtattcttttgctactgttatttttataatccctgctgcactccgcgtccgaaaagtcccaccgccgattatccggcttgattacgaccttacgcacatcgtcagctatgggttgttcttcagctgtgtcctctgcgcaattaaaaaatgccaaaagtatcatcataagcggagctgcgtaaaatatgggataccactcaagcgacctaaccataactaacaatacaacgccaaccaccgctcccgatattcgtataatccagttatacaattgatctcacctccttatatactcccagtatttcaaaactggcagaaccatacatttcattaaattgctgttttgccagctttgccgatacagattttacagttatatatttagttgcaggcgccccggtctttagcctatatttaatcaaaaaattatacatcctcaatcacctctttctatatcaggtcaaatttaatttttttaactaccatttaacatttaatagttagtttttttattcactcaagttttttgcaaacgtctcagccgaaatatattttttaccacccaaaaatgtgcgttttgcaaaatcataacaagtccctgtatagtcctgaacatccttaatacacaaaagatgacgtctatctccgtatttatcgccaagaaactgtaaaacgctttctaagttctccctatatgctgccttctccctcggcattttgctcactctccttcctttatttcacgtaagtatatttataactgtttatatgctcttgctcacgccatttataatacgccgatatatcaacataccatctgcaaccttgcttatatgccggaaaagcttttttatgtattcagcgttttactgtttgttcgtcaatcccaaaatattctttgaattgtctaagctgcatttgttgaattttgcattcttctatttttatttcacctccctttatttattttgattgatataaaatcccatttgtgctatactcatctcaaaggaggtgagtataatgcgagtatatgccaacttattaggcagctggaccgatataacagatacaggcactattgccaaccaacaagatccaactacctattttaaagaaaatctatgctatttagatggctctaaaaacgcaaaatgttttgaatacgactacattcatgttcaatacaacggcgttgattatagaattcatccggctatgatacaaattcttaatcaataaaacccttaaattctaaattaagtctactttgtacagcgttcgcattaggtagttccaacccacttgatgcttcgctgtatagttgttctatagcaatctttaatcttgaccactcatattgtttcaaccctgttaacaattctgcaagttgttcaattttctttatatccacttttctcacctccttatttgtagattaataatctacttagagttaaaaaaaattttatttctttctttctctgaaagtgataaaactttttttaacttctcaatttcactcgctttaaactctgatctattattgattttgttgtataaacacgcctctgatgtttcaagtatttttgatatatcacgttttgtaataccagcacgtgtaatagcaagttcaagttctaatgtatccgtcattaattaacccccttttttgtagattatttatcaacaaagttataataacacaatgtagattttttgtcaacaccttttttaatatttatataaaaaagttgacattcagtctacaatatgttattattaaaaagcgaaaggcggtaactaatatgaatttatatgatagaattaaagcaagaagattggagttaaggctttctcaagacgaacttgcacaaaaattaggatacaagtcccgttcaactattaataaaatagaaatgggaaaaaacgatattacccagagtaaaattaaagcttttgccgaggctcttgaaacaactccatcttatcttatgggctgggaagacgaagaaggcaacagcactcttgaaaaaaaatatgataacatagtccctattactacatacaaagtccctctgcttggcgaaattgcctgcggcaaacctattttcgcgaatcaagacctagaatgctatattgatgttacaactaatattaatgctgattttgctttgaaagcaaagggggatagtatgataaacgcaagaatatatgacggggacatagtttttattagaaagcaatgcgatgttgaagacggtgagattgccgctgtaattatagaagatgaggctacacttaaaagagtatataaagatactaatacaatcactttagtagccgaaaacgcaaaatataaacctattgtttaccgttccggcgattgtgtaaacgtacgcattctcggaaaagcgatagcttttcaaagcgatgtaatataacataaataagaattaataagacatatagaaattgtatacaaaagttatatataaaaagtcgcacccataaagggtgcgtggattgaaatacgtgcaaacatcttttttcggtgtgtgtaaacctggccgatttcgaccaggttatacatatacagcgataaatataaataaatctcagccaaaaataaaaggagaaaatatggaaaaaatatattatccaaatgaagaaactgtaaaaaatgcgatgcaaactgacgatccgctattactgttagttgctcatgacggcagacggttaatagtttcatccatagacgatgcaggagaacatcttatattattacgtttagcaggatatgaagatatggacttagacaaatattttagacttgtagtaaataaagatggagctgactggacctttgtatgtccaagtaattatgaaaatataaccaacaaatcaaaacgtatccaaagattttacaaagatggattttccatcataccattagcgttaaacgaaatcggttatatggttggtattgatataccaagacgttatcgccgccatattgatatgatgtaatggtatgtcctcctgggtgcgttaattatgctgcaggagaagttaaaataattggttgttgcaaaaagtgcaacaaccattcccacactttggataaaaaagcatcacaaatgtaagaagggtgaatacaatgaaaaaacgagccgatggaaggtactgtaaacagatacggattaacggaaaaattaaatccttttacggcaaatcagaaagagaaattaacagaaagattttagcctatcaagacaccaaagaaaaaggagaaatttttaaaactgttgccgaggaatggctcgacgaatatttattaaacacaccatataccacttttaaaaaatgcggaaaaagcgcatatttatctctattacaagagtttggaaatgaacggataaaaaacattacatcgcatgacgttgatatatttttaaagcggcttgccgcaaaagattacgcacagaagacagtggcaacatataaaagtgtttttaatcaaatatttaaatttgctatagttaatggatatgctaacataaacccggttacatctgtttcactaccaaagaatttaaaaaaatcaatacgtaaaatgcccgacaccaaagaaatagaaatcgttaacaccttacatgagggatttggatttttggcctactttctgttatataccggccttagaattagtgaagcgcttgctttgaattacgaagatattgacagagaaaataaaattataaatgtaaacaaaaaaattgtacatgacggaaataacccaatattaatatacgaaactaaaacagaatccggaacaagaacagttatacttttggacagagttgcaaaatatttgccgaataaaaaacatggcataattttctgtaacgagcatgaagactatttaaccaaaaaacagcttgcttgtcgctgggacaaaatgcgcaaagaaaataatttaacattaaccgctcatcaattacggcatgcttatgcgacaatgctttttgaggccggaatagaagcaaaagacgctcaagaattaatgggacacaaagacataaaattaactcaagatatctacacgcacattagacatttttcgaacggtaatatatataatagcgacttcagagcaggaaaacatgattttgctaatgttactgccaaccaatttggtgcgtcaattgcttctgtcttaaatatttatggatgtttgccggctattgctagtaaaatcaagggaaatactaaaagctataacttattcactgaaccggatgatgtatataacttgacacaaggaaatgctcatgaagtgaagcaatcaaacgcaatagctgaatattatcaggaaatgttaggacagtacacgaatgatagtaatataacgattaagaatgcggatttatcaaagtatgatgttcagcaagtcattgataaaaacctgcagtatagattccctgtagtagtgtataaagataatacagcaagtataatcacctcaaaaaatagtcagggaagttattgtataaatggaacgagttctgcaatatcaggaacatataatattatcgatacatattcgtatttgttatcaatagcaaataaaacaaatatagtaaactatgttgcggaaggcgaaaatctgtatgataatataaggtttacaaagccatatggttatgataagaatgatgttgaagtatatcaaaagttggattcaggttggagtaaaacaaatgttgttgaataacaggaatggtatgtaataccaacgccggagcctgatttagaaatagtaagaggagtgagaacagagtttgacggagtagtgccaaatatatataatgcaaatgaaaaatataaggtaaagaagtatggagatttgcaaggacaaacagaaacatggtactatccgtatttgtttaaggcaacaaatataggggcaataggaggagacgaccaaggaaacgtaaatgcaccgaatccggttacaagagcggaattatttaaaatattgctggaaagcgcagacgtggaattagaaaatgcaaatccaaatgctgaatattgggcgagaaactatatacggtatatgacgcaaaatatagatatatatgcagggaaagcaatcgatgacagttatttttacagtgaaatcccaagagatgagtcagcatatataataaagtcagtatttatgggagcagttgaagagacaaaagtaccaaacaagttatatacatatagtgaaaacatgtcatgcgaccaaatgagtaattggaacagcaataagggattgagtgataagtggaaaataaaccagtattatttagaggcggtaaggcagttatactgcaataaaataatggtgggagacggaaatagctttaatccaaaagatacaatcacaagagcagagatgtgtaaatcaataatgagctgcttatttacgctggatgaaggattgaaaaatgtaaaagttgtaaatgacggtgaaaagactgtatatattatgctttatgattctgagatagcaaaatacagcactgaaacgaaaggttttagtcgttatatgaataatttgggcgatgaataccaatatactgctgaatttttcaaaaattatttagaaatgatagggaacaaaaaggttgcgtttgttatatcaatacgtgatgttgattttgatgaaagcactattggatatgcaaatactgccggagatgaggatggagcagaaattataccttcatatgaaattacggatactagaatgaataatattataaataaaactacagaaaagtctataaacataataaataatataagtttaggattatctgcggcaaatgaacatagaacggataaaatacaaatgccggaaatatatttaggtactcctcatacaagtgcaaatgaagattgggttcaagtgtgggaacaagttaacgtaaatgcaaggcaaatttatttagataaatatagttgggtctctaagtctatttataataacgttttaaattcaataggggatggcattataacaggaatatactttggacgtgaaaatccagatgccatgtataaggatgacggaataactccaactatatcgtatcaaaatgcctcaaatataagtgattttatacacagtaaaaataaaaaactactatggataccattttcgactaccactaatgagtggtataatataggtatgtatgtcaatcatggaaagagctgtaataatggcagcagtgatttatttgatgtagttatgatgcaacctggcatttattattccaattatagcggaacatttgaaaatataaaaagttatgatgcatctatacatgacggagaatttggttatgataatcaaaaacgaaagataaaagacttgtatacaagttctgaaaaaaatcaagtatatatgtataacgaacctgtaggtgaagaaaacaaaataaccaatacaaatgtttcttttgaaatagagtatgatatttctttagttaccggacgtgtgcacggaagcaaagtaattcctaaagataaagctaaaagctttacaataacctataagtattataaagatttgataaatgattctaatacatcgtatgctatatatgcaggcggaccaaatgaacaaaattatagcagtttagtaccaggtagaaataataatttacattattttgtaaactttccaacatattttggaagtgaaaaagatggaaatccaaatgacatcggagatagaaaagaattttcatggtttcatgatgaaataataaaggaaatttcagatgcttattacgatgtagattatagcaatctaatatatgatataacaaaaggattattatatggcgaaaattactttagtgatagttgcaaaaaatatttgggttggaaataaaacaatgaaaggatgtaaacatgatgaagaataaattatttagaaaaacatttatctttataacaatattcgctatatgcttttcttgttatattgtgaaagcttctgacaatattataattgaatcgggtatatattttcaacttggaaaatataacaataaaccgattttatggcgctcagtagtatctgatgaccaaaacggaatattaatggttagcgacaaaattttatgttataaaatttttgatgtgtctattaatgacggaggaggtataaccaataaaggtttttgggagaataccgcaatgagggtgtggctaaattcaacagctgattccggtaaaatagaatggattggagaacatatcccctcatccgataggattaaaaaaaattatatcagtccatacaatgatgaaaaaggctttttgaacaaagataatttttctgaaagtgaaaaaagtataatgaatactgtaagtcactggcaatcgttatcaactaaaaatgctattgtttcagaaaatggattaaaaaagccgttttttccaaagattgttgagggagaaaattctcaatttgagcgtactgtatatagatataaaattgcggatatggatagggcatattatggagcaatgtatagagttaatgatacgataatgactcttgatgaaaaacaattgtttaatgttctaaaacaacttggaacaatttctagcgaaaatgctgacggcattactaattcagaaggtgatggaatatattggcttagaactcaatatacaggtaataaaactgtaacttatggtagtggatcaattacaacagctacaaaggatggaaattatggtctctcgtgggtagatgaaattgagttaggagtaagaccagcattttatttaaacgagaataatatgataattaaatccggaagcggaacggaagaagacccatatatattggacggaaaaggacaagaaaatacagcagttttctgtaatggaaagcaagtggaatttgaccagcagccaatagaggaagatgatagattgctggttccggtaagagcaatatttgaacaactgggtgcggaagtaacgtatgacgatggagatggagttataacagccaataacggtgaaagaacagtagtaatgcaaataaacaatcctgaaatgggtaatggaacggaagtgttcacactggatgtagcgccaaagctagtaggggatagaacagtagtacccctaagggcagtatcggaagcgtttgactgtaaagttgactggatagaagaattagacagagtagtaatagacccgccacagccagaagacactgacgaaggacactggcaaagcacatgggatataattattaacggaaaaggaaaaaaacaataagttgtgctaacagaaaggattaaacaaaatatgatttcctctgctgtaagttaaaattatggcagaggaaaaatatataatttggaattttgatatgttaattccacaataaatagaaagagtgggatagagatgaaaaaaattacttttttattaattgctataatcttatcattacaaaatatatctggttttgcttataataatataacagctactgtggaaaattctcagaatatagattcttttaatatgactattaataatggtgaaataggagttactactataaatcaacaaagctatgttgtatcaaaatgtagaagttttgcgtttgaaccaactatatatgatgaaataatagaaagccattttcccaaagaattgtatattgatattggagattatttttatacgcgtgagttaagttatgattatccatatattccggcaacatggaaatataatgttaatcctaaaataaaactttataataagaattttgaattagaaaaaattgcgaatttaggtgagacagcttttccgcgaaatatttggtatgaaaatgatatgtattattgttcatattatcaattttataagaaaagttcagatacatatgttcctgctaacgctagcgatatatactatggacagatagatactaaatatttaataacagttgcttctaaagatttcgaaaattggaatattatagatagtgaaaatataggtttatattctacaaaaccttacaataatagagtaattgaaaatgataaggtaaaactaaaaggaaatcaagtctcttttaaaaataataatatttttcagaatatattatatgaaaataatttatataataatataattactaaggttggaaatttgtttttaagtgtaaatagcgaaaatgatttattattatccattgataatatatactttatcaacatagttttaccggaagacgcatctaattttttaaagaatttaaataatggtttagctaatattttatatatttatgaatacaacgataatattaaaattcaacttggtacgtatgatgatttaaaatcaaaactggtaataacacaggaagatttaatacaaaatttaaatttaatttctaaatcaccttatataaaattaaataataacattttaggtttttcagagccgccagtaatagaaaatgatcgtacattagtaccgatgcggtttctgtttgagcagatgggagccgatgtaaactggaacgaagaaactcagacagcgacggcaacagttccaatagatactaatagacaaatgcgtacatttagcaacgaaaaagaaaaaagtgtaacattttctatagatgatacaacggcaacagtgaatggtgaaactgcaacaatggatgtaccggcaagacttgtaaatgacaaaacaatggttccgcttagattcttatctgaaaatttaggatataatgtagagtgggacgagactactaatactgcaataataacaactgaatagatatttattccgccgctcaaataaactgagcggcggagtaacatttaatttatataattaatataaattaaatgttacggtaaaataggaggatatagaaatgttaaaaaaaataaatttaagtacttatattattgtattattattattaattttaccaattaacgtgttagctaaaaacgaaataaatgctatctttgaaagtaaaagtacaggtacttatgaaaatatagaattgaaaactatttttgataataattatattgcaaatatagataaaaaaacgtacgtgattagtaaatgtaatagtccttattatataccaattgaatataatgaggaaatcgaaaatcatttttataatgaggaatatgtatttgcagatgattattatttcacacgtgaatgtgaaaatgatgcgagtataaattttatgtcacaaattaatttgcagaataatattaaactatatgataataattataatttaatcgttagcaaatcgtttgatggatatgtatataaaatatgttattatgataagaaattttattgcgaatacagacaagttttagaaaaccaaaccaattcatggggaggaaaaaaagttattatacatactatgatgtcagaagattttattgattggaaggatataggagaaaatcgtataccgaatacaaattcaaaagtatcatatataaataattctgtaaaaataaaaggaagtaataattttgtaaatgttatatatgaagatggatttgataaggttttagatacaatgtacggtgatatatttgttgcttcaaatataaaaaaggttgttacagatataggaacagaagcgacaagttatggcaataatttattgagttatgataacatatattttatagaaataaatacacctttagataatatgaaacaatattttataaatttttatgtttatgaaaatgatgattatattatttttgaaaaatataatagagatgagagattaaaaatattgaaacaggaagttgaaaataaattaaatttgataaaagatgcaccatatataaaattaaataatagcatcttaggcttttcacagccgccggtaatggaaaatgaccgtacattagtgccaatgcgttttctatttgaacagatgggagccaatgtaaactggaacgaagaaacccagacagcaacagcaacagttcctattaatactaatactcaaatgcgtacatttagcagcgaaaaagagaaaagtgtaacattttctatagatgatacaacggcaacagtgaatggtgaaactgcaacaatggatgtaccggcaagacttgtaaatgacaaaacaatggttccgcttagattcttatctgaaaacttaggatataatgtagagtgggacgaagctactaatactgcaataataacaactgaataaatttttattccgccgctcagtttatttgagcggcggagtatcttttgttgtatgccggtatatacagaagaggaaaagaagtttgaccagggttcaacaaagagatgggcaagttcagttgaaggataaagaataatgacgtagatgttttggtaatggatttggtgctgccgaccatagacggaataggagttcttgagagaatcaacagaatgcagctgaataaacgtcctcatgttctgatagtaagctcagtcttgaacgagactgtaacgtcatattccaattcatacggcgttgaatattgtatgttgaagcctgtcaactatgatgcgctgattgacagaatcacaatgatggcggctccgataaccacaggcgaagatgtaatgcagaactggaaggtgaacacaaaaaagtttgactatgcacaggtagaagcaatggtgacaaacgttatacatgagataggcataccggcgcatataaagggataccaatacataagaagggcaataatgatggcgatatatgatttggatataatgaactctgtaaccaaagaattatatccaaccatagcggagaacttcagcacaacgtcgagcagagttgaaagagcgataagacatgcgatagagctagcgtgggatagaggtgacatggacactctgaacaacgtgttcggttacacagtatcacaaataaaaggaaagccgacaaattcagaatttatagcaatgatagcagataagttaagacttcagcttaagaatgcttcttaagattttataattaatttttgtataatataggtatataataattaaaaaataaaatacaagaatttatatattcttgtattttatttcaaatcgtgatttaatttctttaaaagcaatagtttttagaattgtttataattaggtcttattcaatagaagttgctcctacttaagttatgataaaaagtataaatatttgagtgaatcaaattagaatctcatttgataaaaagaaattcaataatagttaaatttaattcaaaatgcaaaaaaagtaataaagtcaattaagtgattcttataatattattttttgcgactgcgcatatattgggatgagtataaatttatgactggcatataaatattgattatgtctaagaattaataaaataaattatttatattattaatactccaaagcctgtcacagacattctaagattactatcatattaattttataaatacatgttttggatatagtacattgtaagttgataaaataagttaatatatacgtcttatgctatgattaaattatgaaataaaacattaaatatttccttatcaatacttatcatagcatttttataaaaacttataaaaatatttgttataagtttaaatatttatttcggtttgcatttgccacagggttgatagcctgattttatggcttcatctatagtcatatatattatatttggcttatcttttatataactgcagttaaggtcatgatattttgttccgcttttggtcactccgactttttcttgattgacactaattgacggtgaaggggatgtttcagatatactcaatgtaggtgtgggagaagattcataatcatcagcttcatttgcttggatacttataggggatggataaaactgagataaaaatataaataaaacggtaacaataattattgttaaaacacttgttgatataattaattttatatttttatatttcccgggcgatttaattgccttaaattttttgcagagttcaatttcagcattactatatttattatgattatcaatctttgttaatatttcataacaatgttttttatcaagtaaagaaaacatagaaatatcttcaactgttgatatacgatttacagataaaacgcatattggggcaaggaattcaagagcgaattcgtttgcttcgcgttcttggttatcatcaagaagtccattttcctgaaaacctaatattccatgcttagaaaaatgccccattatatcgtgaccgagttcgtgagctaatgcgaaacgttttcctgcatttgataaattgttgcgataaaaaagtatcatattattatccgttttaatgctgaatgcaggtgaatatttggctatatcaagtacacccattcttttaaaaatatctatataatcagaagaattaatatcataactttttattatccagcctctgtcaagcagtatggactcaatgtcgtcaacgagtatgggaaattctttaatattatattgtaataaagtttgaattgcataatattgtgctgtcatcattatcctcccattttgtataatgataacgacaaaaagtatttaaataaaattaaatttattataaattaatctatattgtcaatgttttcatcaatcttattagattttaaatttttgaccgactgtcctttagcagcaatttctccgtattcagtatcaatttttaatatttcatttatgcctttgtctagttcatctttttgtttatttaatgcgtattcttcaattataggtttaatttgttcgataaatttagttttaagtttttcatcagagattaaatttactagttccaaaagttctttttcattttttgttaatttattatttaattctgaattgtcttctatagattcatcgctgggaattttattgtcaatacccagtatatcgtcggcagaaactttaaaatattctgctattactgttattttttcccatgcgggatattttattttattttctaaatcataaatatagtttctattaattccacagtcttttaaaacttttttgattgatttattgttttttaatgctagttctttaattttttttgcaaattcggatccagttatcatttccataatatcagcttcttccaattcacacttgtttatagtaagactttataaataaaatccgacaaagttagaaaaagtttaaccttctttgtcataaattaacaaattacagataaaatctgcatttttgttgactacagaaatattctgtattataatattaataacttatttataaagttagacaaataaaagaaaacttgcgcatatacaatggcaaatttattcgacaaaattattataatatatttttcatgagtatgcaatagttttttattaaagtgaggtgattatggtggtaaatgaaatcaaaattagattactaagactggaaaaaagacaagtggatttattggatgctatcagaaagaggggattcaagaacttacagccatcaacacttagtcaatatatcagcggaactattacaggcccgcaagccgaaacggtaataaaaattatatatgaaatattagaaagctgggaagaagaaaagtctacttatgttagataactgttttctaattataaaataataaaaatcgagtggaagataaataactccactcgatttaacaaagtttgtaatataacaaacaaaattagctaaacttattcgccgtcagattctcttgaattgtttgaaccactatttcttcttcctgaattattttcggtgttcttagactttgaaactcctgatgacacactgacgctatagtctatatctatacttctatttttcttttttattgtcgaatgtactttgtccataacatttttccatacaggaatacaagggtttgatgacatttctattgaagccggcgtatcatatccataccatactgaagctacataatatggagaatagccgataaaccatctgtcaaagttttctgatgttgtacctgtttttccggcagtaaaggttccgtctgacaatgccgctccgcgtccggtgccgctggtcacaacactgttaagatatctgttcattattgcggcggtctccggctttattgcttcccaggtagtatcgctgtctctgccggtcaagattgtttcaccgctttcatttttaatttcagtaaatgtgtaaggtttattatatacaccttgatttgggaaaatgcagtatgcagcagtcatttcaatatttgtagcgccgtgagttaaaccgccgagcgccaattgtgcatatccaagatctgtgtaaatttcaccgtttatttcttctgcttcaacaagagtagtaaatccaagtttctgcgtcataaaatcgaacgaagtctgaatgcccatgtccgacattatttctacaggcactgtattcaaagactgctgaagagcatagtcaagtccaacttctgaattactgtaagtgtaactatagtttcttggtacccagccatcataggattttcttttatccattactcttgtacttgtgtttattgttccattatccagtgcgggtgcgtatacagctaatggctttattgttgagcccggctgcctgggactttgtgctgcacggttcagagtaaaactggcttctttttcaccaattccgcctgccattgctacaactctgccgtctgatgggtcaataataacaattgaagactgggctgaggaatctgggaaattatttgtattataatagtattcttcaactattgattgaatttccgggtcataagcacagtaaattttaagaccgccggaatataccatttttgttgcaagactttcagaatagcctttttcctgcaatcttgatattgcatcacgtactacttggtcaacataatatgatgttattatttcctcttttttagtagcagccgtatctttactgaatgtaagaggatagttaactgcttcatcatattcttcctgagttatataaccaagtgaaagcatctttgctaaaaccaattcttgtttttctttatttttatccggatttatgaatgggtcatataatgccggattttgagtaatagatgcaatagaagcgcattctgccagatttaattgacttacatccttatcaaaatacaaatttgcagctgtttgaactccatgacagttttgggataaaaatatacaatttaaataaagttctaaaatctgatctttagataattttttttctaagtcaatagcttttgaaatttctgaaatttttctggaaattgtttgttcgtcatcaccggttatattttttataagctgctgcgtaatagtactgccgccaagagaagcttggccgcctttaccggttagtttatctaaaaaatatgttaaagtagctttaagtgttctttttatatctactccattgtgaataggaaaacgttcgtcctcaatagcaataaaggcattttgaagatttttaggagttgcgtccagatctacccaaatcctgttttcatcagaagataatgttaagagattcttttcttctcctgtattgtgatcaagatatactatgtttgaattgctgtccattgtcagtgaatccaaatcaatgccgtcagtatttccccacatgcccattacagcagtgagcacagctcctccggcaacagctcctccaataataattgtaattaaaaatattaaaataaattttccaacgtattttcccattattttttccccttataaaatatcaatcatcaaaatactacatattatactatataattatatcacataaacaggtataataaactataaatctgttaataatctattaaattagtgttacagcaaatatgataacacaagatatgggggtactaattatgtataaaaagttagtcaaaagtattatcatttgtgtttcagttgtgttctttactttgatgattggttatataacatattttgcaactgtaaacgttataaacaggtctgtcactaaaaatttaaattctgctgaagcagttgcatcgcaaacaacaccgggaatgcaggaagcaattccaagcagtacacccggaaatgagcagtattatctcgcacgccttaatggaaacagcattgaaatatatttgtgcagtaatacagattcagcaaaagcagctgaaaaatttttatactcatttaaggtatatgcgtcagatatccctgacgatgatattttaaatttaacgcgcggaataatttttaaaactaaagaagaattagcgtcttttgaagaagattacaatagttaaactttaaaaggttactaatgtttcattattatgtttgttcagacgtttctaaatacttctctaaagtataatataattcatctgcatcaacaggtttaatcacatgtgaattaaaaccattatttaagattttttccacatcatcctcatatacgtcttgcgacatagctattatggggatagtagaggagttagcgtgcttgctttttctgatagtatttgccgcttcatacccgtccattataggcatatctacatccataagtattacatcaatatccttatattgagctttattaaaagtatatactgcttcacggccatttttagctatcatagttttaaaattaacagttttaagaacatcgtcgagtatagcaagattaagttcgttatcttctgctataagtattgttttaccggaaaaattatattcttcaggtgatttatatacacgaacttgtttgccgtccttttcacaaatttcaagaggtatcgtaacagtgattgacgttccttcaccttcagtgcttatagcagaaatatttccgttcatcatagaaatatacttttttgtcattgataaaccaagaccgctgccattttgtgcagaatcattgttgtaattattgctaaatactttatccagtttatccttgctcataccaataccggtatcacttacaacaaattcaaggatagcataatttttgtcgccggatggtttttgtgttgattttaagtcaatagtatttccattttctgtgtatttaagcgcattagtaagcaaatttgatagtagtagacctagcttatatgaatcaccataataattattttcagtaatatcatacctgttttcagaaaaagtaatatttctctcattacaaagataagaaaaagtctgtcttagatcatttagaacgcggcttagtttaaatggctcatgatttatttctaaagtctgtatatctagattagaaatattaagcaattcatttacagagttaaagagagtgtgtgctgtatcatcaattgcattaatattttgtttagttttttcagaatcattaagttctttttttgttctgttaattaaagaaataagagtactcataggttgttttatttcatttgacacacaattcaaatattcagattttgcaattccgtttctttcagaaatttttaacgcttctttcagtgtagaagtagatatttccaattttctgtttttcattctcgattcaaaccatttaattacaaattgtatcaaaagaagaagtatcattattaggatagagccaatagcaagaagcttaccatatttctctctaaatgatttctcataattaacatatatagaatttgaaggcaaagacgaactgcttatatgatattttttcattactttaaaatcaaatttatattttgaacttgaattttccgataaaggtatttcggatatattttgtctattaattattgaatttacagtatttgctgcaattatacctgactgctttgaagacaacactgctccacccaaataaccgttaccaatatttaaatcagttaaacaaaaggttggaattgttgtattttctgttattagcttgcacacttcataatcggagtattgctttttatcaatagtttcattcatatttaaatagaacagtatactgtcattattaagtttagaaagagcggatacaaattcttcttcatttaattcagaagaattaatatctttgaaaatgatattagaaaattgttcctgctcagcataaaactgatctctgtcaccgatacctgttaatgtattatcagaaatagcaataatattttttgcgtcaggataaagatttagtgctgtatgaatattgttttcaatatttaatttttctatagaaccagtaattaacggatccattgctgctttttcagcaataaatttgttttcaattccttcaaagattatgggtgtattaggaaatagaacatttttgtattttaaaactaagtcaagcgcttcatcgtctccaacgataactatatcgaaattgtttttatatgaagaaatatgatagttaagaatatcataaaataatgcgtcgtttttattatcatttattatatttgaattcaaaaattcactttcaagtgtaactgagccgtcaagtgtttcgcgtataccttcgagttgtttaagaaccgatgtgtttgagggcgagtatgaacttataaataaaacttgtatgtttttatctgaactaacattgttattttcctcgctaaaaccattagtataactagtagagaaaataataaaaattatggtaaaaaacataaagtattttaacttttgcatgtgttttgttttgaaaataaacattgtagttgcccctttaatttacatatatggtatcattatgatagcataaaaaggtgtgtcgcgcaaggtttatttttttcgctaaaaagcattataatggtgagttctcttttgagcatattttttaaaaaatgtgttgaattataggtttcaaatgtggtacaatgtgagataagtgttattaataaatacattattatctgaaggaattattttatagcacggaggtgtgttatggattttaaagttgtatcaaaatattcgccggccggcgatcagcctaaagctattaaaacattagctgacggtattttaaatggtgataaatttcaaacgcttttaggagttaccggaagcggtaaaacttttacaatggcaaatgtgattgaaaaggtgcaaaaacctacgttagttttagctcataataaaacattggcggcgcagctttgcagcgaattcaaagaaatattccctgaaaatgcggttgaatatttcgtatcatattatgattactatcagcctgaggcgtatattccttactctgatacctatattgagaaggacgctcagacgaatgatgaaattgataagcttcgtcacagcgctactgcggcattatttgaaagaaaagatgttattattgtagccagtgtttcatgtatctatggattgggtgacccaatagactataataatatggttatatcactgagaccgggaatgataaaagacagggacgaagttattgcaaaacttatagaaattaaatatgaaagaaacgatattgatttttcaagaaataagtttcgcgtaagaggagatgttttagatatatttccttctgacgcatataatacggcagtaagagtagagtttttcggagatgaagttgaacgtattacagaaataaacactgtaacaggtgaagttattggtgaaagaaagcatattgcggtatatcctgcatcacattatgttactacgcctgagaagcgtgacaatgctataataagtattgaaaaagaattagaagaacgcttaaaagaactcagaaataataataagttggttgaagctcaacgactagaacagcgcactaaatatgatatggaaatgctgagagaaaccggattttgtaatggaatagaaaattactccagacatatcagcggcagagaaccggggagtcctccgtttacacttattgattatttaccgaaagattttttattgtttgttgacgaaagccatgttacgctgccgcaggttagagcaatgtatgcaggtgaccgtgccagaaaagaaaatttggtcaaatacggatttagattaccatctgcttttgataacagacctctcaattttgatgagttttggggaaagctgaatcaagcagtttttgtatctgcaacaccggcagattttgaaaaagagcaatcgactcgtattgtagaacaggtaatcagacctaccggtttgcttgatcctgaggttgaagtcagaccgatagatgggcaagtagatgacctttacacagaaattgtcgaaaggacaaaaaataatgaaagggtcttagttactactcttacaaagaaaatggcggaaagacttactgaatattttgacgaccttggtgtaaaggtaagatatttacactcagatgttaagactattgaacgtatggaaattatcagagatttaagacttggcgagtttgatgtattagtcggaataaatcttttgcgtgaagggttagatatacctgaagtttctcttgttgctatactggacgctgataaggaaggttttttaagaagcgagacatcgttggttcaaacaataggtagagcagcaagaaacgcaaaaggaaaagttataatgtatgcatacacaattactggttcaatgagatatgctatagatgaaactaatagaaggcgcggtatacagattgcctttaataaagagcataatataattccacagacaataaaaaaagaagtatatgaagttattgaagctaccactgaattaagcaggtcagaaaaaggaaagacagcaaagaagaatgaacaaaaattaattgataaggaacgagcaattgcagaattaactgttgatatgaaaaaagctgcagagcttcttcagtttgaattagcggctcagatacgtgatgaaattagaagaatgcaggaagaataagcgttataataggagttgacataaatatgaacaaaaatataattgtaaaaggtgcaaaggaaaataatttaaaagatattgatttggaaataccaagagataaacttgtagtttttaccggtttaagcggctccggaaagtcttcacttgcttttgacactatctatgctgaaggtcagcggagatatgttgaatctttatcagcttatgccagacaatttttaggtcaaatgagcaagccagatgttgaatcaatagatggtttgtctccggctatatcaattgaccaaaagacaacggcgagaaatccgcgttcaacagtaggaacagtgacagagatatatgattatatcagattgttatatgcgagaataggtgtgccacactgtcctaattgcggaaaagagatttcgccccagtccattgaccaaattgttgactctgttcgtaatctgcctgagcgtactaaaatacaaataatggctcctgttgccagaggacgaaaaggcgaatatgtaaagacgtttgaagacgcaaggaaaaatggatttgtaagggcaagaatagacggaaaaactgttgaaatttctgatatggatattcgtcttgataaacagaaaaaacataatatagacatagttgttgataggcttattataaaagagggtattgataaaaggttggctgattcattggaaacagctttaaacatggcacatgggcttgtgattgttgatataatagatggagaagagttaatgttttcacaaaattatgcttgtgaggactgcggtataagcatagaagaactcacacctagaatgttttcttttaacactccttatggtgcgtgtccggaatgcgcaggtttaggacatattattgaaatcgacccaaaccttattatacctgataaagaattatctataaaccaaggtgcaatagccgcaagcggttggaacggaactgacaaaaattcgatttcgtatatgtattacagaggtttatctgaactttatgaatttagtcttgatgagccgattaaaaatctccccaaaaaaatacttgatgttatcttatacggaaccggtgaccaaaaaataaagctgacctatgacaggaaattttcaaaaggagttcagtatgcaagatttgaaggaataattaataatcttgaaagaagacataaagagacaaattctgactggatgaaagctgaaatagaaacctttatggtggatatgccctgtccaaaatgtgaaggagccagattaaagccggaatctttggcggtcactattggaggtttaaatataaatcaagtaagtgatatgtctataactgaagcttacgattttttctctaatataaaaatcagtttatcaaaaaaagacataataatttccgaaaatatatttaaagaaataaaagagcgattgaaatttttaaaaaatgttggattggaatatctgacgctttctagaagtgcgggaacgttaagcggaggtgaagcacagagaatacgtttggcaactcaaataggttcaagcttaatgggtgtcgtgtatattctggacgagcccagtatcggacttcatcagagagataatgataaactgattgagactttgaaacggttaagagatttaggaaatactttgatagtggttgaacatgatgaagatacaatgcttgctgcggattatatagtggatataggacccggcgcaggaatacatggcggagaagtcgtggcaacaggaaccgccaaggatattatgaaatgtgaaacttctttaacaggtcaatatttgtcaggcaaaaaattgatacctgttccggaaacacgaagaaaaggaaatggatttaacttagaaattaaaggctgtcaagagaataatttaaagaatgtcaacatcaaaatacctcttggaacttttacttgtataaccggcgtatcaggaagcggaaagagctcatttgtaaacgagatattatacaaacacttatcaaatgtattaaatggttcaaaaaagaaacccggcaagtttaagagtataaagggtgaagaaaatttagataaggttattgatattgatcagtctcctatcggccgtactccaagaagtaatcctgcaacatatacaggtctgttttcagatataagagagttgtttgcggcaacccaggaggcaaaatcccgaggctacaagtcaggaagatttagttttaatataaagggcggaagatgcgaggcctgtaccggagacggaataattaaaattgaaatgcacttcttacctgacgtatatgtgccttgtgaagtttgtgatggaaaacggtataatagagaaacacttgaagttaaatataagggtaagaatatttatgaagtactggagatgacagttgaggaagggtgcagcttttttgaaaatgttcctaaaataagcagaaagcttcaaactttatatgatgttggactgggttatataaaaataggtcagccatccacaactctgtccggaggtgaggctcaaagagttaaacttgccactgagctcagcagaagaagcacaggcaaaacaatatatatattggatgaaccgacaacaggactgcacactgcggatgttcatatgcttataaatgttttgcaaaagcttgtagatgcaggaaatacggttgtggttattgaacataatttggatgttattaaaactgctgattatattattgatttaggtccggaaggcggagacggcggcggaactattgtcgctaaaggtactccggaaaaagtggcaaaaaacagcgcatcatatacaggtcaatatttaaaaaaatatttagagaaaaagaacgaaaaagctaaaatataagtgtaggtttgtcaatgatgtgttacaaaaaagattaaaagagttcaccgaaattgataaaagagttgatgtagtcaatgggagctttccaattataaagaataatgacgtagatgttttggtaatggatttggtgctgccgaccatagacggaataggagttcttgagagaatcaacagaatgcagctgaataaacgtcctcatgttctgatagtaagctcagtcttgaacgagactgtaacgtcatattccaattcatacggcgttgaatattgtatgttgaagcctgtcaactatgatgcgctgattgacagaatcacaatgatggcggctccgataaccacaggcgaagatgtaatgcagaactggaaggtgaacacaaaaaagtttgactatgcacaggtagaagcaatggtgacaaacgttatacatgagataggcataccggcgcatataaagggataccaatacataagaagggcaataatgatggcgatatatgatttggatataatgaactctgtaaccaaagaattatatccaaccatagcggagaacttcagcacaacgtcgagcagagttgaaagagcgataagacatgcgatagagctggcgtgggacagaggtgacatggacaccttaaacaacgtgttcggttacacggtgtcacaaataaaaggaaagccgacaaattcagaatttatagcaatgatagcagacaaattaagacttcagcttaagaatgcttcttaagattttataattaattttttaattttactaagaataataggtacaaaaaatgaccgaaaaataaaacacaaaaattttgtattttatttcaggtcattttttattgccatttttattatgtagtattacaaatttgatttaatcgtcttccccaaagggcaagacgatctcgcccgggctcggcgggcgaaacagggcctggcgcagcaaagtaagcaattataaattaattaagcggattagagataaaattaaatatacccgcgactgcgcgcctaacgaggaggactttgtcctcatttgagtatacatattaatatttgcgtattcatattattctttgagtattcatgttattgacattgtaggctataataaaacaagtcactttgtatcatacccacctagaaggtggggtcgcagacattgtaggtaaatcaaaataagttattttgtatcacacccaccatactggtggggtcgcagacattgtaggtacaacaaaataagttaatacgtataacacacaccctccaggtgtgaaatatcacaactaagttatttattgacattttaggtttaatggtaaatagatattgtggcgcatacgcaccttccaggtgcggtcacagtcacacctaccgatgcttgctaagcagcttctagttttgtgctttaagctaaaacttttttgccatacgtcagattttaatatatttatacaatttccccttttctcagctttgtataaaatacttttatataagtcggcaaattattatactcattattaatgtttgtaagctgctgatatgtaatattatggcttttaagcaaattttcaaaatccgctttatcctgttttactttcttttctatttttttgtttaacgcagcattatatcctttaagctctgacatcaaatcatatacagttttatcctcatcaatctttatacagaaattttctgtatcttcaaaagttttaaactgatataacagtatcgaatgcagttttgtatgtctgtatctgtcccgtatgtatatactgaatggattctctgatacatcgtagccataccagctatggtcttttacaatgcagatagaatactccttccgttttataaagtcgttttttgccaagtagtcgtgggcaatcatgtttacataatccattttttctctccttatatatttgtttccggtctccgcagctaagatatagttttggagccggtttttaatttttttgcgtggttattgagatattggttccatcgctttccataataatatcgccgtttaaatctgttcgaaaaacttctgagccctcgtctgacagacggctcagaacagcttctgacgggtgaccgtaactgtttttctttcccactgatataaccgaatattttggcattacctcacgcaggaatacatacgacgttgaagtttcagaaccgtggtgacccactttcagaacatcggctctgagattacagccctgttctataatattttgctcctcttcgcgctcagcgtccccggtgaatagaaatgatgtgttgccgaaagtgattttacagataatagaagtattattcatattgcttgagcctaagccggcagggacaaagaattctactgtgcagccgccgaatgaaattgtatccccggattggggatgaattatttccaatccctgttcggcggccttagttttaaagttattatatgctttgctggtgctttcttttttgggggcaaagacgtttttgacttccatagtggagagaggggcggatagaccgccgacgtggtcctcatgggcgtgggagcaaatcatataatctattgaagttacgtttagctttttaagataagagaataacagactgctgtcggcggcgttaccgccgtcaataagcatagactctcctccgcagaggagaagtgcgcagtccgcctgaccgacatcgataaaatgcacggataatttatccgatgaatcaacagacaaattatctgcataaaaagaagctgcaggcgttggctcagataattcaggccggataaattctgagttttggcaacagctggttattaagaatatagataataaaatactaattaataaagaatattttttcatagatatatccgcaaaagtaagtgaaaaataaaagtatttataaaatataaatatatggaatattaggatacagaactatgtaatatttcttatagacatatttactaacgattttatagtaaatggagttgtctcgcttagttttgcgagaccttttacattactgactgctatattaaaattatgtgatggatttttcatattagaggaagtataaatttttaaatcatttgttctaattaattctgatatgcaaaaatttaaaatatcagaaacagaagcatcgtaagttaaagaagcttcttctaaaaagttatataaatcatcctcaatttcataagttttgcgtattcttttttctcttttagagaatttattatttaaaaatttattattcatcttttgctacacccctcatatgacccaatattacaatattttcaaaattaatttaactaccgtcaatacaataatatataagaaatatttctacatatcagaatgtatattatgaataatttactagataaattttacacagtagttatgtaaattttgtttactaatgttgttatataatgtcaatctcataatattatttgaaaatattaagcaacattaatatataataaaattaagtaatatgttgaccacaatattggtcaaaataaaaaagttatatagcaagcatcggtagggcagacgtagtctgccacgtaaggcgcgcagtcgtggaaataaataatataataaatatcatttcagcaaaatacatttaattaatcttataattacttactttgttgcgccagacccagtttcgcccgccgagcccgggcgagatcgtcgtcccctacggggaagccgattgttgagctacaacattataaatgtgacattggcaggacaacatatgaaaaatatgaaagcggagagttaaatattcgcattagtgtgttagtagcattgcgagagatatatgattgcaaatatgatgatttttttgaaggattagtagcagaaagaatagatagttagttttttatatatttcataacaaaaaaacggattatatagcaagcatcggtagggcagacgtagtctgccacgtaaggcgcgcagtcgcggaaatatgtaatataataaatatcatttcagcaaaaaattatttaattatttttataattacttactttgttgcgccaggcccagtttcgcccgccgagcctgggcgagatcgtcgtcccctccggggaagccgattaaaataaaaacataatagattaaaaaatgaccttgacatttagaaaaaaaatgatataataaaagcagataaaaggtaaccgttaaacggtcagccaaaaattgtgattttaaagtaaccgcaatccttgggggagggcggttacttttttattgattcaatgagagtaatgaaaacaatcataaaaataattatgtaaacatactccatataaatcaccccctttctatcactaagtaagtgatagagggaggctaaccgtcctacaatttccttttacctgctggatataattatatatgtaatattgaataaagtcaaattaaaagtattttacataaaagcattaatagactaaaaaatgaccttgacaattagaaaaaaaatgatataataaaagcaatttaaaggaagctctcttcgacaggctcagaggtagctctgaacccgcaagcaagcttgctgattaaagataaaaggtaaccgttaaacggttagccgagtttagttattttaataaccgtgacccaggcaaaggcgcggttatttttttatagattcaatcatacatgtaaaaacaatcataaaaatgattatgtacatataatccatgtgaatcacctctattgtcattaagtaaatgacaatagaggttaaccgtccttcaattttcttttatcttcaatcagcaagcttgcttgcgggttcaaagctgcctctgagcctgtcgaagagagcttcctttaaattgctaaatataatattatatttgatttatcgaataaagtcaaattataagttttttacataaaacatataatatataaaaatgaccttgacaatttaaaaaaaaatggtataataaaagcagataaaaggtaaccgttaaacggttagccaggaatatagttaaaaagtaactgctatcctagctaagagggcggttacttttttattgattcaatgagagtaatgaaaacaatcataaaaataattatgtaaacatactccatacaaatcaccccctttctatcactaagtaagtgatatagggaggctaaccgtcctacaatttccttttacctgcttctataatattatatttgatttatcgaataaagtcaaattaaaagttttttacataaagacatataatagataaaaatgaccttgacaactttaaaaaaaatgatataataaaagtaggtaagaggtaaccgctaaacggttagccgagaattgggattttaaagtaaccgcaatccttggggtaagggcggttacttttttattgactcaatgagagtaatgaaaacaatcataaaaataattatgtacatataatccatgtgaatcatctcctttctgtcattaaataaatggcaacaaaggctaaccattatctttattcagcaagcttgcttgcagtttaaagctgtctctgaattatatttaaatgaaattttaaaaatatatttaattatttaaacttcacacctcgctgctgtgcagcattcggttcctatgttttgcccgaactttgggcggctttccatttcggaaagccgcttttttatatgaaaattaatgttttttaaattaatcaattcttttacactttcgtcataattttttcatatcttccgtatataatgttaaacatagcaaggagatagaaaacttgtttattttcaaacagttaaattttttatatattatataggaggtatcagtatggacgagttcaaaaaagagtttgatatgacttcaggcgacggagcagaaaattctgtgaccgaaaataataatgataattcaaagagtgagcaaacggcggcgtttgaaatgaacgaagtctcaactactcaggaaaatataccaagtcaggcggaagctaaaatagaaatcagcgataagacagaaaatacagcttcttcaactgaaacagcatcgtatagttacagcggttcggctttgggcggcaatgcacgtgaatcttttaatcaaaacagtcagtattcgggaacaaattatcggaaccaaaacagtcagagccaatcggcaaacacctcatataacacccagggttcaacttcttatcaaagcggaccttacagcaatcaggcttataataacggatttaatgccgcatacaagtcaaacgggaacggaaaccccggagttccgtataatgaacatataaacaagaaaaaaaccgataagaaatcagtcagatatgttgcggcacttgtggcggcggcggttctcaatttagcagttttgggcggcgcgtttgctctcggtcactcgtttggttcaaagagcggaacggtgacaaacaaaaccactttatcagaacagcttaaaaccgacgacggacagtctagcggaggaagcacaggcggagcgacaagcaccgcttcaaccacaggaagcaaggacacaacagagatagcaaaggaagtcggcccggctgttgtcggaataaagagcacggttcaggggcagatgagtttgttcggcggatacagcacatcagaagcacaggggtcaggcataattatcagcgccgatggatatattgtaacaaacaaccatgttgttgctgattcaagttctgtatctgttcagctcaacaccggttctgaatatgcggcaaaggttatcggcgcggatgaccaaaccgaccttgcagttataaaaatagagccgacagaagaacttacagtagcgaacctcggcgactctacaaaagtagaggtaggagagacggctatcgcaataggtaacccaatgggtcttgagttctttggaagcgtaacacagggaatagtcagcgcggttaacagaactgttcaggttgacaacagaacaatgaatcttatacagaccgacgctgctattaattcaggaaattcaggcggagcgcttgttaattccaaaggcgaggttataggcatcaacgcggttaaagtaacaactaccggtgtagagggtatgggatttgctatcccgatttcagaggcaaagcctattatatccgaccttcttgactatggttatgttaagggaagaccggttataggattgtcaacacgtgacgtatcggcgtatatggctcagcagtatggatggcctcagggcgcgcagattatgtctgtaacaacggataatgcaagaaacgcaggattacagcagggtgatattatcaccaagatagatgataagaccatatctaaaggctcagaccttactgagtataaagatacaaagtcacccggagatacggttaagctggaagtttataagtatgctacgggcaagactgagtctgtttcagttgttttgagcgaacagattcctgactaatatactgttatcaaattcggttaacggagaaatcgtaatccgattatatatacggcaggatggtgcggcggaagcggcgccgtttctgccgtatacttgtctgttaagtgaattatgtagtattgtatataaaagatagattgtcaaatagattattggacataattgtgtaggtttgtcaatgatgtgttacaaaaaagattaaaagagttcaccgaaattgataaaagagttgatgtagtcaatgggagctttccaattaaataattctaccagagtggaaaagaacatgctgggtcaggaagtaaagacaatagatccaaagaaaaatgagagttcggcaaagtatgacgactttggaagacagacagaagtaaagagcagaatagacggaggagacagcataaaaagctacagttatgacaataacggaaacgtaataaaagaaagcataacaagcaataagccgggagaagcgttgacgtacagaaatgtgtattatgaatacgacaatatgaacagactggtaaaaacatacacagacgagccgggagagacattgtatgagtatgacggaaacggaaacataacaaagatgataacagggtcagtgaacggagaaggaggagtaagcacaacatatgagtatgatagccaaaacagactgatttcgagcacagacccaatgggatacagtgaaagttatacatacgataataacggaaatattgtaagcaaaacagacaaaaacggaacagtgacaacaaatgtgtataacggaataaacaaccctctgtcagcaacaagcgaaagagacggagaaacggagacaacaacctacacatacgcagacacaagcacagcgctgctgagcatagcaaacgaagcggccacaataacctacagctatgatagaaaaggacaagtgacgggagaaagccgcacaacaggagaaacgctgagctattcatacgataaagacggaaaccaaacaggactgatactgaactcaaccaacggagtaagtcaaaacataagctatagctatgactatctgggaaagatgaaagaggtaagggataacctggaaaacgagctggtggcagtgtatagttatgatgaaaacgggaacctgacagaaaagaaaaccaacggaaacacaatggtaacgagctacgagtacaatgagagcaacctgccgaaaaaggtaagcaatcaaacagtggcagacccgctgcaaaacataaagggaacatactcggagtataactacagctactacctggacgggaaccagtcgtcagtaacagacatattcggaaagacaaaaggctatacctacgacagcgccggcaggttgaaacttgagacaataaaccgtaacaatcagttagaacattcaacattatatacgtatgacgaaagaggaaacagagcgttcaaaaaagataaaaacggaataataaatgaaaatgaaatatcactgatggactaccatattccgtggagctatgaagaaggagaaggagaaacaagctatgtatatgatgataacaacaggctgacataccaaaattgtgaatatgggtattgtatgagtaacgagcaaaaatatatgtatgattataacggaaacatgacaagtaaaaatacccacatatattatgataattattcaccggatgaacatttccatacagaatatgaaaacacaacaagagattacggatataaccttcagaataagatggagagttatgatggaaaagaccaaacagcaacatacgcatatgacggaacgggaacgagaatagggaagacagtaaacggagtaagcacaggacaaatatggaacaatggaaacgtaatagccgaatacggaacaaaaggaacaaagacgtatatccgaggagctggaggaaaaatagtaaagacaaaggatagagcaaataacagcagatatttctcatataacgtccacggagacacaacaaacataatagaaaagaatgcagaaagtacatcatttgcagtaacggcagcatatgaatatgatgcattcggaggtttggtatcaggaacaggcggaggagaagcagacagcaacggattcagatacaatggtcaatatacagatgaagagactggattaatatatctaagaaacagatactatgacccaagtataggaagattcactcaggaagatccaattcgttcagatagcaattggtatgtttatgcagctaacaaccctatatgttatattgatccaagtgggttggtaataactctaactggaattactgacaaaaaagatgcaagattcattgctttgcaagagttgacagacgatgaactggatgttgatttaaaaacaggaatagtatcttatactaaaagcgatgatgttgacagagaagtagctactaatcttgttcgagatataatagataataatttagattgtgaaatcatttttagtaaaggtcaaaatggatatgctagtataaaaaaagatggaaatggaaatatagtgggaacggaaattgcattcaatcctaatttcacaccaagtaattggtcatatgttgatggagaaggatatggataccgaaaggtgcctaattttatagtcttgggtcatgaattgattcattctatccatgttttcactggagaattaggaaatacacaaacacaaggatactatttgggtggtctacaaccaggtaaaacacttttacggcagggtaatgttgaggaacttaatacaacgggtattgattatgtaaaagtcataaatggcgattgggcaaatgcgacacgtgtggaagcttcaaataattactattctgaaaatgcacttcgcttggaatatgatagcgtacataaagatgatgatggatatattatgatgggaagaagggcggtttactaatgttaaggaaaatattttgtattatgatttcattgtgtatactaacaagttttggggcaggggcattagcctcagaggatttcataaatgagaaaatggtaaatgtcattaaagcagttgctccatacataactgaaaatgtgaatgaatcaataaaacgtggtgattgtattgcaacaatcatgaaagtgattggagtagaccaagatactgctgatagatatgcaaacgcatgttattaccagccagtattttcagatttagaatatgacaacgtaaactcaggatatatcattcttgctaagttcggtggtgtggctattggcatacaaagtaatgaatatgatactatccatgattttgaaccgaaaaatgatgtgacgctcaaagagtgtcttgcattcatgttacgttgtttgcatgatactaaaaatatatcatggaatgatgttttgagtcaagcaaatgaatttgggttattgaatgatgaagaatataatataattcaggaagacgatcttcttacagatgaaatgttcaaaactctattgtctcgtatgcttgttaaaaaacgttatttatattggccgatagatgatccaccagatgggacagcaaaatctatccagatcgatcaaacggacagtattcaatatattgactggattttagaaaagaaaaataaataatcaaaaacaacaagttaagatttcgttatgattcgataagatatgatagctattgcaagttataacaataatacatgttcttttataataaatgacgacaaatataaaaaaatgatgaacagaaattgatggatggtacagtattactctgcaatgatataactgtaataccattgaactcattaaaatcaataataaattgtgatatacagtgggataaaaaaacaaatgtgtatatattaaaacaaaataggcttcttataattttttaaggagcctattttttatgattacaaagacataaaatttatttaccgactgaatcatcaggtacatatccagctttgataatttcttcaataaataaatttaggtctatgccactatttattatgatgttaattaaacttttaaaagatggtagccttttaccattttctaaatctatgtattggcgtggtgacagacaacatctctctgccattttctcttgatttaattttagttcaattcttctaaagtataatgtttttccaaagcacatttttaatatgttcatcatttcactcccaatctttaaaatatatgaatattctatcaataatatattttaaactatatgttacatattgggcataaacgctgttttcagatattcttataaaatgtgaaaaatgatttatattaaaaattatcattaataaaaaaatacagcttcaaaatccgtgattgaatgtcaataaatgtgttacgaaagtcttataaactaaaatcaaaacatattaataacaaatatagatataaaataataaaaacagataaatcgcttcactacttgatataatatatcaagaggagcaatacaatgattagaattttattgtctaggaagttaggcgaacttagatggacacaagctgaccttgcacggaaaacagggataagacctaatactataaatgacctttatcatgaaatgacagatcgagtaagtttagaacagattgacttaatatgtgaagctttaaattgtgatttaatcgagttattggttggtgttcctaattctgtgtcagagttaaactcgcgtaatcgtttaggtgagttaaaaaaagacgcctagtttggtgtctttttgtgtatattatatgtactaatttggcaatcaatttgtatatgagagaaaattcatgggacgattgtgggactttcccgttttaaaataaataaatataatggaatagatgtattaaaaagaaatataactaccgaaaacacacacataaacacttaatagtattttataactattgagtgggaatgataaatattgtgcttttctatcccgaaaagtgccgattttacggcacttttcgggattttgcttttttagtggctacaaattggctacatcagccgtattttttgtagccattaggctgtcaagctgattggcgacttcgatttgcttgtttgggtataggtgactgtaagtttctattgtagtctgtactctttcgtgtcctatcaaaaatataatattaggtcaactatgaatacagccaatatggacacatatgcccaaatactggatagttacacaaatcaggagggattacaaaattcccaaatatctacatatttcaaaaaattcgctcatggatggcattgcttttcctgatgttatatgatttatatatccttgtgaacgtcccatatctaaactcatacatctttctgatacattttttctcattctcaattctgttattctttctcttatataatcctcaaacatttcgttttctccctatttacttttaaattaattatattatatttgatttttttatttgttgccatggaatggcatgtagaatataagtcatgtcatgtggaatttataagtaatggagtgtcgcaaatgattattgatgaaacgggaatagttttgaccccaggaaacttagggaaagattgtttagggaatggaaaatatttttataaaggcggaaaacctgtgccgtgctgttgtaacgaatgcgattttttactctgttgtattgataaaaattataaagataaatgcttaaaatgtacttatactcaatgccctcgttattttgcgtttcaaaataacgattttgcagcaaatcaagacttggatgaactgataagattgttctttaatttagaacctgtcttacaaaataatatgatatatttaattaatgatattttaggaatacaaaagcaatttaaagatgaaaataaaaataattagtttagtataatataatgacttatatattgaacactgcgtgttcagatgatagctcacctaacgaggcgcataaatgcgccctaccgatgttcactaaaaaacctgcttttttgtttattaatctagattgaaaacttagcttttttaatgaataaatcaatagtaactcggattatctttattcacggcagtacacaaagtcaacgggaaagtagtaaggcttttttcatcatgaagccatgcttcatgatgaaatgagcgtgggcgagcgccccttggagccgtcaggcgacctaagcgagcagcactttttctttggtgaagcgtttcttttttttgcgagaaaaagaaatggttcatacaccttattatgtaataataaaaatttttatatggggtcacatacaaagttaatttttatgaatatttacttgatatattgaacactgcgtattcagaagatagctcacctaacgaggcgcataaatgcgccctaccgatgttcactacaaacccagtcttttgagtaataattaaatggttcaaacacctattataagtaaaataataaatattatatggggtcacatacaaagttaatttttatgaatatttacttgatatattgaacactgcgtgttcagaagatagctcacctaacgaggcgcataaatgcgccctaccgatgttcactacaaatccagtcttttgagtaataattaaatggtacaaacacctattataagtaaaataatatatattatatggggttatatgcaaagagaatcggatattggatataatgaattaaatatctttagtaacaacttataaatataggaaatttgaaaataaatatctcagtttttgcgataatatacaaataatttatattgtcgcttgaaaaatatataaatatatactataatatagccataatagacatttgtctattatggcgtttttataaataaaattatctttttttaacatgttttatacatacaaaagcggaaacacagtatcttccgcttttcttaatttaaaataattttatataataattaaaagcgagaggaggaaatacagcatatagctgtataaataatatatatggaaaatcaattatttaacctaaaagacttttatgacggcaactcctttgatgattatacatatttgggcgcacacaaagcagattcagggtatacattcagagtgtatgctcctcgtgccgtgcgtgtgacactaataggagaattcaacggctggctcgaatacgaccttataaggcctaaaaacagtaatttttttgaaggaacttttgccgatgtaaaacccaatatgatgtataaataccgggtctattccactcctgacgaatttgttgaacattctgacccatacggattcggcatggagctaagaccgggttcagcatctattatacgtgaactggatgagtttaagtttactgatgatgaatggatgtctaagcgtgacgtgggctataacaacccggttaatatatatgaacttcatcttgcttcatggcggcaaaaagaggacggttcatggtacacgtatactgaaaccggagaaatgctggttccatatttaaaagaaaacggatatacacatgtggaacttatgccaataaccgaacacccggcagatgaatcctggggttatcaaaacacctgtttttacagtcccacatcaagatacggcacccctgcggaactgatgcagatgataaatcaccttcataataacgatatcggagttattttagattttgttcctatccattttgcggttgacggatacggtctcggcaaatttgacggacaagccttgtatgaatatcccagcgaccatgtggggtgcagcgaatggggaagttataatttcaactttggcaggggcgaggttcggagttttctccagtccgccgccaattactggctgaaggaataccattttgacggtctcagaatggacgcggtatcaagagcaatattctggctcggcgatgtgaaacgcggcgtgaacgagtgcgccataaaatttatacaaaccatgaaccagggactcaaaaaacgtcataaaggaataatgctgattgccgaggacagtacaaattatcttaaagttaccgctcccgttgaatatgacggtcttggctttgactacaaatgggacatgggctggatgaacgacaccctggaattttttaaacttccgcctttataccgaacaaaaagcataaacaagctcacattctctatggcatatttctacaatgagctttatttgcttcctctgtcccatgatgaggttgttcacggaaaagctacaattattcaaaaaatgtggggaagttatgaacaaaaatttcctcaggcaagacttttatatatgtatatgtacacccacccgggaaagaaattgaattttatgggaaacgaaatcggtcagttcagggaatgggatgaaaagcgcgaacaggactggtttttaaagaaatatcctcttcatgattcatttatgcgatacatacgcgacatcagccgtgtatatgtaaacacttctgcgctctataacggcgagtataacagcaagtctttcacatggcacaaaatgggaaccaaagacagagcgctggcaatatacgaacgaggctgcggcgaagacggcagatacattgtttttctcaacttttccgatgtgcccgttgaagaatttgagtttgagatagaaaatgaaatcagcctagaacttataataaacactgaggctgatatttacagcggcagtatgaaaatcggaaccactgaaataaaggcagaattaaccgaagacggaaacacaaatatttcagtaaatatgccgccgttctcaggacaaatattaaaaatcaaagaattaaccgggcaaaaatagtttgcttattttccatatttcgggaacctaatatatttataagagtctaaaatatataaccaaattttaaggagtgataatatgaaaaaacttatctctactgtattatccgtaatatttttgttatcaatattacaaatttctgctttcgccttaaccttcagtgattctgattacggtgacacaaatctcaatgcagctcttgacagattaacagattccgggattatcatgggcgacgacacaggcacgttcagacctttcgatgaattaatcaacagcgaaatggcagttattttggcacgcgccgacggatacaagccgtacacggctgcagagcaaaacggctcatatgcggacactgctgttaaccacctgtacgaattgggtatattggactcaaacacaaatacctttaaccaatccgaaaaagtaaggtttattgattatatcacagcgactgttaaacttatagactataaaaacggactggatatcagcacggctaaaacttctgaagagtatttgacgaatgcttatgaactaggtcttttatcatttattcctgattatgagcctgaacaattcataacaagaagagacgcgtcggttgtaatagatttggctatgggattaaagctgacaaacaatgaaacgatgtacctcttgcttatagacgggaatattaataaccacccggtggtttcatccgctccggttccaacagcaaacccggaaagtcaaaatgcttttgcctacaatatgaacagcaaaatggacaagagcaagaactatatgttttcgccgctttcggtaaaaaccgctttggctatggctgccaacggcgctgacggcgaaacaaaggctgaaatactcgacactctaaaaatcaaagacttaaacgaatttaatgccgcaacaaaagcattgattgaaaaatacagcggcggttttgattatgcacgctacaatgagctttctgacaaattaaacaacggtgactatagcgacgctgaatttgaagaatacaaaaaactttctaacgaattaagaaacggcaagagcgttgaatttaatattgcaaattctatatggctgaataaagattattacgcaggaagcgacgcggcgtttagtcctgactttgaagccattgtaaaagacagctattacggcacttctgaaacagtaaacaacgatgacgctgttgaaagaataaacggctggacgtcagaaaagacaaatggaaaaatacccactataatagaagacagcggctttttggcagaactgataaatgccgtatactttaaagctccatggcagtatgaatttatgactgagaataccgccaaatctgtttttaacaatgcagacggcacgcggaccgagactgattttatgaatgatagaggttattatgatacatacgccgatgaaaatgttcaaatagtggagcttccatacaaaggaaacaaaacgtcgatgtatatcagtatggataacggcggaaatatcgattatgataattatctgtcaaaactgagttctaattatataaatctgtctataccgaaatttaagatagaatatgatgagaaaatcggcagtacaaacggtgactgcttgttaaaacaactgggaatcaatacggcgtttaaccaaaacacagctgactttaagaacatgattatcaatctgcctttgggcgaaaacgtgtttgttaatgaagtaatacataagacgtttataaatgttgatgaaaggggaaccgaagctgcagctgtgacttcaataggaatggctggttctgctctaccgcctgaaccgattgacttcacaatagataaaccgtttacgtttataataatggacaatcagagcggcgacatactatttatgggaagataccaggcagtgccggctgaataaaataaataagcatatataaaaggggagtttttatatgaatgaatatccgatatgtcaaagctgcggtatgccgcttgaaacaccggaacaaatgggaactgaatctgacggaagcagaactcagaaatactgcgcttattgttatcaaaacggagcgttcacaaatgatataactcttgatgaaatgattgaaagcaaccttaaatatctcaaagaatggaacaaagaaacaggggaagatttcactgctgacacagcaagaaaagagttacaagcctatcttcctacacttgaacgctggaaaaattaatttttatagtatagaaaaagcccaaaaatgaagcgcattcaaattattagatttttgtctaactttttgaattctgctcataattgggcttttcttatttttcattatacaaaaaataaaataagtatttgtccttgaccgcacttttgactgcactctcatgttttacataagcaaaacaatgttttatataaaaaacatataggttataaaacaccggaattgtgtattgtataacactccgtgagttatttataaaacaactttaattcgtttcttcccaattaattaagaagagtaccgactgatagaatttataatatattaattttatacttctctctgatattatatcaacatattaaaattggtatttatactcaagagtttttattataccataaattttacagcaaggcaaaattggcgctttcaattaatgacttcatttggcataagcaaaacgggtgtccttcagggtcaagcataactctccagccatcagagaattgtttgcttgcgggggtggctccgcaagcaatcgcatattgaacagacttttccaaatcattaacagcgaaatccaaatgcgccatagtttgctgtgcgtcaggctccgccggccatacaggcggttgataatcggtatttttttgaaaagttattccgggatacgcgccttgttccgttccaggagcgcccacgcaagcatagtcatcgtcattgaatactatttcccacttaagcaaatccgcataaaactttgctaattcgtaaggttccttacagtctactgtaaatgcgtacattttaatttttaattcatcgctcataatatgttcctccaaattaagaatattttgtatatacttctattgtgttaaagcaattttaatagaaaaggttcaaatcttaataaaaagatttataccttgtgtatttataatggtcttaaggtcgaacttgaaccgacaaagcacacaaaacttttttattaaatttttccctaaacaaaataatcaacaaattaaatataccataaatattattttgctgcaatacaaaaaatatattttatgatatttttcacttctttcatttttattgatttttttcctctataacatttgcattaatatctaaaggatttcaatttaaaaaatcttttattaaggcttgttgataaatgttaatattatgtcttaccatttcaagtgagctgtgcataatttgcagttcagcaagagagccgtcacttaatacaaaatatttagtggatgtatgcctataaatatgtatacagtttttttaactcctataatattaagattttaaggaaaaaagctaaaaaaacagacaccttggttaaatagaaaaaaaccaaataatcaaggtgtctgacaagttataaaaaacattttaacgaataaacaaaaatgagacaaactccataataacaaagggcttgtctcattctcttaacatttggtgacccatcggagattcgaactccggacaccttgattaaaagtcaagtgctctgccaactgagctaatgagtcatatttagttttttaatggctgggccggcaggattcgaacctacgaatgcagcagtcaaagtgctgtgtcttaccgcttgacgacggcccagtatttggggtgggtaaagggaattgaacccttgacctctagagccacaatctagcgctctagccaactgagctatacccaccatatttaaataaaaagctggcgcgcctgaagggacttgaacccctggcccactgcttagaaggcagttgctctatccagctgagctacaggcgcataaaattgttataaccgcttgattgtggaagcggttataaaggtggagcgggtgatgggaatcgaacccacgcaatcagcttggaaggctgagattctaccattgaactacacccgcgttcaatttttgcgactttgatattatatcaactatataataatttgtcaagaaaaattttcaaaaaattttattttttttataaattaacattataaacaatttgggtgtagaaaataaaatgttgtttgtgcaattactataacttttgacagcttttttatgggtctttttaaagaattttgattacagtttgtaattgcaatacagtttcttatattttctgtttaacaggttcagataaaattctaatttaatctactattgaaatctcattttagtctagtcggattttaaacttttaatacttcattatactaaaaaaattgaaataattaaaacaggcttaaaataaaaaatgaattaaaagttttttgttataaagctttaaaataataacaatataataatcaataaagctcataatatcaaacttaatgtttttgttattgatttgttttataactgataacaattaaaaatttagtctctctttaaaatacttcaataaaacaaatcagcaaaataaaaacagtataatctcagtaaatagaagcataacgtatttatagtatgtgtttttgtgctgggttatattgactttgaggcgattctggtatataatgtatgacggtagactgatttaggtctactgtttatattttagtattaatttgaattggagaattttatatgacaaagagcgaaagcggcggaaaggcagttaagtcaatcagtattatggcggtgcttatacttcttgcaaaatttatgggtctgttcagagagatgcttattgccgggatttatggtcagggctatgcttccgatgttatcaacagcgcgacccaaattccgcttttattttttgatatggtgctgggcgtggcaattttatccacctttgttccgatttataacaaaaatttagaaaaggtgggaaaatccggcgctgacgcttttgctaataattttatcactatagtgggggctgttgcagttcttgccgcaattttggggtcggtatttgcccagcctatagttaaaatgatggtgcccggctatgctgaagtcccgggtaaggttgaagaaactgccagattgcttcgtgtcctttttccgtctatagctttcactgctattgcctatgtggttgtcggaattttgcagtcgcatggtgagttcactattccgtccttgataagcgttgtatcaaacggtgttatgatagcatatctgcttatatttggggacaagctggggcttatgggcgtggctgtatcaatgctggcggcgtgggctcttcaattgtttttccaaattccatggctgattaagaccggatataggtataaacctcggtggaatattaaagatgggagcatgaaagaggtagcgcttttggcgcttccggttcttataagctcctgggttcagccgctttgcaacgttataaatatgtcgtttggttcaagtctcggaaacggcgctgtgtccgctctaaactgggcaaacaagatatatattataatggttggagtgtttgcttacgcgataacgaattttatttttcctaagttatcaaggcttaacgctgatgacaataatgaagcctttgcgtcaacaacaagaacgtcggtcggctggatagtttttataatcactattgtatcagccttgtttcttgcactttcaagccctatcattaaagtcgtatttgagcgcggagcgtttaccgctgaatctaccggtataactgcgtctgcactattcttttactcattcggaatggtcggttactctatatgcgaggttttgaataagagcttttacgccattcaggacggaaagacgccaatgttcacatcaatttttggggttgtagtcaatatcgggtgcgccgctttatttgttctagtttttgatataggaatagaagggctggccctggctagcgctataagctcaacggcaatcgccgcagcattgcttataatgataaacaagaggcgtgaaggcgtgataacaggcacttttatgctgaacctgctgaaaactttcatctgcggtgtgctcgcgtttataacagccaaatatgtattccttgctgtcgacggcgtattgggaacgggtatggtaatgactttagttaaactgtgcgttgcttcactgcctgcatgtgttgtatattttggtttggctcggattcttaaagtgacagagatgatgataggaatgaagtttatttttggaagaaaacatgattagagggatttgttttaataaaaatactttataaagaaaggaatggtaataggatatgaatgaaatgggatattttcaatccttttggttgttcatttggggttacataaagcagagctttgtttataaaatcctccgtaaagtgtacgacggtatttcgggcgcttggaaaagaagcagaataaccaacttttttcgtaaccagcatttttcttcggatgttttaaggaacggtgctgcggcaaggattttgaggtctccgtttacgtttttcgcttggcttcaaagaaagtattgtgaaaaactgaaaaataagatagagacaagctgtatagtaaaagtctgtgactgttatctaaagaatattctggcgcttaataccagattcatcggtattttactggttggaataacactgggagccgttgttcctgcgatagcaggaggagagcagacaaatctgctggtatatgcactgctgatattaggagctgttttgtctgtcgccaatgctaatttaaccgagttcctgtcgggttcctggataatgagaataattgagcatctcagcggaattgattttaagtatgacatttttgaaaaggacgttacaaagtcaaacggacgtttgtggcttgcagccctgattgggtttgccgccggagttgcagggggatttacaagcccgctttatacgatagttatacttggaggcttgtttgttgtctttctcattctcaggtcggttcaggccggagtttatctgactgtatttcttgcgccgctcatgcctactatggctatagttggtcttgtgggactttgtctgttttcagttcttgttaaggctgtgtcagaccgaaactttaaatggcgttttgaaggcgtaggctttttgatgcttgggttcctggctgtatatttgtttgccagcctgaattcttttgctgtgattaacagtttgagtatttttggaatttatctgttgtttatggcgttttattttgttgttataaacactgttaagaccaggaaacagttgtttgacgtgctgacagtgtttgcagtttcaggcgctttggtctgcctttatggcgttgcccagtatattttcggctgggatacgtctgccgcatgggttgatgaggaaatgttcagcgatataaaaatgagagtttattcaactcttgaaaacccgaatgttttgggtgagtatatccttttggttctgccggtctgcataggcttagtttggcagaagccaaaaaaacttgctaagctggtatatatagccatggcaggcattatgtttgcaactctgatattaacgttctcgcgcggatgctggattggtttcatgataaccgcaggtctgttcgttacgtttgtatgcggaaagatttggggattggcgctgatagctttgccgttcctgcctatggttttgccggaaagtattattaacagaattgccagcgtaggagatatgaaagattcgtcaacctcgtatagagtatatatttggtatggctcgctggcaatggtaaaagatttttgggcttcgggcataggccccggaactcaggcgttcaagtcggtatatccgttctattcatacagcggtatcgttgctcctcactcacataatatgttcctgcagattttagtcgagtcaggaatagtggggataggcgttttcttaaccactattgttatgttctttaagaagctgattaacggttatcagtcaacatccggcaaaggcagtaagctgggcgcaatgattgtagcaatcggcgcaggagttgccgggttctgtgttcagggaatgtttgataactgcttctataattaccgcgtattcttaatattttggatagtgctcgctcttggtatcgccgccgtgtatatcgctaaaggcgaaaaagaggaatcagcagtaaaggcggtggaggaagagtgataaaagtggtagaggtgtcctctgactcgaatatcgggggagcgggaaagtgtataataacttttctcaaatattttgacagaaagcagtttgacgtttctgttgtcctgcctaagaactcactgctgaagccggaggcggaagctttgggggttaaggtttatgaaatggacaacctggccgaaaaatcgctggatatgaaggctattggaagcctgaaaaaattgtttaaggaaataaagcctgatattgtgcatactcacgcaagcatgtccgccaggatagcggccaaacagtgccgtataaaaacagtctataccaggcacagcgtgtttgagccgtcaaggaaaatttctcagggccccggcaaagcggtaaacggctggattaataatcataccgcggacaggataatagctgttgccgaggcggcaaaggataatctgaccgccacgggcgtcagcgctgataaaatagacgttgtattaaacggcgttgaagcgttgaagccggcggctgatatacaaaaagtcaggtcaggatttgggattgagccggatgaaaaagcggttgcaattgttgcgagactgaccgaggtcaaggggcacagatattttattgaagccgcaaagattttgaaaaagcgcggagttaaagcaaagtttctcatagccggtacaggagatacagctgaggcgctgaaacgtcagattaaaaacgagggcttgattggaactgtcaagatgctgggatttttaaatgatgttgagcctttgatgaacgctatggatattcaggctaattgttcattcggtacagaagctaccagtctttcactgctccagggaatgagtttgggaaagccggcggttgttaccgatttcggcggtaatcccggtgttatacgggatggtgaaaacgggtttatggttcctataaaggaccctgccgctatggctgacgctttgcagaagctgatgacggacgagagtttgtatgaaagtatgagcaagagaagtttagagatatataacgagtgttttaccgccgaggtgaacaccaaaaggattgaagatatctatttgaaattgcttaattaaacggtataaaattaactattatatattggaggaaagagatatgaaagcaaagtttaacgcaatagactttataattattttggtcattgccgcgattattgcagtcggttcttactacttggtgtccactatgggcggcggaacaagcggaaaatcggcaggcggaaatgttaaagcaacgtttgaagttgaatttgccaacaaggaagaatatttgaccgagatgccgaaaatcggcgacaaggttactgttggcgttaaggaaaagatgccggctacggttacagatgtgagaattgttccggctgaaacggtggcgtatgatttgaatcagggaacggcacagtggcaggagatacccgggaagtatgacatttatgtaaccatggaagctgacgcggtagacaccgggaagcagataaacataaacaacagtccgataagggttggagattcagacgcggttcgttcaaagggctgggctggatatggttttgtcacacagctgaacgtaagcgagtagtgtaaatattttaggaaaggaagatagagattatgaagaaaaagagtacatttgcaaaagatggaaaattatttggaaaaatcagtattattgacataatcgttgttctgtgcgttatcgttcttgcctttggtatttatgcgaagttcacttcaaacagcgacgcggtttcttcatcagagaaggcgaagatagagtatgtatacaaggtaaagggagttagggattttacgattgacgcgtttaaaaaaggcggacctgtatatgaccaggacacaaaggaatatatgggagaggtaacgggtgtgcgctctgaggatgccgttatggaagtaagtttagtagacggtacatacaaaagtcttattgtgccgaagaagtatgatgtatatgtgactattcaggttgacggaaagtataacagcttaggtttttatacgaacgagaataggtatataggcgctggctcaacggttaatgcgcagtcgaagtatacgacgacaggcggagagattgttgaggtaagacaaatagaggaataaaaggggatatattgccggcttccaaaatggaagccggctttttttatgtcaacttatatattttttatatgggtcatacatatagtatatttactttatctcctgttcgagtttattaaatatttctgatgtaaaaaactcctccaaagtcatatccaaaccatcacataacttcttaattaacactatagaaacattcctgcgagtttcgtcaaacatactataaaccgacgaaggcgtaacttctgcctttgttgcaagttcatttggctttaaatttttatattcacatatatctttaaatctctcaactaccgcatctttaactttcataaaaatcacctcaataaaattataaaattttatattcaccggcgtatacgcacgcgagtgtaaggcgcaaaaaattatttaatttcttgttcgagatttgcaaaaatatcagaatcaaaaaattttttaatagaaattcctaaaccgtcacacaattttttaattgttaaaatagatacatctctacgtttatcattaaataaactatatactgaagaaggagaaataccagcacgtcttgctaattcgttcttttttatattgtctttttcacataattcccaaaatcttttaacaactgcatcttttgcattcatattatcacctcatataaattttacaattttattcatttgtgcgtatacgcgcttgcgtgattttagaaactatgttataatatacgcaaatgcgtaaccaaatattaaaaggagagataatatgaaatgttgtttttgtggtcatgggaggtattgggaagtaccaaattcgattgttgtattgttacttgaaactattgaatatttaattaactatcgtaatgttgatacgtttatttctggaggtatgggtgaatttgatagactgtgtgagtctgctataggcgaattaaaaaaatcatatcctcatattaaattatttttatatattccttatatgactaaatatctgagtaataatatggaatatctacataaaaaatatgatgagataatatatcctgaattagaacaggtatactataaatcagcaatacaaaaaagaaaccgtataatgattgatgaatctgattttatggttgcgtatgtaagaaatgataaaggcggagcaagacaaagctataaatacgcaaaaagaagtaaaaaaattaaaattataaatcttgtagaatatatataaatatcttaaatacaaatactgtcagcacaagaaaagaggatttttaatggataatataaatataactgaatttatcggggatttttttgatgaagaattggatgaatatatatataaaattttatataaactccaaaaagaaagtaaaaaatatagcgacttaataaataatgaagaaaaaataaaacaaacaaatgaaaccttacgtcaagttttggaatgctcaaatccacaaaagttaaatgctgaagaatgtaataaaattatagaatttatagaaaataatagattgaaaatgtttgaagagtgtagagcttcttatattcaaggtatattggatggactttctaaaagaaaattgttataagttaatataacgaaatataaagatatataaaattgaatgatgataataagttcaataaattatttgattatatgactgggttgatatattaaatataagagcttttctttgtatatgaccccatataatatatattattttacttataataggtgtttgaaccatttctttttctcgcaagaaaaagaaacgcttcaccaaagaaaaagtgctgctcgcttaggtcgcctgcggctccaaggggcgctcgcccctgctaatttcatcttgaatctgcgtttcaagatgaaaaagccttgttactttcccgttgactttgtgtactaccgtgaaaatagatatttcgagttccaattgatttacttatcaaaaaacaaagtttttagtttaaattattacacaaaaaagcaggttttttggtgaacatcggtaggtttgcgatagcaaacgcgttaggtgagcaaacatctgaacacgcagtgttcaatattaataaatatattaatttattttctagtatgtgtgttgatgtgaataaagatattacgagttccggttgatttatttatcagaaaaacagggttttccgtgaacatcggtaggtgtgaccccacctttggtgggtgtgatacaaagtgacttattttactatagccttcaacgtcaataatatgaatactcaaaattggaaagctccaattgactacatcaactcttttatcaatttcggtgaactcttttaatcttttttgtaacacatcattgacaaacctacagatttaaaattttgctgcaattatttaaattgaaaaagtacaataaatctggtggaatattaatgtcaattaaaataaataaaatttttatataatttatcatagaataattatatatttaatatctaatatacggtgtatatggtgaactgcggcaggtgtgactgtgaccgcacctgaaaggcgcgtgtgcgccacaatatctctttaccattaaacctaaaatgtcaataaatcacttagttgtgatattccccacctaaggggtgggtgtgatacaaagtgacttgttttggttagacgacaatgtcaataaattacttagttgtgatgtattgcgcatttatgcgccgcgttaggtgagctgtcatctcacgcgaagcgtgaattacttatggcagagtatcataatcctttttattactaattttccatgactgcgcgccttacgaggcaaactacgtttgccctaccgaagcttgcgaaaccacatttttatatgatttattatagaataattatatatttattatctaatacggtgtttatagtgaatatcgggaggtgtgacaccaccattctggtggggtcacagtcacagccctccgaagcttgcaaaaccatatttatgtaatatttttatatacagtttttctgtttaggtttcttttaacttttcaaatgtctaatgaaatacgatagacataagcacataattccaacatatatttaatattgaataaatttaatcagagctggtggggtttaaatgaaatggtttaaagcggttgtcgtcttgattctgtgctatgtgacattttgtttggttatgtttcccgatgcttgtataacagcggtgagcggagcgctgaagttatgcgtcactgctgttatacccacgctgtttccgttctttgtatgcagttcactgcttatagcatttggattaggcgaatttggaagcaggtttttgagcggagtgatgagaccgctttttaaggtcagcggagcgggagctgtggcggtaattttaggtgtggtgagcggctatcctgtgggtgctagctgtgctgttgaactttataagactggaaagataacaaaacctgaggctgaaaggctgttgagtttctgcaataactccggtccgctttttattataggaacggttgggtttgctatgaattccagcgtcgctttgggcggagtgctttatataatacatatcacggcggcaatatcggcaggaattatatatgcgaaaatttcatcaaaaaagaatattgaaaataatctgataaatccgctgatagttgatatgtcgccggataaaaaacctaaaaaactgatagagtttttcggtgatgcagtgtcaaaaagcgttataactattttgaacgtttgcggttttgtggtcttttttgctgtggtggaaaagactattcctgagtttataggcagtccttttatcaattcattgctggagataaccggcggtataaatggcatgtcttctatgggaatagaaccggttttgaagttttcattaatttctatgttcctggctatgtcgggcttatcagtgtttttgcaggtgtcgtctattatatcttctgcggatatatctccaaagtcatatgcagttggcaagctgatacatggcggagtagcgtttattttaacatatgttgtgatgctggtgttaaagctgaccgggtggctccagcagataattggttccggcagtgctgcgtcagcttttgccatgagtgagggctggatagtaccggcggcgtttaacagcacttgtccgcttgactctgttttgcagtatgcttgtcttatggcaggttccgcactctggtgcctgctttctatggcggtactggcgttggcttctgcctttttctgcaaggattgacataatattttatatatggtatcatgcttaccaaaagagattattatggaattttgaggtaagctaaatggcggataaaaatgaacgatccgtatatatcggcgctgtcagcggatgtaatgtgatttccgcagaaaaggcggtggttcctgccaactattcagccgtcaactccactaccggtcatgggctgatggcggaggaagctttgactgtgatagacaaattcagcggcagaagcgctgaggtggtaggacgtacgaatataaagaacggacctgacagaatggttgatggaactgctctgcaaaccaagttttataattccggcaagggatgcgttcaggcgtgtttcgacaaagaaaacggcggtctgtaccgatatttgaatagtgacggcagtccgatgccggttgaggtgcctaaagatatgtatgacgacgctgtggaggcgtttagagcaaagatttctcagggtaaagttcccggggtgacagatgttaatgaagcagggaattacgtgaggaaaagtgatttgacttatgctgacgctatgaatctgtgcaagccttttactgctcagtctctgctttatgactgcgcaactgggataatatattgctcgtttgcgtttggaataagcgctttggctgttttcattcttgagtatagcagaaacggcagaaatgagaaaaaggctttgttttccgctgtcagaacaggagctaaggtctttgggctttcatatgttactcatattctttgttcgcagtttgctagaactgaactttttaaatctgtttgggatattaccggatacataaacagtgggggctttttcggcggagcggttcagtctgtaaacaatgctgtgcgtttcagcgtcggcgacagtgtttcttctgtaagcgcttcgctgacgcagttttctaaaatgttcagagccgggatttttatgaatctgtttaccatgcttatatttttggttcctgatactgtcagagtatttgtcagggatatttcggggtttgattatttaaacagggtgtttatgatagttatatcaagaattttttcaacagtgttttatataacagccgctttgatgcttggaagtttcagcagtctgccatatatggtctcaatgactgtgtgcctggcggcttcatgtatcggaggaatagccggacgtgctgttgtttcaagactgacagaaagatttatgatacttcgggcttaaactaaagaaagaggagtgaaatttttatggcttcaaaatgtgatgaatgcgttaactatgagtatgatgaggattatgagtcatatgtttgtttagcaaatttggatgaggacgatatggcgaaatttatcagcggaaattataatgaatgtccgttttaccgtcccggtgacgaatacacaattgtcagaaagcagaattgatttagggattaatatctatgtaagtgaatattctttaagttgaatattttaaaatgaatttattattacttaacagagtttataatattatgcttgaatatgttatgggattatcttagatttgttatgacacggaagttatgtagtgtcaaaagaaaactaggcagaaaatataagagcgttgtttggtaaacatcggttgggagtgcgtatgaagtatgacgcgtgaggtgtgcagtcgctgaaaagtttattatttaataggatcatgacaaattgtttgtatatatgttcacgctccgcgtgagatggcggctcacctaacgaggtgtgcgcaagcacaccctaccgatgttcactaaaaacactgttttttggaatattgattttaaaaaatttttataaataaagtggttttgcaagcttcggagggctgtggctacacttttatttaaaagtgtatgttatataaaccgtataatgtgatacaaactataaatgccaataattaacttagttgtcatataataatcaaacttagatgtgatgtgcaaacgttgtttgcctcgtaaggcgcgcagtcatggaaaagtttatataaaaaggattatgttatactgttgtatatatgttcacgctccacgtgagatgacagctcacctaacgtggtgtgcttgcgcacaccctaccgacgttcactaaaaacacggtttttggaatattgattttataatttttataaataaagtggttttgcaagcttcggagggcaaacgttgtttgcctcattaggcgcgcagtcatggaaaagtttatataaaaaggattatgttatactgttgcatatatgttcacgctccgcgtgagatgatagctcacctaacgcggcgcataaatgcgccctaccgatgttcactataaacactcttgattttttgtctggtttgttatatcttattcagtattttttcttggattttattgcggatgtttataaggtaaggcttgaaaaggtatgtgttatttgttttataatattgatgaggtactgagaattaaagtatataggacaaaaacgttctgaactgtttaacactaatttatataaacgaaaaatgtttgcggcggcgtgtaaaactattcacgccgccgcgttttttattttatatttaggcttgtaaattacgtttaaaagaaatataatagaatcatataatttaaggattgattcatggtgatagagtaatagataagacgtcttgttctattgcagtgaaatgtttttttatatgacagcatattgcgtgaaagatatgtgatatattttaattaaggttgatgccggtaaagcatcaatgcgtacagtagtctgtgatactattgtgaaaaacaataaaatattttgaaaaacaatagatatataaaacgtcttattttctctgacgtaatattttatttatgtgtgctgtgtgtagaaacgtaaataatattttatatatgctggttttaaaataaagcattacataataggcgctttttattgcgaaacaaaacgaaaaccagcagatgatggtttggtaaatgaaatccggagaatattccggcagagatcgtatataacagaaagtgcggtaaaggggattttaatatatgaaacggatatttttagttgaggatgataaggctattgctaaaaatcttatgcttctgctccgctcagagggctacacggttactcatgccccaacacaaagcgaggctattgatttggtcagcgtgaataggtttgatttggcgctggtcgatatttcactgcctgacggaaatgggtttacggtttgcacggaaattaaagaaactcaggatattcctgttatctttctgacggcttcgggggatgaggccagcgttgttacagggcttaatatgggagcggacgactatatcaccaaacctttcagaccccgtgagcttatagccagaatcaaaaccgcgctgcgaaaaagcagccgttctgcgtctgcgtttgaaatctgcggacttaatgttgatactgcaagcggcgttgttaaaaaagacggcagcgagatttttctttcagctttggaataccgtttactgttggtgtttataaataatcccaaaagtattatcacaaggggcagattgcttgacgaactctgggacgcggcaggtgagtttgtcaatgacaacacgctgactgtttatattaaacgcctgcgtgagaagatagaaaacgaccctgcaaatccgcagattattcttactgtacgtggaaccggctacagattgggggacggatatgtttcgcaatagggagtttaagaggttttcagttctctttctgattatagctgcggtttccgtaacgtttagttttgtatttaatacggcggcaggaattatttctatcatttctgcagccgcttttggcacggcattttttatctttaccaaatcgagatatgagagtattgcgcagatttcagaccaaatcgaccttgtgcttcacaatgccgaccaaatctatatcagcgaatctgaggagggagaactttcaatactgcagagtgagataacaaagatgactatgcgcattcgtgaacagaacagcgctttgagaaaggaaaaggaacatttggcggattcattggcagatatagcccaccagctccgcacccctctcacgtctgctaacttaattctgtcattgctggagaatgctcccgatgaaaatgagcgaaaaaatttgatgagagaaacagaagaattatttgtgcagatggactggcttttgacaactctgctgaaattatcacgccttgacgcaggaattgtggtttttcaaagcatacaggtaaacgtgagcagtctgataaaatctgcggtccatccgtttctgatttctatggagcttcacaatattgatttaaagtcagacgtaccggacggcataaaaattataggggatttaagctggctttctgaggcggtacaaaatatacttaaaaactgtattgaaagtgtgggcaataatgggaagatagaaattagctgcactgacaatccgttatttactgagatttccattcatgacagcggagcaggttttaaaaaagaagatttgccgcatttgtttgacaggttttatcggggaaacagtgaaaacgcctccggttatggtataggactggctctgtgcaaaatgattatagtgcggcagggcggaacagtcagtgcaaaaaatcatcctcagggcggggcggtgtttactattcgtttcccaaagtgacaaatctctcacctaaaagtcacagagatgtaagctgaaggttctattatatgggtagactaagaaaaaggaggctcacataatggagttcttaaaagttgaagatttatgcaaagtttatggcaagggtgaaaataaggtcaccgcgctcgaccatgtttcacttacaatcgaaaagggtgagttcactgcgattattggttcttcaggctccggaaagtccaccttgcttcatattatcggcggcgtggacgtgccgaccagcggaaaggtatatctgaacggacaggatgtatatgccggaagcaatgaaaagctcgccattttccgcagacggcaggtagggctgatttatcagtttcataatctgattccaactttgaacgtggtggagaatatcacactgcctatacttatggacaagcggaaggttaacgaggagcgtttgaatgatttgctcggcctgcttggtcttcaggagcgcagaacgcatttgcctaatcagctttcaggcggtcagcagcagcgtgtttctatcggcagggctttaatgaacgcgccggcggttatgcttgccgacgagccgacaggaagcttggacagccataacggccatgagattatcaaactgctgaagctgagccaaaaaagatacaagcagactcttataatcgtaactcatgatgaaaatatcgccctgcaggcggaccgcattatcggcatatcagacggccgggtagtgagagacgagagggtggtgcggtcatgaatattttcaacaaggtcactctgcaaagcatgaaaaaaagccgtacccgtaccatagtaacaattatcggtgtcatactgtcagccgcaatgataacggcagttgccacctttgccgtttcactccaaaattatatggtcaacggggcaattcagaaatacggaagctggcatgtcggttttttggatgttccgccttcgttcgctgaggagcggacaagtgatgataaggttttaaattctgtatcaattgaaaatataggtttcgccaaactcgacggcggaaaaaatccaaacaaaccatatctttttgtagcaggatttaatgaaagctcttttgataatttgcctataaaactgctttcaggcagacttcctgaaaccagcggcgagattcttattccgcagcatcttgacgaaaacggcggtgtgaagttctcggtaggagatactgttacgcttaatgttggaagccgtgtgccgaataacggggaacttggtaaaaatgccgaaacagacggcaaagttaagctttcggtcaaggcggagcattcgcttgccgataaaagattcatagaccgggaggagagactcggtcagcatgacccttatattccggaagaagagacgggaaaagcaggggaaacatttgtgccggaaactgagagaagttacactgttgtgggaatctgctcaaggcctgcatttgaggaatattccgcgccgggatacaccttaataacagcgtcggactccgaagcaacggcagacagtctcagtgtgtttgtgactcttaaaaatccgtggcaggttcatagttacgcaagaggcacggccgggaatgtggcttatatttttaacgatgatgtactgcgttttatgggcctttcggatgataatttgtttaacgcgctcttgtactcaatcggaattattttgataatcctaatcatgctgggctcggttttcctgatttataactcattcacaatttcactgaatgaccgcacgcgccagttcggaatacttatgtctgtgggagccacagaaaaacagctgaggaagtcggtgctgtttgaggggctttgcattggagctgtgggaataccgattggtattattatcggaatacccagtataaagctggtgctttctattgcggcaaaatattttggcaatgttttgtacagcggagtgcctttgaatttgtcaatctcggttccggcgcttatagccgcggcggtgataagtttggtcactatcctgatttcagcatatattcctgcgcggaaagcggcaggtattcctgttatggagtgtatccgccaaacaaatgatgtcaaggttgaacctaaagctgtaaaaacgtcaaaaatctcagagcgtttatttggtttggaaggcgttttggcattaaagaattttaagagaaacaagaagcgttataaaagtattgtgttgtcgctcactttgagcgtggtgctgtttgtggcggcaagctcttttggaatgtatctgaaaaatgcggcggagagcaccgttgtaggaactgactatgatttatgtttctattcacaggatattgacgaggaagaaatgttcaggctttatgacgaattcaaggttgttcccggagtttacgacagctcatatcaggcaatttcatcatattcatgctcaataaaaccaagtgatttttcggatgcttatctggaatcaacggattatgaccgagacggagaagctatgcctatggatattcagtttcttgaagacagcgtatatttgagctttattgatgagttgggcttgccggctgaggaatacacgggtcagaacgcaaaaatgattgctgttgccaaagctaaaagagagagcgccgagcaagaaggcaaaaccgagctgattgatatgtttgaaagccgggatatgaattttcagattattcccgaaaccaataacgcgccgcaggcagagcagggacagaacataaacataacgtttgtagacacaattccgactgacactcttccaaagaagccgtctgaggttaaaccatacgtttttatgggggttgcaccttatcagctgaaagagagatttgttaccaaggacacccatacagaaatgggactgacattcttatccagcagcccgtctcaatcggctgcagagatggaaaatataataaataattatggtatttcatctgattatactctttataacgtgtatgaaatgtttgaacaaaaccgcaatattatctttattgtcaatctgtttacctatgtatttatactgatgatttcactgatagcggtagctaatgtgtttaacacaatttccaccaatatcaggctgcggagaagggagcttgccatgcttcgctctgtgggtatgtcggaccgtgaaatcaataaaatgatgaattttgagtgtatgttttatggaatgagaacgctgatattcggagtgccgacagcggtgcttatctcctggctgatttataaatttttatttgtcggcggagcggaggtgagttttgtattcccgtgggtcagtcttgttataagcgtgcttggtgtgttccttgttatttttattactatgctgtatgcagtcagcaggataaaaaaggaaaatattatagatgccctgcgcgacgatatgacttaatgcggtcaatatttgtttgatttatttgaaaatcttgtcagcatacgtacggctgagattatttaatgaaaacaacagcagagtttaatatttttatcagtttgccccgcctattttggcggggtattttaatttaaatatcattatcacgcaaaatttgcatatgatgtattaaaacaaataaagggctgatagaatgtcaaaaaacaaacctagcaggaaaagagacaatcagaataaccaaccatcgcttaaagaaaagcttgcagacgcgattgatatttccaaaaacgtcatgctcggcgttcctctcgtgactatggttggagacagagagcttaccattgaaaactatgttggcataatagaatatggagaggatattatcagaataaaatgtaaggcggttaatgtaagcataaccggaaaaaatttagaactaaaaactatgactgatgaatttttatatattaccgggaggttcaaatgcttttcatacgaatactaaattacataaaaggttatcttattattacaattaacggagtttttgccgagagattcataaacatatgcgtccacagaaatattctgatttgggatgttagccgaaaaaacggcgggtttatggcaaaaatggcaacaaaggatttttataaggttcgtgatattgcgcggataacaaactcaaaagttcggattaaaaggagacagggactgccttttttattgattagatacagaaacaggtggccaatattttttgctttaattctttttatagctattgtgcatttcacctccacccatataatgagcgttgatgtggagggaaatcagaggataccgacagagcaggttctgagcgagcttagggatgttggggtaagctttggaaaacgcgtaagcggactgaacgctgatactataagaaaccaaatgataattaacaatgacgaaatagcgtggctgggcgtaaatgtccgaggctccagggtgtatgttgagataaccgagaggatagacactgagagcgtgccgcacctgacggaggaaaaatgcaacctggtcgcttcaaaggatggggttatagaaaaacttgaggtaggccagggacagactatggttaaaaagggcgacggagtgcgcgagggcgacgttcttgtcagcggcataatggacagcgcatacggcggcttcaggttggttcattcatacggcgaagtatatgcaagaactgagtataccgccaccagggaataccaactcaactatattgaaaaggaatacagcggtgaggaaaaggtcagatttggtctgaatctttttggaaataagatagagctgtatccgccatcgatgagaccggacgataattatgatgaacaggcggaagaatatgtgtatcgcggaagctggcttgggaataatgttgagttcggaggtgttgttgaaaaatttcttgaatataaagaggtggaaaagcaaagaactatacaggaggcggttgagacaggcagaaaggaaatgacagaggaagttgaaaactctgtgcccaaagacgctgagataattgcaagaaaaacagaccataatattatttccggggatgcggtgtctgtgaccgtaacctatgagtgcagagaaaatattgcaaaagagagcgaaattgataaaagtctgattgacaaaaacgacaatttggattatgatataaaagccgaggaagataattccggcggcagataaaatcataggattttgaaatacaaaagaaaaacagaggttttttaatggagagacatatagaagttgaaaaaatggatctcgttataaatctgttcggcagttttgacgagaatgttaagataatagagaaggagcttgacgttgctataatcaaccgtggttctgaaattaaaataggcggagaaccggataaggttgaaaaggcagtggctgctgtaaaccagcttttggccgtggcttcccggggagaaacgataggggagcaggaggtccgttatgtcatgggtcagattgacgacggaaaagaagaggaactggctgatttggggaaagacgtaatttgcatcacctctaacggtacccctttaaaggctaaaacattaggtcagaagcagtatgttgagatgataaagaaaaaccctattgtgtttggaatcgggccggcaggaacgggaaaaacctatttggcggtagcaatggcggtgtcggcttttaaaaataaggaagtcaacagaatagttttaacgagaccggcaattgaagccggggagagcctgggatttttgcccggggatatgcaggaaaaggttgacccttatctgagaccgctgtatgacgctttgggggaaatgttcggctttgaagcgtttcataagatattggagagagggcagatagaggtcgctccgctggcgtatatgagaggaagaactcttgacgacgcttttataatcctggacgaggcgcagaataccactcaggagcagatgaagatgtttctgacccgtatgggatttgcttctaaaatagtggttacgggcgacgttactcaggttgacctgccgagggataaaaagtcggggctgagagacgcggaaatagtcctcaaaaatattgagggcatagagtttatgtatttgtctgaaaaggatgtcgttcgtcatccgctggtgcagaagatagttaaggcttatgagaaaaagactatggagcgcgagagggttttaaggcagaaacgtgacagaaacagcagggagagacgcgcgcagaattaatatttgatatacaaaagaggcattgcttatgaaagttgcaattttaaatcaacaggataagataaaggttggaaaaccgctgaaagatttgataaaaaggtcggcggaagcgtcgcttaaattttttgatttgggaaccgatgttgagataagcgttatgctgacagacaacgatggtatacgcgaccttaataaacttcacaggaatattgacagggcgaccgacgtcctgtctttcccaatgtttgagtataatgaagccggggagataaacgaggattatgctgagctgaatgaaatgggagaaatatgtttgggcgatattgttatttctctggagcgcgcagaagaacaggctgaggagtatggtcattcgtttgagagagaggtcgggttcctgactgttcactctatgcttcatttgctggggtttgaccatatgacagaggaagaagagaaagaaatgtttgactatcagagagagatacttgagcagatggagctgacgagatgaaaaaactgataaagagtttcggttacgctttttcgggactatgggcgtgtataatatacgagaggaatttccgtatacatatctctgccgctttggcggtgtttgtttttgcgtggctgtatggcgttgacaatgttcatcttgcggttttggtgctgacggttgctctcgtgtttataaccgaggcggtcaacacctcgattgagaaggcggtggattttttgtcacctgaaagatcggaaactgccaaaatcgccaaagacgcggcggcgggagctgttctgctttcggcaatagcggcggtggctgttgcggtgatgtcatttaacgatcttgacaggctgagctggacttttctgcagctgtttactatgcctaatttaatttttactgtggcttatataattttgagtatcgtatttatattttgtatagtacctaagactaatattgaaaggaaataattatgaaatcaggatttgtcgctataaccggaaggccgaacgcagggaagtctactctgcttaatcggataataggagaaaaggtggctatagtttctaaaaagccgcagacaacgagaacaaaaattttaggggtgcacactgaggaggactgtcagattgtcctgattgatacccctggtatacacaaaccccacaacaagctgggtcagcgcatggagaagtatatatactcagcgacccaggatattgacgtgctggtctatgttgtggactgcaacatttccgacagggaacttgagcttgaaaaggagtcgcttgacgggctgaaaaaatcaaatgtacctgttgttttggctgtcaacaagattgactctgttcaaaagctgagtttgctgccgctgatggacaagctgaagtcgatatacaattttgatgagattattcccatatcagcgcaaaagggtgaaaatgtggacaggctgttaaaaatccttgagggatatttgagcgagggcccaaaattttttccggatgatattataactgatcagccagagcggcagatagttgctgagtttatccgtgaaaaggctttaaggctgcttaataaagaggtgccgcacggtattgctgttgaaatagaaaaaatgagccaaagagagaacgggacttatgatattatggcggcaatatattgtgaaaagcagagccataaggggataataatcggaaaaggcggagagaagctgaaagatattggaagacagtcacgccaggatattgagagatttttaggtgaaaaggtttatctcgagctttgggtaaaggtgaaagagaactggagaaatcttgataatttcatcaccgaaatgggattcgataaaaaataacagtaaagacttttatgtgattttgtgaggatataaatatgtcgttatttaaagttgcgcttctgcagatgacgtctgcagggacaaaggaagaaaatctgcgcaagggcgtggagttttgcagaaatgcgaaggctatgggtgcggatttggctttgtttcctgagatgtggaacaacggctacagtctttcctatgacatggaggttatggaaaggaattcagaggatcaggacggcttgtttgtcaatacttttaaagagctggctgccgagctggaaatggcaatagctgtgacatatttggaaaaatacaagcctctgccaagaaataccgtgacggtttttgacaggcacggcagaaatgtgcttacatatgcgaaagtgcatacctgcgattttgatatagagaaaaatttaactcccggcgatgagttttatgtgacagaactagatactgaaaacgggaaagtaaatattggggctatgatttgctacgacagagagttcccggaaagcgccaggattctgatgctgaaaggtgcggaaatcattcttgttcccaacgcctgcccgatggagataaaccgtttgtcacagctcagggcaagggcgtttgaaaatatggtgggaatcgccacagcaaattatgcttatggccagcccgactgcaacggtcattcttcagctttcgacggcatggcttacggagagatacgccccggcacagttgaagccagagacacgcttatagttgaggccggagaggctgaggggatatatttggcgcagtttcctatggataagatacgtgaatatagaaagaatgaagttcatggaaacacctacagacgtccgcttaaatataaagaactgatttctgagaagatagacgagccgtttataagagatgattacagaaagtgaaaacagaactctgatttatagctatgaaatacgagcgttatgattacagcgaatgaataaggagggctttgatgcctaatattgatgtttgcggtttggtaaccagggaggtcaaatatggtgaaaacagcaggatactaactgttttggctaaggatataggcaaggtttcggttcttgccagccgtgcgagaaccaaccgttcaggtttgctgactgcaacacagctttttgcttattctaatttcacactgtttaaagggcgtgagaacagccttatgaagatgaatgagggagaagttatagagtcattttctgagataagaaattctcttgacaatatggcatacgcgtcatacttttgtgacatagccaatcatatatgcaccgacggcacagaggagaacgaactgttgggcctattgctcagagtattaaagagactgtctgtaaaggaagaaaatacggcggagtcgctcaaagccgagtgcgtttttcttttccgtgcgctttcaatagcggggtttgcgccaaactgcgacggctgcgcttcctgcggcaaaaatgaaaatataaaattttttgatattcagaacggtatttttttatgcggaaactgttccgcaaaacccaggcagaacactgtcgagattaccagcgcgatgtataacacgatagattatatagtaagctctgagattaaaagggtgttttcgtttagtttaggggagaagagtttgagatatttggcaggagtgggagaagcctgtgtaaggaatcagctggaatacgattttaaaactttaaaatatttaaataatgtgagagatctatagggatttaaaacaatattattttatataattattgctgtgtatacagcaataaaatttatatctaagtgagtatacatattattaatttgtatctaagtgaatatacatattattaatttatatctaagtgaatatacatattattaatttatatctaagtgaatatacatattattaatttatatctaatgatatgtatatgaaccgagcttttcaagcgcggctcattttttaattctttattacatatacccgtgcctgcgcgcctaacgcggcgcttaccagcgccctaccgatgcttgcctgaaagtgtgattatataataaaataaaaataagctggtgttttggcgaacatcggtaggtgtgaccacacttttaaaaaaagtgtgtgtaatacatactaacttgttttgccattacctgcaatgtcattagtatgtatactcaatgcaaactgtgtttgccgcgttaggtgagcaaccaaatcacgcgaagcgagaacatacatataacatttgttataatccattttataaaatttattccgcgactgcgcgccttacgcggcgcttaccagagtcattgagtattcataataatatttgcgtattcatattattgacattgaaggtttgataaaacaagtcacaatgcctcacactcaccatacaggtggggtcacagacattgtaggttatggcaaaataaaatcatatgtattacacacacttttttaaagtgtggtcacagccctgtcgatgcttgcctgaaagtgtgattataaaataaaattaaaatataaataagctggtgttttggcgaacatcggtagggcagacggcgtctgccgcgtaaggtgagcaaccaaatcacgcaaagcgtgaacatacgtataacatttgttataatcctttttataaaatctataccgcggctgtgcgccttacgcggcgcctatcagcgccctaccgatgcttgcctgaaaatgtgattatataataaaataaaaataagctggtgttttggcgaacatcggtagggcaaactgtgtttgccgcattaggtgagcaactaaatcacgcgaagcgtgaacatacgtataacatttgttataatccattttataaaatttattccgcgactgcgcgcctaacgcggcgcttaccagcgccctaccgatgcttgcctgaaagtgtgattatataataaaataaaaataagctggtgttttggcgaacatcggtaggtgtgaccacacttttttaaagtgtgtgtaatacatactaacttgttttgccattacatgcaatgtcattagtatgtatactcaatgcagacgttgtctgccgcgttaggtgagctgtcatctcacgcgaagcgtgaacatatatataacatttgttataatcctttttataaaatctattccgtgactgcgcgccttacgcggcgcctatcagcgcccttccgatgcttgctgaaacataattttaatttatgcaaagctatttataaaatacaaaactcatatttataaagaaatttattctttatttatatgagttttatgttttattttattttaataatatgattaaattatatattgttttttagcttttgactggaagctctatttttttgttttcttcagattctttatagagcacaaatttgtttcctataacttgaaccacgtctgcggaggcggcttccgccagctcccccgccgcttcccgggcggttagcattgagttttcaagaacgtgaacttttattagctctctggcttccaatgcgtccagaataagtgcgaccatgttatcgtttataccgtcttttccaacttggtatagcgccggttctctgttggcaaggcctctgagataagcgcgctgtttactgtttatcatattgctctccttttgtttagttagttttcagcagttcggcagtcttgctgtcaggctgtctgccggtctgacgtatcagtgcttccgaaactgcggcgtatacttttttggctgtgatgtccggttcggagtttttgaagcattcaatgtgtctctttactgtctcaaaatcgccccgctctataggacctgtcaaagcgtttataggtccgttttttagaatattgttcatattatttttcagcagaggtcttatggcggcgaaggcgtcgtcatatgaaaaaccgcattcctctaaaagttcgcaggaaagttcagcgagagccacaacaaagttgcttgcaaaaacagcggcggcatggtatttgcttttgttttcggcgctgagaatttgaaagcggctgccgcacttttttaaaacttccgccggaacgccgcttccctcaacggtgaaaaatgcttctctaaaatctttatagcttgtaaatttatcattcaccgcaagcagcatatgtatacttgcggtttcagcttttaatattttgagttcggacaaaactgtactggaaagcgcgccggaggtgtgacagaaaattttattgcttatatcaatatcatattttctgcattcactggctatattatggcttacatcagcaatagcgccgtcgttcaccgttataaatattaaatccgaatctgtgattatctctttcagtccggtataagcagaggcagagccgccgataaattctgcggattcctcagccgagctttgtgttcttgaataaaagccggagacggaaagcccgttttcggacagatatttgccgagtgaagagccgacccgtcctgctcctataaatcctattctcatatttttctccattttatttagctgaatattcgaaactgtcaaacgagggataaatagtgctttcagttccgctgtaggcatatagaccaatcatagcgccagtaaagcgtttgcccttgctgattgcctgactgcaaaggtaatacaggttctcggcagcatagacctctgtaaaagttttgccgtcatggctgtagctgaatgtgcgttttaatccttcggttgaaattttcaggtacaggctgtcggttacctctgttatatcaacggtgcaggtatatttctcgtcctcgtctattttttcaaacagttttaacgcgtatccgtcaccgttcttatatattccatatgtgaagtatgtattctcatcataatatccggtcattccataattttgttcgctgtccagcttgattcccaaatccagcttgcatacagcgtcaaaattaaagtccggctgtcttctgaccgtaatgtttttggcagacgttgaacttagcggacagcgtgagccttttattatcagcttactgtccttaacagtgattccgtctgcttccggcgttcttggaaatatccagtcaggttttaatctgtctccgtcaaaatcgtcaaatcctgatttttcttctgtatccatagccgggagatttggttttttctgcagatagctggggccgttcaagctgttaacgataggccagccgtcggcggtccaggtcaccgggtcgagacatgtctctctgcccaaaattccatactcgccgtcgagcagtctgttgcacagatataccatataccattcgccgttttgagtctcaactggcttgccgtgtccgcagcatgtgattggagcgtcataatccctctgggtcataatcggattgtatgggcagggttcataaacgccttttaaggttttgctccttgaaactgtcacctggtgcataagcccggtgccgccctccgcttcaaagaggtagtaatatccgtctttatataatagatgcggtccttcgggagcgcgtttattggttccgtagtataagagctccgcgtctgaaatcttttttgtgcagtcgtctcccagttccagtattctggcacccctgttcaggagcatataccgtttgttgtccttgtcggtaaatatagacgggtcgattccgtcctcttcaataaatgccggttcggagtacggtccctcaggtttttcggatgaaaccacgatttggcggcgctttacatctacgtcgtcattatatctgagggtggctgtgatataaaactttccgttaaagtacgaaatatccggtgcccagtagcccctgccgccttccaaatcatctatgtgcgcccagtcgggatttgtgattgcatggcctataacttcccagtgcacaaggtctgtggaatgagagataggtatgcaggggaagaagataaacgaggagttaaccatataataatcacttcccacacgaacgatagacgggtcagcgaaaaatccgcgtcttatcggattgtgatacatatcctcatatttggctccggtgacctcttcaaaataggcctctatctcagcaagtccgttttcgtgagcaagctgatacggggtcacaaggtttttgtcagcgtcgcagggagacattccaacacgctcaaccaaatacttcacacattcaagactgcctgacataaccgcttcgtgcagacaggttctatggttcttgtctccgatattaaagctggcgaaagagtattcaataagaaaacgcagcatttcaaaatctccggttcgggctatataaaaagacataggaacgccgttttcgtcttcttcatttattctctttggattttcgtttaatatttctttgattttattcaggtcatggttctttataagttctatcatttcactcataacttttactgcccctttcaatatacagatatttcataaatacatatattctaacagtgtttaagaataaatgcaacatttattttaagtatatattacaatatatacgttccaaaatcaaagtgacaaattgagtgcatttaacacatcgcttgataaatatccgccaaacatacggcgtggataattattaatccaactttgaatgtattttatttttttatgtactatattatataaggtaaaatcaatcagcttgtttgcactcttgttgttactctttcatatatactgtgcggaaacgcataatataaacttgtgagttccccgtctattttgcagcttaacgtatatgtgtttaaaatgaaactgatttttactagatagaaaaacagacacgtgataaattatcagcttaagaatcgtttctgcggatagtgaaacatagcgtttattcagtatttttcaggtctgcttgttgacaaattttatcgtttatgatagtattacaaaataattgattagaatttttgtccgtattaaagcgggcttgtactttaggataaaaccagcagaattaggaggaaaaaccatggattttgtaatgagttgtttgagcgtcggcgaaaatggcaatctttctattggaggatgcgacgttgccgcgctagctgaggaatatggaaccccggcgtatataatggacgaggatcagattcgtgaaaactgccgtgtttacaacagggcgatgcaggagtattacggcggtaacggtatcgttctttatgccagcaaggctctttcatgcaagtatatttacagaatgatgaaagaggagaacatgggtatagacgttgtttccggcggtgagatgtacactgctttaaaagccggattcccggctgaaaggatatactttcacggcaacaacaagactgacgacgagcttaaaatggcgcttgagaacggtgttggaagaatagttgttgacaatgtttttgagcttgaaagccttaacagactgtcaggggaaatgggaaagaccgcggatatattgtttagaataaaacccggtatagacgcgcatacccacagctttatcagaacagggcagatagattcaaagtttggggtttcgcttgaaaacggcgaggctgaaaatataataaagatggctgacgatatggaaaacttgaatgttgtcggagttcactgccatataggctctcagatttttgagcttgagccgtttgaactggcggctgagaagatgatgacgtttatagccgaccttaaagacaaatatgatatttctataaaagagctgaatttgggcggcggttacggcataaagtatactgagggcgacactcctattgattatgacaagtatatacaggcggtgtctaaggttgtccgccgtatctctgaggagaggggaatacctctgccttatatagttatggaacccggacgttctataaccgctgaaacaggtctcactgtttatagggtaggcgctgtgaaagagataccgggggtcagaacatacatttcggttgacggaggtatgggagacaatccgagatatatactttatcagagcgagtatgaagctgtcagagtaaataatcctttagctgaaaaaacagttacggcaacattggccggaaagtgctgtgaatccggagacattttgattaaggacgctaagctgcctgaaatcaaagttggtgatttggtagcggttttggctactggcgcatataattattcaatggccagcaattataatagaataccgcgtctgcctatagtaatggtgagcggcggaaaatcaagattagccgtaaagcgcgaatcatatgacgatttgattgctaacgacctgtaaaccggaggaatttttatgttatttagtgttttgggtgacgcttcgatgaactttggacagaagctgctcaccatattagttttggtgttttgtgtgcttctgtcgttgtctgttcatgagcttggacatggcttggcggcttacgctatgggtgactataccgcgaaaagcagcggcaggctcagtcttaacccactgcatcatcttgaccctatcggcgctatctgtctttttctgtttggattcggctgggcaaaacctgtgccggttaatccatacaactttaaaaatcaaaagggcggtatggtgctgacgtcgctggccggtccgtttaccaattttattttggcgtttatcgctcaaatcggcgttgctgcgcttgggagcataacattcaggtctgcgaatattggttatgatatagcttcggttttctatatgatttgcagctatatggttattatgaaccttggtctcgcaatttttaacctgataccggtgcctccgcttgacggctcaaaggtgcttagctctgtgctgcctactgatttgtattttaaatatatgcagtatgaacagtttggttttatactgcttatcctgctgataaacctgccgtttttcagcagattgctgaatatgtgcgtgtatgggataatgggattttattctcagattatctcactgttcattcattagggataaattttagcggggattagtgattttgataaatggaacaattaaactttaaggttttggactttgagggccctctggatttgctgctggcccttataaaaaagaataaggtcagcatttatgatatacctatctccacaattgtggagcagtattttggcgttatgcgtcaaatgaaggaatataacctggacatttccagtgagtttttggtgcttgcggctactctgctgcaaataaagtcaagaatgctgctgccgaaacctgttgaggaagacgagactgacccgagagaagagcttgtgaaaaggctggaagaataccggcgcgttaaggcggccgcggagtatcttgaagccagaaagcatattggggagtcgatgtttttcaaagagcctgacaaaatcgagaaacctccggctgagtggaattattccaagctgacccctgaaaacctgcttttagcttataaacaggcttatcagaagatggagcggaaactgccgccgccgaaatattcgtttgacggaatagtggggcgtgaaaaagtttctgtgcgctcaaaggttaagcaaatttggggcaggctgttcggaaaaacgaaggtctttttcaaagaactttttaaaggaacaaaatccaggcctgaggccgttgcttcctttttggcggttcttgaaatgataaagctaaatcaagttaaagtcgagtatgatgagagcggagacatatcaaatcctatcgtaaccaaaagcggagacggggaacttgatttaagcgcgattgaggactaggagaagataaagatggaaatcagggaaattcaggccattgtggaaagcctgctgtttgcggcaggggaagcggtggagctggaaaagattgccgatatagttgatgttgataaaaaatctttgagagaaataataaaaaaaatgattgatacctataattatgaaaagcgcggtatccatataataaagcttgaggattcatacaggatgtgcaccagaggcgaatataaggattatgtttcaatgcttatgaagccgggcagaaagctgcagctttctaatgccgctatagaggttttggcgattgtcgcgtataaacagcctgttacaagggctacaatagagcatataagaggcgtaaactgtgactatatagtgaaccggcttatagagagaagatttatagccgagatgggacggatgaaagatgctccgggcagaccgatactattcggcaccactaaggagtttttgcagacatttggtatagagagtataagcgaccttcccgaatttgagtctttggccgtgcctgaggatactgacatggagcagatgacgattgatgagaagcaggaacagctggagtttaacagcgccgtttctgaggaagccgcggtaactgaaacatccgataaaaatattgaaaatgcaggggagtaatttttattcggcaagggatataagtctttttgtttgaaacgcatgagttttattagaaaactgtttagacgtgagacgatgtataatactgagaggtggtataatgcacgtagtttggataatacttggtataatagtatttatcatttgttttgtgctatggtcaaccgttacgctggatatagcctctaacggtaaaaaaactattattaccgccagtatgtacaggtttcttaaatatgaaatagttttgccgaagccatccgaattagacgaggacaagcaggagcctgacgcggagcagaaagctgataccacagaaaatgaaactatgggaaatgaattctctgaaaaagaatttcacggtaatagaagaaatattgcggagcagaaagccgggacggctgatagtgcagacaatgattcaataggaaaagaatttgatgaaaaagaatttcatagtaacagagcagattttaaagagcagaaagctgataaggccggcggttcagaaaataatgaggcagataataattcctctgaaacagataaaggattttatgaaaataaaaaaagttttatgggaacctttaaagaggatttaaaaagtatttgggacagtgaaaaccacaatcttgatattccgcggatatatgaagtgattttaaaatatactaatataataaaaagcggcaaatacgggcttaataagttttttggatatatgaagcataagattaggattaacagactggatttgtatattcgttttgggacaggcgagcctgataaaaccggtatgacatacggtgcgctgtatggtttggcaggaagcataagtcctctgctgaaaaagtttttcaagatgaaagacagcccaagactgtttcttgacccaaactatgtgacccggtgctttgaatttgaagtgggaagtataattaaaacaagggcggctcatattatcaatgccgcagttatagctcttgtgtcttatttaataaaaaagagaaaaggaagtgttgagaatgtcagaactatcggacaagcatccaattgaggggttgatgtcttctgcaatgcagggactcaaagaaatgattgacgttaacacaatcgtgggcagccctattacgacttcggacggaactgttataatgcctatttcaaaggtggctttgggttttggagttggaggctctgagtttcctaaaaacaaaaaactgctcagcggtgaacaggaagaggtcaataacctgttcggaggcggaacaggcggcggactgtctttgacccctgtgggatttttggttgttggcaacggcactataagaatggttccggtcagcgaggagaacagtatctatgacaggattatagacgcggttccgacggctatagacaagattagcgagataatttcttcagccaaaggaaagagcaatgtggtggttgaccatgaaccagcggagcctgacagttatgttccggatgatgaaagcgatgattatgttgcaggttcgtttgaaggctaggcggtctgcgttttagacttaatgattaggagtaatgttatttaatgctgattagagagaaagttctgccgtttatgctgagtatctttatttttgcggcttgtttcgtgggtacagagcctgcatatgcggcggataatcaagttataaatattgtgttggacccgggtcacggcggcactgattatggtgcgacttcggtcggaggcctggagtttcaggaaaagaatatcacgtttaagcttgcccagtatatacagctggaattgagaaaatacagcggcgtatctgtgaatatgaccagatatgccgactaccatatgaccaacgctgaaagagcggattatgctcagagagttggggctgatgtggtagtaagcctgcactttaactcgtcttcggacaggtctgtgcatggcgccgccgtctgcgcgtcagggctttgggaatatactaagcccgatttgggatataagatattgtcggagctggcggggcttggtatagatacgtcagccggggtttatactcaggcttcaaccacaggaaacatgtggtgggacggtgagcggttggctgacttttcaggcgttatgcgtgagtgcgcctaccgtgatataccggcgatttctgtcgagcactgttacttgagctgttatgacgagcttatttattataataacgacattgcgctgagaaagctggcggccgcagatgtgaggggaattgctgaggaatatggactgcagcttcaaaaatctgagggaaatgttgacagaacatacgataacgcatatatcaacggatatgaggacggcacattcagaccatcgggaacaataacccgtgcggaagccgctacaatgctggcaaaactcagcgatagttttgacccggatcagcagtacagcactacgctcagcgacgtgccggcgtgggcgtggtattataagtatattgcgtttttgaattcagttgggttcataaccggagacgtgtatggaacatacaggcctgacgacaatatgtcaagggccgagttcgctattcttgcctgcaggtatttggggcttcagccgggcggagaaagcggattcagcgattgcaaaggacatatggcggacggctacattgccgctcttagaaataatggttacgtcggcggtgatgaaaacggcgagttccatccaaatgacgacatgatacgttcttcggttgttatgatgatgaataggatactcggaagattcccggtttgcagcactcagaaagaaaatccgtttacggatatagctcccggattctgggcttatgacaatattttggaagcggcagtatcacacgaggttcgataattaaacataaataatattataaatgcggacaatatgtttgtccgtatttatttttggtttaaggctcgtattttgtcaaagtttttgggtcaatagttgaggaaactttgaatatattgatttatatggataatcaattcttatttttataggtaatgtttgtatgattgattgtttttacgtcatttgaaaacggagatgataaattgggtattaaaaaacataatgcggcaattaaatatataggggtctttttgttaacggcctctgttttgcttactaatttttatgccgtcagagctgaggatacggggacggtggggacatcagctcaggccgccgccgttatagaacagaactcaggcagagtgctgtataataaaaatgccgaccaggagctgcctatggcgagcactactaagataatgaccgccgcagtggcgctgaaatacggcaatctttcggatgttatagaggttagcgcgactgcagcaggagttgaggggtcaagcatgtatctggagtgcggtgagaagataactttagaaaatttgctgtatggactgatgcttctctcgggcaacgatgcggccgtggcaatagcggaacatattggaggcggagtggacggatttgtcgagctgatgaacaaaactgcctcagagcttggtttatcacatacccattttgacaaccctaacggtctgccgtcagatactcattacaccacggctttagagctggcgaaaataaccaggtatgctatgagtatgccggagtttgttcagatagtatcgacaaagagcaagacgataccctgggagggcaagggttatgacaggagcatgacaaatcataataagcttttgggaagtttagagggctgtataggcgttaagaccggatttacaaaggcggcaggcaggtgtttggtttctgccgtaaaccgaaacgatatgacattgatatgcgtgactttaaatgacccgaatgactgggctgaccacgcatcgcttcaaaacagcatgtttcagaaatacagccagaatgttttgacctcaactgaaatgataatagataagatttctgtagccggcggaatgctgggatatgctggggtcagcccgaataagacgtatacatttccggtttgtgaaaacgacagcgtaagcgttgacacaaatgttgacagcgagaatatgaagttcccaataaaaagcggcgacgtggtcggtacgggcacggtgacggtaaacggcgaaaactacgggaattttgaactgctggcaaacagcgatatagatttggctcgaccgtctaaaggcagtttttggaatgatatgaaaaatgatattgtatatgtttttcagtattggctgagcatgttccggtgagatatgaaaagttagataatttatataagatgagaaatataaaattatataacttatataaaatgatatgaaatataaaaaggaaagccgacagaaaattaagggttttgctttgcaaacctcggaagtgtttgcccctgcctgaagggtggtgtaatacaaagggatttgtattacatctactttaaaaaagtgtagtcacagtcctgccgaagcttgcgaaaccatatttttatatctttattatagaataattatatatttataatctaatatgcggtgtatatagtgaacatcggtagggtgtgcgcaagcacaccacgttaggtgagctgccatctcacgcggagcgtgaatatatatgaaacgatttgaaagtatcatttttatataaacttttccatgactgcacgcctaacgcggcaaactacgtttgcacatcacaactaagtgatttattgacattgaaggtttatcaatacaaagagatttgtatcacatacactttaaaaaagtgtagtcacagccctaccgaagcttgcaaaaccacatttttatatttatattatagaataattatatatttataatctaatatgcggagttcttagtgaacatcggtagggtgtgcttacgcacaccgcgttaggtgagccatcatctcacgcgaagcgtgaatatatatgaaacgatttgaaattattctttttatataaatttttccatgactgcgcgcctaacgcggcagatttcatctgcattgagtattcataataatatttgcgtattcatattattgacattgaaggtaaatcaaaacaagtcactttatatcacacccaccatactggtggggtcacagacattgaaggtttatcaatacaaagagatttgtatcacatacactttaaaaaagtgtagtcacagccctaccgaagcttgcaaaaccacatttttatatttatatttagaataattatatatttataatctaatatgcggagttcttagtgaacatcggcaggacgcgcttgcgcgtctcgttaggtgagctgtcatctcacgcgaagcgtgaatatatatgaaacgatttgaaagtatcctttttatataaacttggccgtgactgcgcgcctaacgcggcaaacgttgtttgcattgcatattcatattattgtttgcgtattcatattattgacattgaaggtaaatcaaaacaagtcactttatataacacccaccatactggtggggtcacagacattgaaggtttatcaatacaaaggaatttgtattacatacactttaaaaaagtgtagtcacagccctaccgaagcttgcaaaaccacattttatatattttttatttttaatatataacctttcttttatgtttagctttattgaagactttctacagaattatacgagacatataaaattatatgatgtatataaatcacatgagacttacaaatcatataatatatacaagctatataatttataaaaaattagacgagtaatataagatatatcaagtcaaataagatataaaataagcagaaaattttgaagtatttgtgcttcaaaattttctgccctttgtttttatttgcttattattgcggatttgcctgaggctttcgcttggtaaagcctgttatcggcaagattaaataaatcataaaactcatcggattctatttcgtcggaaccggcgcatccaacactgacagtcagttttatattattgccgttttcgtcggttgaatagctgcatgccggtgtaaaaatatcaaaaatcattttttggaattcgtcataattttcactttcgtatactataatgaactcgtctccgccatatcttgcgataaatgtgtttttataatctttaagtgaattattccaggattcagctaaataatttaaaatctgatccccggttctgtgaccataattgtcattgacttctttaaagttatcaatgtctaaaatagccaaacagactgaacggtttaactttttcattctgctgtagctgtttataaaatgctcttcaacatatctgcggttgtagacatttgtcagcggatcggtgataagctgtttgtttttatgttttaggtcgagtatggtgttaaacatttcgtcttcgctgaatataaagttccggctgatatccttaaccatttcaagtgcaaaactgcggccgtcaacattgatatatttggatattatataatataaattcttatttatattctcaaatttaacataaaaatccttgtctatcaaggttcttgcagaaatacagttggagcaccggctttcatttgaccagacgttaaaacaaaatccgtcttttccggtcaggccggccgatgataattcaggcatcagtttatccacagtatccgattctttcagtatttcctcagagataactttgcagataatagggtcgacaactctgactatgtcgaaggtatttcggaggatttttatttcacttattaattcgttataggtgtaattgtgtttcattataattctcctgctgttccggacaatatttgggattatccgcccaatctattatccaatttgttttatattataacatgttgtattttgtttgtaaataacagtcggttaaaatcatatatacaaacaagtcagacatatttattgattttctatcattatttaatattttaattttgagcttaaaaaatttcagtcattaaattttgtttgatactatgcgtgtagttttgcagtctgaattgaaccaaaaagcaacaaagccggctaaatatatgaactattttattctctgaattaaacgttgttttcatatggaaaaatctgccgaactgttttatatttttattacagccatttatttatgaaattaaataattcagtatttttcgctgaatgcagccgtatcagctttagatgaaactttctgtttgcttgaacattctttcgtgcacggctgcatttctttgcgtatcgaatgtggttaagcaacaataagttttgtttagtacctatttttatccatatacgtgtggaaatttttagtatgttttaaattatccacatattcgcagtatatcaagattatgattctgattgaatgtttctttttgtaaatttagccgccaatcagacgtacagattagcggctattagtaatttaacaatcttgtgatgaaaacagtccgaacttatttaactattttatatgttccgtatataacttttgaagcttccgctctcgtggcagaaccgcggggtttgaaacttccgtcctcatatccgttcataacaccgagacctacaagttctgcaaccgcgtctttagcatatgcggcaatatctgaattgtcagtgaattccagtatcacgccgtcgccgctcttgtttattgctctgtataaaatagtagccatgtcttgtctcatgataacttctccgataccgaagtattcatctgactgaccttgtacatatccggcgttgactgctgctgtaacatatggagcataccatttagtttcgtccacatcattaaaatgtgaggttgtgtctgtggcgtcaaggccaaacatctgaactaccattttgcagaactgctctcttgtgacgtttccgcttgggtcaaacttattgtcgcccataccgtttactataccggcatttgtaagaccgataatagattctaaagcccagtcatatccgtccaaatcagtatatggattttcgtctgcaaagttaggagctttggtgggatccggttcagtcggtgcggatgatggataaacggttccggaaccgttagtatctccgcctgtattgccaccggtacttccgccctgatttttgttcgggttaacagttttataagctgttactgtatcttcacctaaataatatgagatgtcattatatttgtaatagcatttaacgtgaacaacgtctccggttttatacatttttgtggtagacggcaaacttacggaaactgactcgtctccggctttaaaagccttttcactgctgttttggataacttcgccttttgagttgtatgcgtaaacctgaacagttgcgtcctggtctattatagcctttcttcttttgacggaaacagaccagctgtatcctatgtttataccgttagtgattgagaatatgggcagattgtcgcttacaacgtttccgtcctcaattttattgataattttttctattgaagacagcatatattctttatatgtgccgctgtaattcttattcacatcatcatataaactttgcgctatagtcttcagcgatgacagatatgttttatatagagtatgcaggctgaaactgttggcttttgagtattgaacttcaagagaagctatttttgtgttataattctcagccgttttgtcctcaagagttttcagcgctgtttcaatatatttattataatctgttagctttgataccacttcattgtattcttcagttgcttttgcggctcttttaagtgcgcttggaacagaggttgaaagattgtcaaatgtggtctttaagtattcatagtttaaagccgagctgtcgtcagttattccgtcataacattccggcatctgcataatccctgaaacttcctgcatagctttagcggctttttgcagggtataaaagtcagtaattgatttattgctgattgagagagcggtatcgattctttttttgcttgtttccatcatagaatcataaagctcaacagcggtgtctattcgtgcagaatagtagcttgagatatcatataaatcgtccttttcttcatccttataaaatgtcagcgctgatatttcaggcagagccattagagcatcataggatgactgttccttttcagtaaggtcaggcatatttgtgccttcaaccactgacagcgttgggttaataataagctcggagccgtcttttaaagtcgctgtaaatttgtcaatagacatgttatgcgaggtgattttattctttgatgtaacagacgcgtttgacaggacaaccgcgccgctcagggcggttgagccgttcttccaaacgtaagttatagttttatcgtccgttatggattttgaagtttcaccgttaccggcaaagctttcaccaaaggatacggagttaatttccgcattatcaaaagtggctgtaagctcaaagcctaaaatttcaggcagtgatgacgcagttttgaaaactaccttatatacgtcgtcttcatcggttgtataaactgttgcggtgactttcatatccatttcctgagcgccgggcgtggctgtgggttcaggagataccgtaggctcctcgggttcagcggtggctgacggttcaggtgaagccgtagcttcagtagtttcatcagtgagcacagtgtctgttgctgtgattgtttcattattattctctccggcagcaaagactgcaggagctgaaactgcggtagttaaaacagcggcggaaacaagaccgcagactagattgttcagttttttattcttcataactaacctcctgatatacaagaaaaattgtgtaaaacattaagcatagaattaattataacattcaaatatttaatatcaattaatcagcaattacaatagtgttacattcgacattatacgcatgttaatatatggtaaagccaaaacaaaaaatgcggaaactacttgatttataatattccaaatgttataatgtcaaaagctatatattgaaaggagcgatttttgtggctaaagagctgtcaaaaacctatgaccctaaggcggttgaggaaaaagtatatcaggaatggatagacggcgggtattttcatgcggaggttgatgaaacgaaaaaaccgtttactgtcgtcattccgccgcctaacgtgacaggtcagcttcatatgggacatgcgctggatgaaacttttcaggatattataatcagaacaaagagaatgcagggatataatgcgctctggattccggggactgaccatgcaggtattgctactcagataaaagttgaagaggatatgagagtcaatgaaaacgggctcaccagatatgatttaggcagagaaaagtttttggaaagagtttgggcttggaagaagaagtttggaaacagaattatagaccaattgaaaaagataggctgttcctgtgattgggacagggaacgcttcacaatggacgaggggtgcagcaaggcggtcagagaagtttttgttaacttatacgaaaaaggccttatttatcagggtacaaggataatcaactggtgcccgtcatgcaagaccgccctgtccgacgcagaggttgaatattcggagcaggaaggccatttttggcatattaaatatccgataaaggacagtgacggctatgttgagatagccaccacaagacctgaaacgcttctcggagatactgcggttgccgtaaaccctgatgatgaaagatataaggatttggtgggcaagatgctgattcttccgctggttggaagagagataccggttattgctgacgaatacgttgataaggagtttggtaccggctgtgttaaaataacgccggctcatgacccgaacgattttgaagttggaaagagacatggtcttgaggaaatcaaagtcttaaacgatgacgcaactatcaatcaatacggcggcaaataccagggtatggacaggtatgaagcaagaaaagccatagttgaagatttggacagacagggacttttggttaaggttgagccgcatgtccacaatgtggggggctgttaccgctgcggcacaactgttgaacctatcacctcaaagcaatggtttgttaaaatgaagcctttggctgagccggcggcaaaagctgttgagaacggcgagacaaagtttatccccgaaaggtttactaagacttatatgcactggatggaaaacgttcatgactggtgtatttcacgtcagctttggtggggacatagaatcccggcgttttattgccaggactgcggtgagacaattgtttctaaagaggacattgaggtctgccctaagtgcggcggaaaagttaagcaggacaacgatgtgcttgacacctggttcagcagcgctttgtggccgttttcaaccctgggctggccggatgatactgaggaactgaaatatttctaccctacctcggttttggtaacgggttatgatattatatttttctgggttgcgagaatgattttctcaggaatagagcatatgggtcaggttccttttaaagacgtgtatatccacggtcttgtgagagattctcagggcagaaagatgtcaaagtcgctgggtaacggtattgaccctctggagataatagacgagtacggcgcagacgctttaagatttactttggctaccggaaactctcctggcaacgatatgagattctatactgaaagagttgaggcaagccgtaattttgccaataagatatggaatgcgtcacgatttgttttgatgaatctttctatagataaatgcgaactgccggacagagataagctggagatttcagacaggtggattctgtcggaatacaatgatttggtaaaggaagttacagataatcttgataagtatgagttagggatagcggtttcaaaactgtatgatttcatttgggataagttctgcgattggtatattgaacttgtaaaaccaagattctttgaagagggcgagagcaatataaccgcccagcaggtgcttgtttatgtactgtctaacacgctgaaacttctgcatccattcatgccgtttataaccgaggagatatggcaggctttgcctcatgagggcaagagcataatgatttccagcttcccggtatataatagcgagtataaagacgaaaacgctgaaaaagaaatgcagatgataatggacgcaataaaaggaatcagaaatatcagaaatgagatgaatgttccgccgtccaagaaagccggaatctttataatcactgaggagccggagatatttgaaaacggtataccgttttttaagaagctggcgtacgcgtctgaagttaatgttataaaagacggcggcagcgttcctgagaacgtcgtgtctgttgtagttcccggagctgagattctgatgccgcttgacgagctggttgaccgtgcaaaagagatagagagacttgaaaaggaaaagaagcatcttgaatcagagataaagcgtgtcgagggcaagctgaacaataagggatttaccgaaaaggcgcctgccgcggtagtggaggaagaacgcctgaaaggtgaaaagtacagcgaaatgttaaagaccgttattgaaagtttggaaaagttaaaataaatattttatgcagtatatgtcggcgcttagggggctaatatggataatgtatcaatgggcggaggtttgaaggcggttgtatattgctctcataccggtcatgccaaaaaatgtgcggaaatgttctcaaatcgtttgggagtgccgtgttatgacattaagaatataaaagggcttggcaggaacagcaatattgtattctttggctggataagggctaacaaaataattggctataaaaaagctaaaggattttttgatatcaagctgatatgcggcgttggtatgtgcaaaggcacggacagcattatacaaagcttgattgagagaaatgatattgataagccgttttattatgttcagggcggagttaatacggaaaggctgagcggagtttataaatggatattgaatatagtccgatttggaattggaaaagccgttagccaaggtgtcagcccggacgaaagtttcgattctaaggctcaggcggagtatgaggataataaggagcttttaaaggatatacaaaataaccgcgaccatataaccgacagtgctgtggaagagctggttaagtattatcaggcgttaaagtaatgttatttatggcggcggggtatatcctgccgccatttttgataaaagattatgctgctgaggcatcaaaaaacgaattgttgggaggcactttggatgaaaaagcaagttaaaacaaacgctatgaggatattggagaaatcgggaataaattttgaggctgtattctatgacagcgatggatttatggatggggtttcggtagctgaaaagctgggtcaggatttaagggacgtatataagacgttagtgacagagagcaaaaatcacgagtattttgtgtttgtcattccggtggcagaagaactggatttaaagaaatgtgcggctgctgtggggcaaaaatcgcttgagatgatacatgttaaggatataacgaaggttaccggctacataaggggcggatgcagtccaatcggtatgaaaaagcagtttaaaacagtgatagacttgacggcagaggagcgggaagagataatattcagcggcggcagactgggagtacagattaaaatggctccaggaaagctggcggagctgataggagccgaatttttagacataacaaaataacaggcggcgaggattggaatgagaagtatgaaaactgatttaaggaatattcccggcgtcgggaaatcaatagagcaggatttaatagatataggtataaattgtgttaatgatttaaagggcagagaccctgaggatttatatctaagagacgcggctgtaaaagggatcaaatccgatccgtgccttctgtatgtgttcaggttggcagtgtattatgctgaaaatgaggagcgggatatggaaaaactcaagtggtggtattggaaagacaaaaaatatccgccggagaaataaggtgatgtattcggcggatatttttgataattctatttgattttttataattctatttaaagtattcacatattccggtataaattgcttctgcaagttttttttgatattcttcatctgtcagattttttaattcttcaggatttgataaaaatccgcattcaaccaacgctgccggaactttagcgtttttcagaatatatatcccggtttcgttctttttggcgacccggttattgttgttgtcaagattatttattaaagacgcttgtataagctctccgagttttttgctgtcctcactgttctgtgaataaaaaacctgagcgccgctgtattttggattttcaaatttgttcatatgtatgcttataaataaatcagcgccggaatcttcaatcagcgataacctatataacaggtcgtcttttttgacatatttgccgctggtgttattgagcagtttaacttcgtcactgtcacgggttaaaaccgcggtgtttccgtcagagttaataacatcgcggagtttcagcgccacagccagatttatgtctttttccagaattccgcttgcggacgcgccgccgtcaacaccgccgtgtcctgcgtcaataacaataacttttccgctcgcttccgcattggtagtaacagcagggtcgtcatttaagccgaaaatcattatacaaatggcggcaatcaccataagcgtacctaatcctattaaaattaaactattctttttaacagcaaaaaacacataaatcacctcagttgattatatgtgcgtctatcctatactagaacgtataaaagcgcctgcgtacaatataaataataaaataagatttatagacagtctttcaggctgggtcacagactttgtcggttagataaaacaagacactttgtatcatacgtgccgaagcttgcaaaaccacatttttatataaattattatagaacaattatatatttattatctaatgcggtgtatatagtgaacatcggtagggcgtgcttgcacgccgcgttaggtgagctgtcatctcacgcgaagcgtgaattacttatggaaggttgttataatcctttttaattgcaaattcatccatgactgcgcgccttacgcggcagatttcatctgccctgccgaagcttacaaaaccacacttttatataaattatcatagaataattatatatttattatctaatatgtggtgtatatagtgaacatcgggagggcgcatttatgcgccgcgttaggtgagctgtcatctcacgcgtagcgtgaattacttatggaaggttgttataatcctttttaattgcaaattcatccatgactgcgcgccttgcgaggcaaactacgtttgcattgagtattcaaattattgacattgtaggtaaatcaaaacaagtgattttgtataacatccaccttttcaggtggagtcacacctaccgaagcttgcgaaaccacatttttatataaattatcatagaacaattatatatttaatttctaatatgtggtgtatatagtgaacatcgggagggcgcatttatgcgccgcgttaggtgagccatcatctcacgcgtagcgtgaattacttatgtaaaattgtcataatcctttttattacaaattttcccatgactgcgcgccttacgaggcagatgaaatctgccctgccgaagcttgcaaaaccacatttttatataaattattatctaatgcggtgtttatggtgaacatcggtaggtgtgaccccacctttggtgggtttgatacaaagcggcttgttttattatagccttcaacgtcaataaattacttagttgtgatgtattgcgtgcttgcacgccgcgttaggtgagctgtcagctcacgcgaagcgtgaatattcacttattgtggtttgtcataatcctttttattacaaactttttcgttaaagaaataaatttgttttatccaggcggctgacagcagttatacgcataaacaaagttataaaatatctaaattaacagaattaaattaaaatcaccgcatatagttaaaatgataaaaatgtaaatttcatgaaaataaaagtattttaataaaacagcgagaaaaaaagagaaaatatcaattattactaatttaatcgaaaataatcggaaatatatgcgttgacttttggtctttcaactagtataataatcgatgttgctgttaagtgcggcacacgaaaagatacgggagcatagctcagctgggagagcatctgccttacaagcagagggtcataggttcgagccctattgttcccaccactatctttttaacatatgggagcatagctcagctgggagagcatctgccttacaagcagagggtcataggttcgagccctattgttcccaccatatgtggtccggtagttcagttggttagaatgccagcctgtcacgctggaggtcgtgggttcgaaccccatccggatcgccattacagcttaagcaaattaagctgttttgcctctgtagctcagtcggtagagcaggggactgaaaatccccgtgtcggtggttcgattccgcccggaggcaccattttttgcgggagtggctcagtggtagagcgtcaccttgccaaggtgaacgtcgcgagttcgaatctcgtcttccgctccaactgataaaagacgcatatttttgcgtcttttatcataattattaaagcaggataaaaattttaaaatgtgtgcataattatagaatacaaaaatataattaaataaggcgccatagccaagtggtaaggcagagctctgcaacagctttattccccagttcaaatctgggtggcgcctccaatattatcggggtaagtttgcttgctccgatttttttatgcaaaaatctattgtctgtgccgccgcttctcattttttacataatctgcggttttgcagaagccctgaaattgttggatgaaatgcaagatatttaagtattgccaatattatcaataatattttgtgctttatcgtgttttcaagattaccgtttttataggcgataatttttattaacttctttatatataattgtttttgtatctgtatatctgaatatctgaatctttacaatcttatcatggtatatcaaacattcaactatatcctagaattatcttaaattttttgttataaatcatattttaaatttactgattttcaaagtttgcgacagatgacatttgattgacatatctgctgtcttaaagttaagtatctgctttattgcgtcagttcatattatgatattgtatttattgataaaatgggtattagtcgtataatctgcggatatatccgtagttatttattgttttaagtcggttagactgcaaaattggacttaaacaacactctcaaacgcgaaggggttatcttagtatacacttctttgtaagcgtgaatttagaaaaaattgacagccgtattaaaatgaagaatagatgtttataaattatatgggggtgttgtaatagatttatgttagcgatatactgcaagtaaatctacggtagccgtgagtgatatatttgtaggactttttaattgtgtttcatttcaatcttatatataaacggctgtttgaagtgttaagcaatttggggatataaaaaattcagattaacgcacacagtttggattgataattttttatttctgatattgtgtatattaattcgcataaatttgtgtgacagggcagaatttgattgagtgaacaagtttgattaaatttatttcaactcaagtatcccgggcagatgcggattgtcttttatacaatatatattattgcaatattattttaatccacatcatcacaaagcttttaaccgtgttattttaggtatgaatttttcagtttacgaacctacacgggtgcggctaaagatagggaattcattggtgatattgccaacaaagcaaaagaactgactaatgttagccagctccggaacgataacaaagggtggtacttgccggcgtctgttttatcaccattataggcaagtggaaacatcaaacgtaaaaaatataaactaaaatacttactttgttctgtataatatttttatattacattaataaaggagatttttatataaatattttaatttacccgctcatgtagggtacggcaaaataaaaaacgcttacgcacctcctgaaagagattttaattcacgcaccattatggtgaacaacaaaaataaatcaaacttgatattataatatattaagctttcaattcacaccccagcaatggtataacaaaaaagccccgatttataggagcatatttatatttcagaattttgatagtagaggccatcatataatctttgcaataatatgccctcttcgttaaggtcgtaattatcatcaaaaccaatttctgttattttatcatctaattcggtcaatagtaaatcaatatcagtatatgactttttcaaatattttttcacaagttctttttgtttctcagtaataatcatcacttaaacttcttccttccggtcgttggtttaacctgtattaacacttgagtatcatgattaacggcaggcgttaacaagtcgtcaataaatatttgactttttccatgcttcaactttctaatatcacctaattttgcaggattctgaagcacgtctaatacatcattacattattacgtttttgttcagccggccatatcaccaataatataaaatgctttgatttatttgttatcttcatactgttacttgcagtaatgccaatcaagtttttatctatttcttttgctaatatttttacatttcaatccacagtcgagattatggtgggtttgactattggtaaaatataccacaggctgtatctgtgtccaatttcaatccacgcaccccgcatgggtgcgacggttggaaaatacaatatcaaaatatatctatgatatttcaatccacgcacccatgcggggtgcgacatattttctgcatatggcgtcaacaatggatttaagatttcaatccacgcacccttgaggggtgcgacaaaaaaggagagatatttatgggaaacatgatcatttcaatccacgcacccttgtggggtgcgactgcaaaaatatataaaaaataacatttgtattcctttaatctagtatattttgctttttaagcaaaatatataatataagattaattattacatacattttttattatatatctttgtttttaatggtgcgaacctcccggtaattttatgcgagcttaccattctcatctatatcattttagcatatttttagagataattttatatttataactttttaattggtttaatttcttaagcttatactaaatatgtttattttttcctgttacttattttatatcacataatgtaatataaagcaatatatttttttaaaatatgttaaaaaataaaaaattgcattaaaatataataaataatatgaagaggaatattataaatacttggaataacaaatggtttaatataaaataaactgcagaaataatatatcatattaaaaatgtttggctacaagaagatatataaataatttaatatttgatacttttatgatataaattttgaaaataataaaaattagggatgttaaaaattcactctgtagtttaacacagattatacaaaaattttttgtcattataattaaatataaaattttctcccataccgtatcgggttatattattagaatattctatgctcaataatcctttctactatatttttttataaattcagcatcttagaaaaatcttgatttacccaatcagccgggcataaatcagaaacagttgacttcactgaagtttttaatttatatgtatttaaaagatgaaacaaaataattaatggtgttatggataaagcaataaagtatttaggaattggcataactgataaaaaatcgattttgctgattaaatcctaatttgaatttaattgtttatcagaacttaaattcagaattatatatgatacttaagtaaattaagattaacaaaatatattgataattaaagttatactatgtcacgcactggcactaaagttaatttacaatgataatagattcatatatatgatgctccgctgtcatgagaaataacaattcacagcagttttgtggttataataatttgacagcgtaaatttaaaaaataataaaaaatttggggtggcattatcgtttgctgaaaaggcgggttgtaatgttgttccgtaacaggggtggcactgccgttcgtataaatcgggttgcagcgttgttccaaaggagaattcttatgggaaaagaagcatttgatttctttcctttagacgtgcatcttgcgagcgccctttggagccgcaggcgacctaagcgagcaagcactttttctttggtgaagcgtttctttttcttgccagaaaaagaaatggttcaaacaccctattatgtaataataaatttttttatatggggtcatatacatagtaaatatatagttttttaataagtaaaataataaatattacatttatatattgaacactacgtgttcagatgttggctcacctaacgcggcggcatagccgcccttccgatgttcactaaaagcccactttttatcagtatattaaataaaaaagatacgtttgtaatttatacaacgtatcttttaacttattattccaaacgatttcgcatatgcttttattatttcctctgcatggctactttgctcaggtgacatttttaacaatatttcatttagtggattgtgattatctcgtgtgattgttccaaacaagatataatctgcatctatatctaatatcctacatatttccattaatgatggaattgataatccgcttaaacctctttcgatttcactaatatgctgactactcacgcctaatttattcgctacatactcttgagtacattttttcattgtacgtgcattacgcaaccttgtacctattggtccatagtcatattattttattcttattttctaatacataaaatcaaataaatttacacgttaaagtatttttatatcgcctgcgttcattcacggtagttcacaaagtcaacgggaaagttacaaggctttttcttttgtgcgtggagcgcaaaagaaattagcgggggcgagcgccctttggagccgcaggcgacctaagcgagcaagcactttttctttggtgaagcgtttctttttcttgccagaaaaagaaatggttcatacaccttattatgtaataataaaattttttatatggggttatatacatagtaaatatataattttttaataagtaaaatgataaatattatattattccgcggcttcgcacctcacgcggcagactgcgtctgccctaccgatgtttgaaaaacctaaaaatttttttataaaaacaatgtacaaggtttagtttcaatgttttgcatgcctctatttataaaataaatagtttatactaaaataaaaggcaacaaattaatatactttgcccatgcacaagactttgtgcttctgcattaccgcattgctcgtaagtttcgacacaatatattataatatgtttaaacaatttggaataatttggaggtaaaaataatgggtagagaggttggttttaacaacagagaccgttttgttgaattaggtcttgttatctctgcaataagaaaatctcaaggcttaacacagactgagttggccgaaagagccaaaatcagccgttcacatcttagttctattgaagctccaaatataacgcaatcattttctttagaagtgttgtttaatatctctgatgctcttgcaatacgagccggcgatttgttaaatatggaatttccatcagttgaactttattatgaaaatgaaaacaaaactaatactaaaaaaaataaaactaatggataattacattagttttattttttaatataaaaacttttaaataaatcccctcttctcgacaaagtttgctaaaatttttatttattaaattatacaatcatataaaaaaacataataaataaaaaaagcttggaagggatttaaagtgaaaaaacttcacataattataataacaatactactactgctctccgcatgttcagcagccatattcttaacccagaaccctgcggcaacagtcacagaaacatcagcgctgacatcaccatacatattatcaacagaaataacgccgtcagcggaacagccgtcacaaacagattcggcacaaacagcggaaaagcccggcgccgggcaactgacggcgcacttcatcaatgtgggtcagggcgactgtgagtttatcgaactgccgaacaatgaaacaatgcttatcgacgccggggattcgggcagcggtcccgaaatcaccgcatatataaaaaacctcggctatgatactataaactacctcgttgctacccaccctcatgccgaccatatcggaggaatgtcctatgtgattaaaaacctgaacatcattcatatgtatatgccgaaaaaatcaaccaatacaaaaacgtttgaaaacctgctccaaactatactggatatgaacatttcagtggaaaaagccgaatcgggaacagagattttaaacatcggaaacttaaaaatcggtatcttggctcctgactcagaagcatataagaacttaaacaattattccgctgtaataaaaatggactataaaaatacctcattcctgttcatgggggacgcagaaaaagagacggaagtaaaactgcaggatgaagacgttcaggcggatgttttaaaggtcgggcaccatggttccgacacctcctccacaacggcgtttttggaaaaagtctctcctaaatatgccataatttcctgcggcaaaaataataaatacggacacccggacagcacagtgcttcaaaatcttgaaagtataggctcggcagtcttacgcaccgaccagctcggtactataattattcgttcagacggcacattattaacacagttataagttaacagtttcagaagggcgcaatttttaaaatcttgactcatataaaaaaataaacacacaaattttatttgatattggccgcaaaaatatcaataaaagcctaggattgcgcccttctgaaactgttaagtacacccgtatgcgcctgatagaaatataatatatttttattaaacttgcaaaactataatgcaggcactcgtccgctttgaaaattcaatagaaaatttaagagtgtttttagtaaacagcggtagagttataaatgtgaccacacctgcaaggtgtgtgtaatacaaagttacttgttttgccattacctccaatgtctgcggcggtacttttgtttaaagggtatgtatataaacgccaataattaacttggttgtcatataataaattacttagatgtaatatatgcgcttgcacacctcaataggcggtgaactgacatatcacgcgaagcgtgtacatacttagttaaatttggataactccctttatatcagacttttccgagacttgcaaaccgcatttttatatatttttaatttaaacagctttaattttttgtctggttttcactttccacattaaaggctttaaaggaaagtgtattatggcttacacacatcttgcaggtgcggccctttatgaatttaaaaatcgttcagtaaattaacatatcttatctttcattattagataaaagactttataaaaattctcctaaaattttataaacacatgtatttttttcatgttttgggaaagacttttatctgaggtgataaaatgagtaaaaatccgaaagacagagatgacagaaacaaagggagaaatgacaattatgaccgtagaataatagtcgatccgcccagcgatgagcagaaaaagcagccggaagaggccgtttcatcaagaagaaaaggattttacataatccttttactggggattacggcaatcggaatttatgcggttctgaactcactgcttccgcacaccactgcaaaaaaaccaaatgaaaccaaaaccggctcagcctacagcactgcggcgccaaactatgacagcgttcccgcaaacgctcagacaacaccatatgacgcaagcgagccgctgagcagaaacgaaatcaactctcaaactcaaaaggcaaccgaaaagcctgacgctgaaacaacatctgattccgaagcaacagaactggttcagccgcctgtgtccggaaaaattataaaagatttttctgactctgaactgctctattctgacacgatgaaggactggagaacccacgccggagttgatatagccgccaacaaggatacgcctgtaacagccataaaggacggggttcttaaaaaggtatacgaggatagtcttttcggcacaactgtgattctgcaccatgacgacagcggaatcgacagtgtatactgcaatcttaaagacgcaacgtctgagcctattggcgcggcaataaagatgggcgatgttttgggcaaagtcggaagttcagcagtgtctgaagtgaacgaccagccgcacctgcactttgaaatcaaacttgacgacaacttccttgacccgaaacagtttgttaaatttgaagaagtagattatgttcagccggagccgtccgcttcagcgtcggccagcgctgctacttcaagcagtgcggctcctacaacttcaaacagttcggctcccaccacttcgaatcccggaacggcttcacctgacaaatcatcgcctgaagtttccggcgacgactatgactacggtgatgaagacgctgaaacaatgataattgattaataaaagaccctcctatgaacattcataggagggtcttttgtctatgatggcggacacgtcttttaagacggttacaacaataaagcggataaaaatactggggtcaagtgtaaaatcacgcggagcgtgaacattcttaaataagtatatcataatattttttactaatatttttttccgtggctgcgcgccttacgcggcaaacatagtttgcacatcacaactaagtttgattgttatatgacaactaagttaattgttggcatttatagtttatatcacgttatataaactgcagagcaataaatttcttagttgtgatgtattgcgcggatacaccgccgcgtgaattgagctatcaactgaacacgtagtgttcattatataaaatattcattataattaactttgtatataaccccatataaaataattttattattacataataaggtgtttgaagcatttctttttctcgcaagaaaaagaaacgcttcaccaaagaaaaagtgcttgctcgcttaggtcgcctaacggctccaaggagtgctcgcccccgctcatttcaccatgaagcatggcttcatggtgaaaaaagccctgtaactttcccgttgactttgtgtactaccgtgacaaaagatatttcgagctcatattgattcaatccattaaaaaagtcaatttttcagcgaacattggaagatgtgaccacacctgtagggtagatgtgattctttttaattcgttttgatttatctgcaatgtctgtgaccactcctataaggcggtcaatgtcacacactgcaaggttcactaaaaacacctttaatttttctgttgacttttataattttttattattaatataaattacatgattattatttggattgaaacaattcatacagtgtggggctgaaattaaactctttcatcagcgtttcggcttttgtttttgcagtctccctcacaggttttgaggtgctgcgctttacagcttttattaaaagatttttaggcgagtgctcaaaatccacaaactccagcatttgcactttatagccctgccattccaatattttcccccgtattgcgtcggtagccaatgctgaaaaacgttcctttatcagaccgtaatctgtgagcgcagaaaagttttctgtctctatctgtccgttcagctcatgctgacagcacggaaccgatattatagcctttgcattccatgatactgcgttgtatagcgcataatctgttgccgtatcgcaggcgtgcagagtaatgaccatatccggcggagttttaacgctatatccgtttatatcccctatttcaaagctcagtccgtcataccgatacttttcagccagtttattacacttttctattacatcagcttttaaatcaagacctgttatgcttactttcatttttttaatctcagtcagatagtaatataatataaatgtgagatacgactttccgcagccaaaatccagtatgtttatactgctgagttttaaagagtccacaacattgtccgctatctcaacaaaacggtttatctgcctgtatttatcatacatagagctaacgatatgtccgtccttagtaaacacacctaaatcaaccagcggcggtattgacgtgttttcctccagcagatactttttctttctgttgttgccggctatggcttcgtcagttttactcgcaatccgcttttttatcagactttctttgcctttttttgaaaccttcagcatatagaaaaaatccgcgccccaggcgtcgagctgtctgaagctctctgaccgcattatctcctcaacggtgcctgttatcaaatccggttctacgttctcgtgaaaaacctgtttttctgtgtagcaggcgatttgatatttctctgtgccgccgatttttttcagctctatttcaatctttttatatttgccgtctttatgttttggattgcttattacagcctttaagattctttcactgaaaattgtttttatatattccatttcagttcctcctaaaccacaaacccgccgttgacgccgataacctgaccagttatgaactccgctccgcttcctgacagaaagtaagccagctcgcccacgtcacggggttttccgattctcatcaccggggtttcggaaatcaattctctgacagtattttcatcaagccctgcgttcatatctgtatctataacccccggcgctatgcaattgacccttatattcgaggggccaagctcttttgccagcgccttagtcataccgataagaccggatttggccgttgaatatgccacctcgcacgaactgcccacaactccccacatagaggatatatttattattgagccaaaatgattgtttatcatatgtctgacaacgccgcgcgtcactctgtacggaccgtttagattgacctccataacctccgaccattcttcctcggttatatccgtgaacaaattaaactttgaaattccggcgttgttgataagtatatcaactccgccgaatttatcttctattttatcaatcatgctctcaacttgctccggcacgcttatatccgcttttataggataaccgcccgtctcctccgccagagcttctgcttcaccggcggatttattatagttgattataacgttatattcgcctcggtgctctgcaaatacccgtgcggtttcagcgccgattcctcttgaagctccggtaatcaatacagttttcataaaaaccacctttaaagtataaaggaacggtttaaaccgttccagtatttttttaaatattgaatttatcatgtataactttaactgctttttcagcattttcaagctttatcagaaccgaaaccttgatttcggaagttgaaatcatatgaatatttatgtcattatcaaacagagcctcaaacatttttgcagcaaccccggggttgttcaccattccggcaccgacaatagaaacctttgacaggtcatccctgtggttgacttctttataatttaaaatatcctttaacccttccaaaacttccagcgttttagcctcgttctcacgcgtaaccgtaaacgctatatcctttgttccctcacggccgactgactggagtatcatatcaacatttatattctcctgagcaagctgagaaaatactctgaaagcaatccccggtgtgttttcaagaccaacaaccgctattctggcaacatcgttatcacgagttactcccctaatcaacattttttccacactaactacctccttaacaagagtgcccgacactctctcaaaactagatttaacttccaattttacattatacttcttcgccatctcaacgcttctgttatgaagcacattcgccccgaggcttgcaagttcaagcatctcgtcgtatgtgatttcatccagcttttttgcgtccttacagatacgcggatcggcagtatagaccccgtcgacatcagtataaatctcacatttatctgcacgcatagcagccgctatagcaacagcggaagtatcactgccgccgcggcccagcgtcgttatattatcatatttatccaagccctggaatcctgcaaccacgataatatttcttctgtcaagttcagactgcatacgctcagtatctatattgttgatacgcgcatttcctgacgcggcgtttgtattaaaccctgcctgccagccggtcaaagataccaccgggcatccgattttttctatcgccatagccaaaagagctatagaaatctgttcgccgcttgaaagcaatacatccatttcacgctttgaagcgtcaggatttatttcattcgcctttgtgattaagtcgtccgtggtatcgccctgtgcagacactaccacaataacctgatttcctgccttataagtctcggtaaccctctctgcaacattgattacttttgcggcgtcagccacagaactaccaccgaatttttgaacgataagtcccaaaaaaacccctcctgtttttatatatcttttcaaatgagaattccatgccgtaaacacagttttccttttgaaaattctaaaataatttacttaggtattttctattatacacgctccgagattatcgggctttaaaagatgaagcttccaatccttcattttgcttataagcaccttgctgatgttgcagttaaacgcttgattgtcggcttttataattgcaattatagtcggtccggctccgctcagatacacgccaagcgcgccgttgtcataacaaagcctgaacaggctgtccatattagggataagccgctttctgtaattttgatgcagtttatcgcctactgcggttctgatgttttcatacttcccggacataaggcttgctgtcagcagcgcgctgtgcccggcgttatataccgcgtcgtcatgggacacggatttaggcagaacccctcttgattttttggtttgaagatagaagtccggcactagagccgcaaaacacaaatctttcggattaagctcagtcttaacataccgtatagcatatttggttctgacattcacggtaaatccgccgagcagagcaggcgtcacgttgtcaggatgaccctcaatatccgcagccagctttaacagttcattcatagacagtctgtctccggaaagtttattagccgcaactattcctccgactattccggcgctgctgcttccaagacccctggtaatcattatgttattttccagggtgagtttaagaccagggcatttatggccgaccatctcaaaaactcttttcatggatttatatattaagttgttctcattttcaggcaggaatttttttgagtcatccaaaatattaatctgcagtctgcccgaattattttcctcggcggtaacataattatacagccccagcgcaatacccatgctgtcgaatccggggccgatgttggccgatgttgcaggaactctgaccttaaccattttattcagccaccaatcttatctttcccaaaacgttatatccgccaagctcgccgtcaactgacacaagtttgtcaaattcataaccggtcatttcaggcgttacaaccgcaaactcatctttatatttctcgccgtccaaagttataacatcgtatccttttttagcaaacgtctccggagccgcctccgtctttgaaagcctcacataaaatcttgacggcaaagttttggcgtcgagcaaatagccttcctgcccctcgctccagcctaacctgatatgcttatccttatgcttcacagtatctattatatctgaaagcaccgcgctggctgtcggaagcgctccggcgccgcggccgtaaaacatcacgtctcccagcccctcgcctctgaccataataccattgaatacgtcatctattcccgcaaggggatgtgaagaatccagaatagccgggcaaaccatagcataaacgccgttttcagcccttgaagttatacccagcaattttattactgcgccgaacttagccgcgtattccacatcctcaagggttacttttgtgataccatcgcacggaatctcatcactgtcaacaaatttgccaaacgccaaagacgccagtatggcagtcttacggcaggtgtcgtgaccttcaatatcagcggtcgggtctttttcggcatacccgttttcctgagcgcctttcagtgcgttctcaaaagtttccccttctttaatcatttgggtcaaaatgtaattcgtggtaccattcaaaataccatatatatcagtaagctcatttgcggccaaactggtgtaaagaggtcttataatcgggatacctccgcctacgctcgcttcaaacaaatagttaacgttattgtccttagctattttaagaagttcggttccgtgttttgccacaagttctttatttgaagttacaacgcttttaccggcctcaagcagttgttttgtgaactcataagccggttttgtgccgcccatgacttccgccacaactccgatttcagggtcgtttaaaatatcctgaaagtccttagtaaagcatttatactgactgtccggaaaatctcttaaatccagtatcttcccgactgttatttcctcgccgctgcggcgttttattgattcggcgttagtggcaataagctctccgacgccgccccctacaacaccgaatcccataattcctatcttcattggtatattcctcctgctctgttatcttctaaaaacataaaccggttatcaagttaaaaatattagtcaaacttattaataactatacccgttatgagtttaggccagaaataggtggatttttgaggcattttctcattagccaaagaaatatcctttatttctgaaatctttgtcgcatttatcaaaaacgagcattgataatcgccgttctttacacagttaaccgcgtcagacgcgtctcttgtatatacaaggtgatcctggttggctaagcttgcatcatctatatcaaaatacttttctaatataagcttatgcagtattgtaacgtccaaatatttataagcattgctcttatcctttattaaatcatccattatatgaacatctttgagttcaagcaagtaataataattcccgccggtatagaacgcaaacctcttttcatcaacggtgttgcgcagtttagtcattattatctccgcaaaatcgccctcggtgaagtatatcttagacgcgttaaaatcatcggtcagcatactgattgtaagctgttcagagaagtttttaacgttttttatcattctgtgtgttggaaatacaaaaagaccgctgtcgtccatggaaacaagcatcatcatagtatagtcatacgactgtgtgccgatttcagttccgtcagcttcatgacgggcgtttctgtaattcagagcagtctcgtatctatggtgaccgtcggcaataaacaattgcttattttcaaactttttagaaataacattaattatagccgggtcttttataatccaaatattttgaataacattctccctggttgtaaaactaatatcgggagctccgtctgaacactctgaaataatatcagcgattgcctggtcaggatccatataaagcgaatatatttggctcatatttgtcttagttgcttccattaaatcaagtctgtcacgctttgcctttttcaaagtttcctcatgaggcagaataactttttttgagaactcctcaagctgaaccaaagagataatacccttcagcgaatgcgtcggagattcttcagtatcaagctgaaaaacctgctcatagatataaaatgccggttcgtcttcaaacacaagaacctgttcctctatccacttattcaaatacgccgcgcttctggtatacttgttattgtcagaatcatcgctttcaaattccataccgtaatccaagcgaataacgttatactcatccttattataaagctcctgctgttcttccgctgaaattatgtcatacggaggagctgtaaccatatctaaatctttaaatttttctgtattatatctaagccctttaaagggtactacttttgccattattatcatccttccggaataatttaattttcgcgctgacaaatgttacagcacggacaaattatcataatcgataacatatcatattagataatacaacatatttgtcaatacgtcaaggtaaatttactctgcgcatgtaaatattttcccaaaaattcctggattttttagatttaatctacaaataatattattgtgataattaatgaaattattacaaatctatttaaacatagtagaatttgttggaaaggagaaacccatgggaaaattcagtaccggtatgcttcttggaacagtgtttggaataggaattctaatgctcgacaagaagaatgttaaaaaagcaaaaaagatgatgaacggaatgcacttttaacctccaaacaccaattattaagagccgcacaaatttgcgcggctcttagttttataaacttaataataaaataatatcaaccatttgtatataaacaaatggttcgcatgttgcgtttactcgtcaaatgcagtacattaaataaattctaaagccaataaaattaatttcaactacggttaatatttaaaatataatactttaacttaaacattattctctgcatttccgtccctattaacttcaattacatcggtacgtccgagtaaatagtcaactgaacaatcaaggtaatcagcaatctttgcaagattattagctttaggcattgaattcttcatatttgacatagtattaagtcctaaattaatatctttaagcatttttttgacggtgacattgcgcatttttgctactagcctaattctatcagcaaccttgctggaaatatacataaatttaacctccatattttgtgcatttattactaatatctaaatttagatgtttcaccgtcgacaacaactaaacttagaaatgcagtattttcataacagttataagtttcatatgactataccatattacacctgtagatagtaatataattaatcaagagcagtttaactgctacaaaactattataaaactttaaaattattgttttcagtatttactgcactgctgttaatttctattacatcagtacgcccgaggagatagtcaacagagcagtcaagacaatcagcaatacgttcaattttatctactgacggtattttattttgcttttcaatatcataaataaaacctttatttataccgcatttttctaaaaggtatttaattgaaattcctttttgcttagctcttagttttattctttctgtcatttgtaagttttgcataagacattttgctcctttttgttaacaagcgataattttccacaatataagtaaaatactcggcatatttttttgcggtataataacacatttattatattaaaatcaaattactctataaaattataatttaatcatctaaaaagctattaatgaaaaattatataataaaatgacataatttgcaacaaaattaaaataaaaaatatgtatggcgattatactttaaacagttaacatctataactgccttaatattacatataaatttatgttaataatttttgaaataataatttaaaaaaagataatataatttatgaaaaaagaagcaggttttgaaaacaggaaccctttcgttgagctgggattggtaatttcagttttgagaaaagccaagggctacacccaatacaactcgaagagagggcacaaatcagctgttctcatcttagttctattgaagctcctaatatatcttcctaattttctttagaagtattcttcaatattgctgatattttagaagttaaacccggcgacctgcttaatcttaatttgccatcgtcctattttaataaagatgaagaagagaaaaaattagaagataagtagaggaagtaataaaatgtatttaaaaagatgaagaactctgcgtataaatgcaggattagggcaaacaaaaattgctgaaatattaggaatacaacaaacggtatactctcgatatgagagagggtttcaaactatactgttacattttccagtgaaacttgcagacttttataataaatcaactgattacatattaaatctcacaaatgaaataaatccacattaaagtaataatatttacaaatatattgaacactacgtgttcagatggtagctcacctaacgcgcttgctagcgcaagcctaccgaggttcactaaaaaacctacttttttatgtattataaaagctgaaaacttagttttttgataagttaaactaataggaactcggaatatttttattcacggcagttcacaaagtcaacgggaaagtagtagggcttttttcatcatgaagccatggcttcatggtgaaatgagcggggtgcgagcgccccttggagccgcaggcgacctaagcgagcaagcactttttctttctttgcgtatacatattattgacattgtaggtaatggcaaaacaagatactttatattacacacaccttgcaggtgtggtcacaggtaaagcgtttctttttcttgccagaaaaagaaatggttcaaacacctattataagtaaaataatatatattatatggggtcatatacaaagttgatatatattatttttaataaacaaaatatatttattaaatttatatattgaacactgcgtgttcagatgatagctcacctaatgcggcgcataaatgcgcaatacatcacaactaagtaatttattgacactgtaggtaatggcaaaacaagcctctttgtatcacacccaccatactggcggggtcacaatacatcacaactaagtaatttattatataacaaccatgttaattattggcatttatagtttgtataacattatatagcttatataacatacacttttaaacaaaagtgtagccacaattgacactgtaggtaatggcaaaacaagtctctttgtatcacacccaccataccggcggggtcacaatacatcacaactaagtaatttattatataacaactatgttaattattggcatttatagtttgtataacattatatggcttatataacatacacttttaaacaaaagtgtagccacaattgacactgtagataatggcaaaacaagttatttagtatcacacccacctgaaaggtggggtcacaggccttgcaggttcatcaatacaaactactttggcttacacgcaccttttaggtgcagcaccttgcaggtttatcaaaataagacagtttggttataaaatataatcacttatgataggttattccggcgcttattgtaaacgccctatatatctgttccagcagaattaccctcatcagctgatgcggaaacgtcatctttgaaaaactcagctttaaatcagaaattgattttatgctgtcatcaaggcccagtgaccctccaattataaatactatatggctttccccggtaacagaaagggactctattttttcggaaagctgttctgatgaaagctgctttccttcaacgcaaagggaaattatatatgcgcctttcggtattttcgccgcaatcttctcggcttccttatttaaaacaattttctgctgcccgtcctcgttgggttcatctttaacctgtatgatattaagcttgcaaaatctgctgagacgttttttgtactcgtcgacggcgccgcaataaaacttctcttttatttttccgacgcaaatcaaagttatattcaacataatatatccctctttaaagcttacataacaataggtgccgcaaactgtacggcacctatttatttaagcgtttggtttttctttaaattctgtcttcttcatggaaacgtcgccggtttcctcttttatatctttctcttttctggcgttatccgtatcattcataacctcaagcgccgcgtcaatcgcctcagcgtcgccggtttggaacagagcgtcaaactcgtcgccttcaattttttctttttcaagcaagagttccgccacttttttgagattttccatattttctgtgaggattactttacatctctcatagcattcacttataatcctatggatttcctcgtcaataatagctgcagtttcctggctgtaatcagccgaatgtccggcttcgagccccaggaacacctcgccgttctgttcgccgaatgttcttgcgccgagcttttcactcattccatactttgtaaccatgctcttggcgattttggtagcgcgctccaaatcatttgaagcgcctgtgcttatatcatccaaagttaaactctcagcaacacggccgcccagcaaaactattatttcttcaaccatttcggttctgctgttataactggtatcctccttagggagcgacaaagtatatcccccggctctgcctctggggattatagaaacctgatgaaccctgtcctgtgtcggaagcatctttgacacaaccgcatgaccggcttcgtggaaagcagtaagcttcttttccttatcggttacctttttactcttcttttcaggcccggcaaccactttcatgatagattcttcaaggtctatcatgtttataaccttcttatttgcgcgcgcggcagctaaagccgcctcgtttacaaggttttcaaggtctgcgccggtgaatccgattgtagtcttagctaaaacgttaagtttaacgtcatcgcccaaaggcttatttttagtgtgtacttttaaaatcgcttcacgtccgacaacatcaggcgcgtcaaccaatacctgtctgtcaaatctgccgggtctcaaaagcgccgggtcaaggatatcaggcctattggttgcagcaattataataacgccgtcgttctcaccgaaaccatccatctcaaccaacaactggttaagggtttgctctctctcgtcatgtccgccgccaagtcctgcacctctgtgacggcccactgcatcgatttcatctataaaaattatacatggggcgtttttcttagcgttttcaaacaaatctctgacacgcgacgcgcccacgccgacaaacatctcaacaaagtcagaacctgatattgagaagaacggaactccggcttctcctgcaacagcttttgcgagcaaagtcttacctgttcccggagggcccaccaaaagtacgccctttggtatcctggctcctaaacgcctgaatctttccggcgtttttaggaactcgactatttcttcaagttcggccttttcttcctcttcgcctgctacatcggcaaaagtttttttcgactgcccttcgttggtaagctttgccttgctctttccaaagttcatcataccgcggccgccgcttcctgactgctgcataaacatgaaccagaatacagcgaaaagcaagaccattccaagcgttggcagccatgttacccaccaaggtatactggacggaagaggagtctcaaccttaagcgacccatcctttatctgtttttccatctcgtctccgacgtcgctcctcagtgtttcataacccggaacttcaaccttaattattgaatcgctgtttttcatctttaccgtagcaacatcgtcagctatactaatctcgctgacttcgtgattttggatatctcttactaattctgaatatacgtctttatcctgtttaggcgtaactctcgtcataaaaaataccataaggataactaaaaacaacagcaagtaaaacccgataccctttaaatattttttcactctgtcgcctcctgtcaaaaaattttgatacacatataacaccagtttaaatgctattttaatattgatacaatgagtgattatatcatacataaaataaaaatacaaccaaattattaatatcttaacaaaaaattcaaatgttttgttataataccaatacgccccaattttaccttatgcccgttttaacaaacttatcaataatatttactatttaaataactttctgtttttatcctgcccaaaatttactatttcaaaaccaaaatcatatcggattcatcggaggaatttttcggtacgtcaatcacatccgaaaaagcggtctctttatctaaaaacacaccgcttgccgggtcataccaacgggctgatacaggtttaaattccagcgcttcaagatttaattcaaaactgcggccgctgtagttataaatcaaggcaaagtcttttcctgaaaaagctgtgatacggtcgtattttgtgaaaccgccgttatttattaagttatcgttatgtttaccgtcttgaaaatttacagacgtcataagattatacaaatatcccatctgtgctgaacccgggtcgttcagggcttctctccagcaggttttaacattataccctgcgtctttgtcgttttccctatagaactgcattattgcattatccccataggtatggccgcaggctccttcaaacactgaccagtacgcatatcttcttacatcttttgctttccataacggctgtgaaaaatcatgcagtccctgaggtatattttcataagaaggctctccgtcaagaacaggttttaaaggcgtacgcgcaagttctcttcttacatatctccaattatcttccccgtaaaaatcttctgaaacattattatcgtcccaaaagcccagcgagctttggtcataacgcctgtgtccagactgaaacatattaaaatccagccagccgcagtcattaaaccacatagcagacgaggttctgccgaacggatggaatgtaaccagctgttccggcgcgtatttttttatcgtgttgcccaatatgttccatacatcaaaaccggtctcgccccttatatcccccccaagaatccaaataacgttctcatgctgtccgtacctgtcagcgagatactttccatagctttccgcattatcagcgtttaaatatccttttttgaccatcgatccccacaccggaagcaatcccatatataagccatagccggcagccatctccacaagagtatctattttttcccaatagccgctgtaactgcagattttagaaaaatcattatctagcacggccgtgattttttcatccggctcttcaacattcatattatgtacaagaactgtctgaattacattaaaattcttttcggctctgtccgcaaaatatacgtttgcttcgtcagcggtcaatttctgagctaacagccacgctgtatccccaagccaaaaaaatggttttagttctccggaaatatctttttttgccaaatttttattatttttgtaaacagctaacattttattcacctcattatatcattttattatcctgcaattatatcacatacgttcagaaattaaaacaataaaatacgcaagtccgaatttggacctgcgcatatgtacagattatttttctttagcccattttcggcagttttccaatctgggctttgggtcaaatcccatttcaacgcccatggtagagaccatttcacacgggaattcttcgcattcaccgcaatgattaagccctttgctctcacagcaggttttaacttcacattctccgccccaaaaagtttttttcatcgttaaacatcccgtacagccaacctcttcttttctttcgcaggaatcgcactcgattccgcatcttgattcaaacatatgtaccgcgtctcccttttaatatttggaaatgcgcaaaaaagcttttttgttttttataattatgtcaagttatcaatctattcttccgcctcttgcacatttccgttttattttattttatttttattaaaattcaagttcagaaattacttcttttagagcgtttgccgatttcataagatgagtgcactcgttctcatttactgttatcggaacctttgtctctataccgtcctttccgactattgacggcatactgagaacaacgttttctataccatactccccgtgcatcatagacgacacaggcaaaattgatttttcatcgcggagtatagcctcgcatatcctctttacagacatagctataccgtaatatgtcgcctttttcttttctatgatttcataagccatatttttcacactgtcggctattcttatcattgcttcttcatgattaaaataacctctcatctcacagaatgaattaattgggatacccgaaacgttagcgctgctccatgccgctatttcactgtctccatgctcgccgattataaacgcgtgcacgctcctgctgtctacccccaaatgctgacccagctgatattttaatcttgccgtatcaagaaccgttccggaacctattatcctattttcaggcaaaccgctcaattttatagatgtatacgttaaaatatccacaggatttgaaacgataagcagaattcctttaaaattgcactcatttatctgcggaattattgacttaaaaataccgacatttttatgcaccaaatcaagcctggtctctcccggtttttgcccggcgccggcggtaataataactatagccgcgtcggatgcgtccttatattcgccggaatatattttcatcggtctgtttaaaggcacgccgtgacttatgtcaagagcctcgccctccgccctgtccttatcaacatctatcagcaccatttcagagaacattccgctctgcataagcgcaaaagctgaagctgaacccacaaaaccacatccgattaccgccacttttcttaaattgacatcacaatttgaatttttcaaagtgtattcctcctttatactataattccagtatacacattattataatccataatatatagttttatccaagagcaacatcaagaatcatcataattgtaaaaccaacagcaacgccgatagtggcaatattgctgtgatccccggattgagcttcgggaatcagttcctccacaacaacgtaaatcatagcgcctgccgcaaacgcaagtatatacggaagtattggaacaatcaatgatgtgagtattatagttattatcgcgcctatcggctcaactaccccggaaagaatcccgtataaacaggagcggcgctttgagattccattcccaagcaaaggcattgatataatagcgccctcagggaaattctgaatagcgatacctatagcgagagcaaacgcgccggacattgaaatagcggcgtttccgctgagcactccggcaaagacaacgcctacagccataccttccggtatgttatgaagcgtcaccgcaaaaataagcattgttgatttgcgaagttttgcttttcgcccctcaggtttatcggaattcaaatgcaaatgcggcgttatactgtccagcagaagcaaaaatccgataccgagcaaaaaaccaactgccgccggcacccacggaatggatccgttctcctccgccatatcgatagccggaataataagcgaccacacagaggcggcaatcattacgcccgaggcaaaacccagcaaaactttctgcagcaccggctgcattttatctttaagaaagaacaccatagctgcgcccaaagatgttccgacaagcggaataattattcctatacaaatttttatagtatcgttcaaaatatcacctgattcatttaaatttctttaattacataatcctaaaaagcccgtctctgctgcacaccaaataaatttttgcgccggaaatccgcggaattctaacctctccgccctgttcgggatacagtctgacaaccaaagccctgtcatatcccgtacacagcacataatttatataatgctccttttccattttatgcccaaacgatatataatactccccatctattattttaacttcagcaagatgtttttcgtctatcccattttctatcataggctcaagtttgcgtccacagcatatcacgtcagcgccgcttgccgcggttactagatttccgcaaacagggcagaaataaaactttactttcttcatattccctccgtcagtctctctttcgtttaaatcgccgtccagcatttttcctaaatctattccgaatatatcagataaatttttaagcagtcccacatccggcagacccagtccgcgctcccattttgaaacggttctgtcgctgatattcattttgtcagccaaatatttctgcgtccagcctctttcttttctcagcttttgtattaactctcctacttttctgcaatccattttatcacctcccggctcatttttattacattgccgtcaaaaattactttattttacttatttattatactgtgataaataagactgcacaacaaacgctccgtttggatgacaaaaaccgctgaacctctaaggattttgagttactttatttccactcgctgcctatttccatatctttgtagtaatactttttatctctttcgccgatttctctcataactctgcacgggcttccaaccgccacagtattgggcggtatatcttttgtaacaacgcttcctgctcctatgacgctgttgtcccctattgtcacgccgggcagaacgattactcccgctcccatccaaacgttattgccgattctgacaggcaaattatactctatacccttttcacgcagttcaggatatataggatgcccggcggttacaatagttacgttgggtccgaatttaacattatttccgatatgtacctcggcgtcatccagaagtgtaaaattgaaatttgcaaagaagttatccccaacataagtattgcatccccatgtagcggagaatgggctgagtataaaacaatttttccctgtgcggcctaaaatttctccaagcattttttcccgcttttctgtatcatttatgcttatattattatactccaatatgattttatctattttaggaaactgttcctttgctatttcagggtccatagggtcataaagctcaccgcttagaatctttttaaacttatccatatttgttgtctccttttttaaataaatcatatcaacaagctgttttccatcctcaaacataggatggtcataattatcaacaaaaaaattcttaactctatgcgactctttaaatccgcacgctttatagaaattaagggttttctcagaatcccccgttcctacgtacatagtatcgcagtcgttataataagataatatatactcaacaagttttttcccgtatcccattctttgaaactcaggagcgaccgcgatatttttaagctcatacaccctgtcttcacactttacaacaacgcactcggctttaacaccattgtcagcggcgacaaacatatcgcctttatccaaatacaaatctatcatgctttcctgctcatcgcccaacaaaagaagatctaagtatttctttttattgttctcaacttttattattttcatataattgtttaaactttctccttatagatttctgaaccttctataattttaacagttccattgcttatatcgacaatacgttcctttaatccggcacagtcacttatcggaacatataatgaaagctctacgctgtcggaatatagtgtttcaccctgtatgaattcccagctgtgcagttcattctgaatctttcccagcatattgtaatcacagataacagaaagctcacggcacagtatcatttctaaaatatttgccgctaaaactccggcctttgcgctttttgaatacgtatgaaccaatccgccggtacccagcaatattcctccaaaatatctagtaacaacaacgaccgtgtttgttaatccttctttttttaacatatcaagcacaggcattcctgctgtgcctgacggttcgccgtcgtcgctgtatctcattacaccattttcttcgacaatataggcataaacgttatggctggcgtcccagtatttttttctgagttcgtttataaactctacggcttcatgctcgctttccacaggttttactgacgcaatgaatctggaacgcttctcgactatttctgcgctcgccatattcttaacagtcttatatctatccttcattttagtttctccatatgttctttttataaagttgattatatcactaacacaatcaattatcaatagttctgatttataaatacatattgagtaagctacggctaatttacaaaatattaacacctaaatttctaacatatgataaaattattaagaatggaatttctttttaaaacgtcagaaatattatatgaaaaacaccaaaattattatgaggtgattttttatgaaaagatttaaaaccaacattttattttccatactattaatttttacaatcagttttcttacctcctgcacagggagccataattcaccgtatacagacggctccgggaatttaccggcaaacggagcgtacggcgcgatactcaataccggaaagtctgatgcaataatacttacagttgatggagaaacgatggttatagacgccggggaaactgagaacggagacgatgttttagctcatctcaaatcctgcggcatagataatataaaatacttcttaatcacacactttgataacgaccatgtcggcggcgcagctgcagtcgttagcggaacatcagtccaaaacgtgattatccctgattacgtaaggaacagtaaaaattataatagttttatgaatgcgttaagtgcaaaaaatattgagcctttaactcttaaaaacgacatgaatatttctttgggaaacgcagttatttctctatatccgtcgaagagaactgagccatacacaaaagacggagacgacaacgccttctcaattgtatctattgcagaatataacggagttcggctattatttgccggagacgccgagagcgagagaatagaggaactattaaattcaggcattgaacttgactgcgattttattaaggtgccccaccacggcaaaaaggacggaaacgaaagtttagaacttgcagaagccgtctctgcaaaatacgcggtaatcaccgacagcggcggcgaacctgcctcagaaaaggttttgaaagcatataaggatttgggaacagaagtctttgaaaccaaaaacggtgcggtgtactttaaaatcgatgataatggtccggaagttctcggcgcagaaacttaaacaacgccgccttaattgttattttttgccaaatatattaccgtttatttaaatagtataaaagatttaaaaatattttaataaaaaccttgattttttaagagaagtagtataaaattagtgtatatgtaatggaaatgtaattattcctattttttaattgcattgttttgtgtttggtttttaccgcctttaggcgaagtggtatagatttacatataattcattggaaaactatgggggtgctaaaccggtatgggtaaaaaagtcttggtcgttgacgatgaaaaaagcattgttgaaattttgactcttaacttaaaaaatgaaggatacacggtatgcgaggcatatgacggcgaagaagccgttaggaaggcggaatccgaaaaacctgatttgatactgcttgacgttatgcttccgaatatggacggcttttctgtctgcaaaaaaatcagagagacttcttctgttccaatcttaatgattacagcacgtgaagaagaagtggacaaggttttagggcttgagctcggagctgacgattacataaccaaacctttcagcgtacgtgaacttttggcaagggtcaaggccaatatgagaagaagcgatatagttcctcagcaggctgaggttgaaaacgatatagttgaaatcggctgtttcactcttgactgtaacagatatgagctttataaaaacggaaagcttatcgatttaacagtcagggaatttgaacttattaaatttctttcagcacagccgaataaaatatattccagaaagagtctgcttgaatatgtttgggattatgagtactacggcgacgtcagaactgttgacgttactgttaggcgcgtcagagaaaaaattgaggacgacccgtctcagccaaaacatataatgactaaacgcggtgttggttattactttgcaatataatttaattgagccgaatttgatatgcacctccaaaagtgtctaacttttggggtgcatatcatttttaggctcttttttattgcttatttatatatggtagtgaatattttaacaattatcttccaatatttaaaacgctcttgactttctaactgttttatggtacctttttattatgaaatatgtcgaaatatgtaataacatataggatttattgccgtatataacaattggggggtattatcttggtaaatattcaggaagaaatcagcagccgaaaagttggaaacgctttatattttgattaccgaagattttttggaatgctttccgtgtggctcgtatgcgccatattctcgtttttcccccttattttaagacctatgtttaccaatgttgctgaaacaatggatattggatactggattatggtgttcagtgacaatgatgttttatatcttgtcgttgcaatatcagtagtcgccgtgggtatgtcgattttaataggaaaaaggaactctgtggctgtatatctcattgcagtcttggaggttgttgggatatttttggctatgatggggtatttaatgctggaaggagaccctgttttgtttggagaaacagtatataaaattaatatttgggctgttactatatcagtcgttttagcttttgtattattcctgtcagttagtttcagggtacgagaaggagctgaaaaataatgaatatgggattttctttcttactggcctctgttataatcaccggagtatgcatacttatttgtatagtttatatgtcctataaaatctcggaagcctggcactcgacgcggcttatagacgctgagttccccagcactacaaaacatcttaccaaaaaaaatgtgaaaaaacttgaagatttttataacagacccgcatccgaggcaaggtttgctatgggactgttctattcagatgaaaatgttaacgctctgagaagaaaaacatcgccgattaaacttccgaaaggtaggtataatatatgaaaagacaaaaaactgctgtcgctgaccaaaccactaaagtcatgccggttgtccaaaatgataaaaatataaaaaagacaactgacggcgcccctgacaaggatagcatagacgcttcaaacaaagctttgtttgaaggaataaactcttataggaaaaatgagatgactgagaatgaatattgggaacgtattttctatgttcacctcaaaacaaaggaactgtatatcttagctgaagagtacggctctgaacttcagactttctttcttccgataaacagccttaaaaacgcgtatgagaatatcattcatgtgtgcgccaacgactatatggcaagaatcggtaattccgattccaacccaaagtatgttctcgacaatttaagggtcgctttggggcatgagtgcaaagcattctttgatacggcggactttctctcaatattactcagaaagaaaatagctgaatgcttaaacggctttacatatccgcagattgcctcagtgtgggacgattacaacacagtcagacttcagcttatacaaataaatcaagaaataagcgaaattagaaaccgcaagtctgacacaaacgactactatatagacgaggatgttgaaaaatactattttgaaaccaaaaatctgctcgactggtatatttttgtggaagaaaaggtatacccaaagcttgagcagcgtttcaacgacatataaaattgactaaattaaatatatttaaaagaggttttataacctcttttttgaattttgcggaaaggagcctaaaaattgaacgatattaaaacccgcgctaatgatttttcaaagggaagcattcttaaacatatactgcgtttagctatacctatgacgatagcgcagctgataaccatactatataacatagtggacagaatgtttatagggcgaataggcggtgtggaaacgactgacgcgcttaccggagtgggagtctgccttcccatcgttacaattataatggctttttcaaatctgataggcgccggagccgcgccgctcatatcaattgagcgcggccgcaacaacggcgaggaatcggaaagtattctcggaaacgcctgcagtctgcttataattgtcggtatatcaatctctgttttgggcttatgttttaaaactccgattttaaagcttcttggagcgagcgacgcaacactcccatacgctgattcatatatcactatctaccttataggagccattttcccggtgatagctctggggcttaacagtataataaacgcccagggctttggaaaaaccggtatgctcaccatagctatcggcgccatgctcaatattattcttgacccgatactgatttttgtatttaatatgggcgtggcaggagcggcgattgcaactgtgatttctcaaattgcttcagccatttggacagtaggctttttactcagcaaaaaggccacatataccataaaacttcgccatatgataagacttaattccagaaggattaaaaaaatactgtcgctcgggttggcagggtttacaatgctcgctacaaacgcggcagttcaaatggtctgcaatatgacgctaaaacaatacggaagcgatttatatattggaatcatgacgataataacatctgtcagggatatacttgttctgcctgttcagggattttcacaaggtgcccagcctgtcctcggatacaattacggggctgaaaaaaatggcagagtcaagaaagcaataaaatatatgtctgtgattttaatatcatatactgttttagcttggatgaccgttgctgtctttccccaattttttataaggatttttacagagaatgcagatttgcttgccggaggcgttccggctctgcacatatacttttttggttttttctttatggctctgcaattctgcgctcaaacagtctttaccgctttggacaaaccgaagcaagctgtttttttctctatgttcaggaaaataattattgtggtccctatgacagttttacttccaattttctggacgccgcatgtaaacggcgtgttttgggcggagcctatctcaaatctgataggaggcgctgccgctttcaccactatgatactgactgtatacaaaaagttgtgattaattaatattttaaggctataatataattatagcttatatattgggaagtgataattccatgaaatcaaagacgttaaaattaatttctgagcacgattcgcttatacttagcgtaatgttatgcacgcctgataccaccgaaaacatacaggggatacttcaattttcacatggtatgaccgaacataaagaacggtatttaaacgttatgaaatactttacttcaaaaggttatatctgtataattcatgaccaccgcggccatggaaaaagtgtgaaaaaccgtgatgacctaggatatttttacgaagacggtgctacgggtatagttgaagatctgcgccgcgtatcagagtacgtaatggatctttacccggggctgcccctatacctgattgcccatagcatggggacattagcggcacgggtgtatttaaagacatatgattatataccttccggagtatttctgtgcggtgcgccgagctctgacaactctacgggcgtcataacccctgtgctagacaaatatgccaaactccggggggaccattataaagaccagctgataaacgacctttttgtcggaatctttgattttgtatttaaagacgagaaccaaaaaagcgcatggatttgcagtgataaaaacgtagttgacgagtttgtaaacgacccgctgtgcggattttcttttacgattaacggatacaggggcttgctggagcttctcaaccgaacgtatctcgacaacacattaacagccggaaaccccatgcttccaataatatttatgtcaggctgtgaagattcatgtatgctgggatacaaaaaacatatcgaggcggtttccaaacagcaggaagccggatattattatgtaggaagcaagatgtatgccggtatgagacacgagatactaaatgaaattggcaaagagcaggtatatgaagacatattaaagcatatcgaactctttaaacagatgaaaaaaatattatagaaaatagtaaatttttggtgattataaaatgcttttttcagccggaaaggcttatgaaatcagcatttctgtcatgtgaaaaaccgtcctgcaaagagtaaaatggtgcccaagcgaacatacagttataaacagcagcatgaagtaatgaaacgaaatgagctgtttgacatttccatgcggctatattaaaatgaaaaaagatagttatgggcttgtaggccttaggcggataaaacgtatttaacaaattggaatttggaggttaattatgaggttagacggttttggattgctcgtaaacgatatgggaactatgattagattttatagagatgtgctcggcttcgcaattaaggaaaatgagcagacatcgaatgtttatcttgtgaaagatggcacattgtttttgctttatggcagaaaagactttgagaatatgacaagcaaaaaatatgaatatgtgaagggcctgaacggtcattcggaaattgcactttatgttgatacttttgaagaggtggatttggaatacaaaaatgcaataaataaaggagcaacggctgttttggaacccacaacagagccttggggacagagaacctgttatatagctgaccctgaaggaaaccttattgaaattggctcgtggaacaaaccctttgaaacaaaagacaaatgacaaatcccagtttgccgggctgattaaatgcgccttatttgcataatacgtattccttctttagccgttttcaatagtggcaagcagggcactttgccctgcttgccactattgttttcggtggaatcggaattcccgccgcgcatgaaaatagccccggtatgagatagcacacttctcatgccggggcttgttcagactgcgtctgcttaccgttagcagcttttcggggattgctttttcagggcatacgctatataataaggctgtcagcaggccggacaagggcttgctgattttttgttttgtggtgcccaaatggtgctgggctttacaaaaccatgctgttacagattgtgccggtttagtcgccggatttgaggaaacgcccatttcatgcgggttcgcagggagctatgaaacagcttgccgccttattacgcctgaaattgctatcctaacgataaaaaatttgattaaaacaaaaattttctacattgtagccactgcgccgtctgcggcggctgttgccagctgtctgagcggttttgttctgcagtctccggctgcgtagatcccatcaatatttgtcttgcagtcttcgccggaaatgacatatccggcggcgtctaactctaccaagccttttaaaaaaccagtgttcggaatctgtcccacggctacaaaaaggccatccacagccagccctgaaatttcaccgcttattttattctgcagttccactccgttcagcctgccgtcctcgccctttttaaacgccgttactgtagagttgagtatgaattccacgtttgatttttgtttcagcttttcaaccgtggattggtcgcctctgaactcatctctcctatgaataatatatacagtctcacataatcccgataagaattccgcgtcctctaaggctgtgtttccgcctccgacaacggcaactttcttttctctgaaaaaggctccgtcacaggttgcgcaataagacacgccgagaccaactaaatcctcctcgccatcaacgccgagattacggtttgctgcgcctgtggctattataacacgttcgcattcgtactctttatcggcagtcagcactgttttggaattatcgttaacctttattcccacgacttctccataatctatctctccgcccagctccaatacctgctcataaagagcggtagcgaaatcaaacccggatatgttttttataccggggtaattttcaaccccgagagaattaacaatctgtcctccataagtgtttccctcaagaattatcgcgcgtttgccttgtcttgcaagatatattcccgcagtcattcctgcggttccggcacctataatcactgcgtcgtacattgtctcacctctattttataaagtcaagcaaagcggctttcgattttgcgccgacagatttgtttaccggctgtccgtttttaaataatataagggtaggaatagacattacaccaaatttacccgccaaatcctgctgttcgtcaacattaacttttccaacctttatggtctgaacctcttcggctatctcgtcaacaatcggagaaagcatacggcacggtccgcaccatgaagcccaaaaatccaccaataccggtttttccgaattcaatacttcagattcaaaattttcagatgttacagttattacatttgacataagcttttacctgcaaggtttatcgccctgcttttcctttctgaattttaatattttaatttataattttattcgaaaccgcctgtcttataagctcaattacattgacgtttcccataagcccgctgacagttatccttgtcatattctcaaccccgtctcttgggatattaacctcataatctatatcagtggcgtcgtctccaaccaaacactgggcaataaatcccgccttgtgtgaagcgtcgatagcaatatcagaatatgaaccgtaggggtatgcaatcatatcgcatgttttccccaagttcttttctatcaaatatttagacttgcgaagctcgtagttaagagtgtccttatccagctcgccgagtttaacatggtcgtttgtgtgcgattctatatcaatgagaccgctgtcctgcatctcttttgcctgctcccatgtgaagtgtgaataattcacctttccgctttcctttgtagcccctactgtatcggttactacaaaaatagtcgccggaatctcgagttctttcaaaatcggaaacgccacttcatagtttgacgagtatccgtcgtcaaatgttattataataggatttgttgggatagtcttagagccgtcacggcatttcacaaaatccacataatctcttaatgatataggagtatactgcgtcttaatcgccgtcatatgcaaacgaaaatctcttggtgagataatagatatcgcatttgagctgtcaaaatcatccgatatatggtgatataacaatattggcaccttaacaacatcagcttccggtgttccggctctaacctcattaggaggctgcgtcgccgacggtttttgggtaggcgctgctgttggttcaggcgtggcatctgggttcttagtcggttcaggcgtagcgttcgggtcttttgtcgaagccggagccggagtggcggtcgagtatatatcctttatccaagaaggcggatttcccgtctctgaatttgcgcttgaacttcccgtagtatttccaaaagcaacattaacgctgccatcataatcaagaccggtttcttcggcaaatgccgccgttccataaaatgaaattgatgaagcagcaatcatcgccgctaaaaccagggataatttcttcataatcaattctcctttattgtttacttaaaaactttttctattacactaataaattcatcgttattctgtgaacctacaatgtatctaagtatagtctctgttacatctgctgtattctgtcccacaagagccctgcggatacgccaaacagcttccttttctctctgacttaacaagagctcttcttttctcgtgcctgatttggctatgtctattgccggaaatacacgacgctcctgtaactttctgtcaagatgaacctccatatttccggtccctttaaactcctcataaatcacgtcgtccatgcggctgccggtctctataagcgcggttcctaaaattgtcaggcttccgcccccttcaatatttctggccgcgccaaaaaatcttttgggcttatataaggcgccgggatccaatccgcctgaaagagttcttccggttggagctatagttaagttatacgccctggctaaacgggttatgctgtccagcagtataacaacgtcctttttatgttcaaccaaacgctttgccctttccaatacgatctctgccacttttgtatgattctgcggctcctcgtcaaaggtggaatatataacgtcgccctttatgcttctctgcatatcggtaacttcttcagggcgctcgtctatcagcagaactatcaaattaacgtcaggattattttgggttatactattcgctatatttttaagaagcgttgtttttccggctttaggcggagcaattattattcccctctgaccttttccgacaggcgctattagatctattatcctcatagaataatccgtcttgactgtctcaagtttcaaacgctctctgggatagataggcgtcaaatcctcaaacgcttttctgcgtattgacacatctaccttatcgccgttaacggactgaacataaagaagagcctgatacttttcaccctcatgctgcattctcgtgtttccgacaatatagtcccccgtcttaagtctgaatctcctaatctgagcctgaggcacatacacgtcgtcaggacccgactggtaattatccgacctcaaaaatccatatccgtcttcaagaacctcaagaactccgctcattaagtttgtgcggcgaaccgggtcgctgtattctataacttcattttttgcaggctgaacagccggtttatcatttttattttctccgcccgggcggctgttattctgaggttccttttctgaaacattatttttttgcaacgcctgattagaagcttctgacggattcttaacctcttcagtttttcccgatttttcattttcaataaaatcagaaaccgcttcaataagctcctgtttcttgagttttgaaacgcctttaagacccagatttttagcatattctctgagctcaactatcttcatattttctagtttctccatttcagcggagctgcttttcctgttcattaaatcctcctactttgacgataagttatcataatccgtcggcgtaaccaactgcactatcgggttgttttcatacatagcttttgtcagggttgattctgaaatatatttttgagtattttcattctccctcagcggggttatagcatatacaagagccaaaactaaatatattatgataacaccctcaattattccaaataccactccaaccgctctgtcaaaaaatcttatcacgggaagtcttgaaacgatattaaccacttttcctataatagaaattaaaattcgggttataataaacaccgacaaaaacgatatcaagtttaaaaccaaatttgtaataaagctggttaaagcgtcatttaaagccgtctgtccggttgccaccatgcttctcatgtattccggcagcgccgtcgcagttaatgtttccgaggctattttgggttcaacatatttcgtctgcacaattgaacgaatcatatctccaaaagcgcttccgacaataaaatccttaatataaggataaaggatatatgccaaaattatgctcgcaataaaagccgctaccttatatgcagattttaaaaaaccgtttttataacccacccagataaaaattgcgaaaaaacatgctgttagaatatcaagcaccgtgaaacctcctagaatattttccgacaaactctgttattttatcctgacaatatcagccttattccctccgagaaccaaaacattgcgttcattcccatatatacctatgctcattatatcatgtgatatctctatagattttttaagttttcctttataatttaaacatataaggtttctggaagtcgctgcgattatattgtcattataaccggcaatgttttttatctcgtcactgcttgtatagcttccgagatatttgcccgaaatactataaatctcaagcactgagtttcccctgctgtccctgcacaggaacaacagattatcaccgttttcaacatcatatttgacaggtgattttccggctaaatcaatttcaaaattcttattccctttttttgaaaatccaaatatcttgctttgtccgacagcagttatattgctgtttttatcaaaattaattttcgcaatgagagtgtcctcgcaaattgcagtgccgctctcctgtccgtttgacgtattcataacccgaatctttgaataagtctcgtctccgtcgctcatcatctgcgcaacggcaatatacttgccgtcttttgatatatcaacgtccgttatatatccctctccgctgttccatttaaacacctcgtcagcctttttattaaaaaccaccactgtgcccttataaccttcttcggcaagcgcggcaaccgcaaatccctttttattgactttagctgacaatatatcagtgcttattggatagcttactatattgttcccatttgtatcatacagattcaagctgttatttccgtccaggtccgctaaaagcgcatattttccggcaatatctattgtcggattcgtgagcgtcatttttatattccaaacgtctccgcctttgttgttaacatccttgattccgcttttgttaagcagcaaaacatctttgccgaaagcatactgaatatactgtcctcccgtatcaaactccaaatccgaatatgcacggtatgtagtattcggaactataacaatatttacaaacagagccaaaagcactgctaaaaccgccgcgataaagcttaaacgaattgcgttgatacggacgaccttacctttgacagtaatattttttatactgcttccatccatcttttttataaattttactgcggagtcatactttctctttaaatagttgcctatctgagagaagctaaactctttgttgagatcaaatttcatatcaggtcatcctcagctataaatatactttttttagaaacaacccctgaggcggagctgtaataccgccttggcgtctgtctttactgcatataatttcaggaatatccgaaacctcaattctgccggtgcctacatccgcaagcgtaccaacaattatcctaaccatattatataagaatgcgtcagcttcaacggttattgtcagcagttcgggaaactccccgctctgctccgctccgcatacgctaatagttctgacagtcgttttctgctgtcctcctgccgccataaacccagcaaaatcatgctttccctcaaaaaaaacagcagcatcttttatctttttaaaatctaatttgtatggaaaatgccagctatatctatttaaaaatggattttttaaagcgctgttccaaatattataaatataccgctttccgtttacagaaaaacgcgaattaaaatcatccgccgcaacccaggcttccagggcggttatatcgtcttctaacctataattcaacgcgtacggcagtttttccaccgggatttttgtttctgatttaaaattaaaaatataatccaaagcatgtacgccggcgtcggttctgctgcagcctgtgacttttacatcagacccggtcagttccgaaagagccttttctatagtgctctgaacagttaccccattagattgagactgccagccgtggtaatttgttccgtcatacctgattctcattgcaatattttttatattttccatattaaaaacttccaaatccaaaattcagtgaaagaattattccaagcaatattaaaacatataaccagctcattatatctattcctgagaatttaagttcatagagcctggttctgttctcgccgcctctgtagcagcggcattccattgccgtggcaagctcgtcagccctgcgaaacgcgctgataaacagaggaataagtatcggcaccatggcctttgccctgctcagaaggcttccgctgtcaatgctggcccccctggcagactgagctttcataatcttatccgtctcatccagcaaggttggtataaacctcagcgcgatagtcatcatcatagctatctcgtgcgccgggacatgaatttttttaaatggggtcagcaggtattcgagaccgtctgtcagcgctatcggagaagttgtcaaagttaatagagatgtgcctaaaatcagaaaaatcaacctcagaaccataaacgccgcaaagcgtataccctctttggtaatggtaaatatccaccaatgccatacgggcgtgcctgaggtcaaaaacaaattaaaaagccctgtgaacacaataaatatcattatcggcttaagcccttttattaaatacttaggagacaattttgacacaaaaacacaaatccccaaaaataccgccaatgccaaatagccgtaaaaattctgaacgataaacaccaaaaccacatacgctatcattattaaaattttagttctcgggtccagcttgtggataaaagaattcccgggaaaatattgaccgagtgttatatcttttagcatttttccgcctttcaataaaactgtattaaatattttacttcaacataggagccagtactctgtatgcgtccccagtagtgtagatacctcccggaacgtcaatcccggcttctctgagcctatccatcaccctcgttatctgaggaacattaagcccaatctcctgaagtcttccgcttttgcagaacaccttatcaggggtatcaaacatctcaacatggccgccgttcataacaagaattctgtcggcaagttttgcaacatcctccatactgtgagacaccaaaagaaccgtcaaattcatcctcttgtgcatatctcttatcttaaacaatatctcatcccgtcctgccgggtccagcccagccgtcggctcgtctaaaatcaaaatcttaggctccattgccaaaaccccggcaatggctgctctgcgcttctgaccgccggacaaatcaaacggtgatttttcaagcagactgtcattaagccctaccatgtttgcggcaaatctagctctctcctcaacctcttcacgagggagacccatattagccgggccaaatgaaatatctttaagcaccgtttcttcaaaaagctgatactcaggatactgcataaccaatccgactttaaaccttatatcccgaagatttacgcctttatcattaatatctgttccatctataaaaactctgccctcagacggttttaacagcccgttcagcatttgtatcatagttgacttgcccgaacctgtatggcctataaccccaataaactcaccgggtttcacctccaggctcacattgtcaagcgcctttttttcaaatggaccgcccttcatatatgtatagcttacgttttcaagcttaatcattaatgcctgcctccgtataagaaaatcatatcaaattatcagcaattcttctttagtctctttattaattcttcagcgcactccttatcattaagaacgcgcggattaaagtcaagaccgagcttattgagcatatatatcaaatatgtggactgaggtgtatccagtcccaaatccaccaacctatctacctgcggaaaaatatctcggggagcgccttccatagaaatgtgtccgctgtcaacaactataaccctgtcggcctgaaccgcctcatccatataatgagtaatcagaataacagtcatgcccatttcccggttgagcttttttattgtttgtataacttccgctctgccgttcgggtcaagcattgccgtaggctcatccataaccaatatttcgggctgcatagccaaaactcccgcaatagcaaccctctgcttctgaccgccgctgagcatatgaggcgcatgccgcttaaacgcggtcattcctacagtttccagcgcattatcaacacgctctcttatctcctcgcgcggtacccctaaattctcaggagcaaacgcaacgtcctcttcaacaattgtggcaaccatttggttatcaggattttgaaacaccatcccgacccttctgcgtatatcaaaaagccggctttcatcagaagtatctatcccgtcaacaaataccttgccatcagttggaagcaaaatagcgttaaaatgttttgcaagcgttgacttaccggacccgttatgcccgagaaccgttaaaaattctccttctttaacgttcaggctcacattatcgagcacacggtttttctctccggtgtcctcgtccgtgtattcaaatattaagttgtcgacagttattatatcttccataaagagatacccctaaatacaattatcttttatcccagcgtgctgaatagccgcatggaagcacaagtccgccgtttgttacaggcagaccgatttcatctatatcaatttctccgccaaactttttgcagagcgtgagtttataaatattgctcattacattgcccgacattccggtagtatatgaattaaccaaaaaaaacaggggattgtcagacatgacatttaaacacgattcaataagaccaaaaagctcattttctattttccagacctcgccgcccgggcctctgccgtaagaaggcggatccataattataccgtcatatttgcggccgcgtctgacctcacgctccacaaacttctttacatcatcaacaatatatctgataggcctttcatcaagaccggataaaacagcgttttccttagcccaggtaaccatgccttttgccgcgtcaacgtgacaaacgctggctcctgcggcagacgccgccatagtagcgcctccggtatacgcgaaaagattcaaaacatttacctcatttttaggcctgccgctgtttttgattatatctgaaaaccagtcccagtttgcagcctgttccggaaaaagccccgtatgtttaaatcccataggctttattccgaatttgagttcacggtaacctatagtccaggacttcggcagttttttaaaagtcttccagctgccgcctccggtatggcttcggtcatacctggcgtccgccgctctccataactttgacttgtccgcctcgctcactgtccaaactatttgagggtcgggtcttagcagaataacatctccccagcgctccagcttttcgccgtcagacgcgtccaaaagttcataatctttccacttatcggataaaaacataaagatcctccgctgaattactaaacaagataaatttgggtaaatttgcccaataataatttaatgtatattttaacacgtattgtattgaaagtcaagggtgagagatttgtaaacatatttaaaaactgccgaaattaggcggatttttcatcaaattactgtgacaatacacttgacttttgataaaaataaaagtataatgtacaagctaaacagataagattttttgtttgaattgtttcagaacaaaatttttttacacagttaaaatccaaaagaggtgagaatatggctgacaaaaaaccggcggacagagtaatagcgcaaaacaaaaaagcttttcatgattactttgtagatgaagaattcgaggccggaattgaacttttgggaaccgaagtcaaatcggtgcgcgccggaaagattaacttaaaagacagctatgtttcactcaaaacaggcgaagccatattgataggcacacatataagcccatacgagcacggaaatatatttaacaaagaccccgaaagagcgcgcagactgcttctgcacaagcgtgagataaaccgtcttatcggtttaacccagcagcagggctacacgcttatacctctgagagtatattttaaaaaacagcttgttaaagtttcaataggtctgtgcagaggtaaaaagaattacgataagcgtgatgctatggcaaagcgtgacgctaaaagaaacatagaccgcgccattaagaattataaccatggataaaaccgcggagttaggagatatatcatgactataaaagacttacaaaccgaaatgattgccgcaatgaaggcaaaggagaagaacagaaaagacacaatctccgggctaattgccgccgttaaaaaggttgctattgacgagggatgccgggacgatattccggaatcaatggttgaaactgttattttaaaggagcttaaaaccgccaaggagcaagtggagacatgtcctgaggacagaaccgagctgctggctgaatataatgagaaagtaaatataatcagtgaattcgctccaaaacagttgtccgctgacgaaataaagacaattataaacgaaaaattctcagacgtactggcttccggcaacaagggcttgattatgaaatcggtaatgggcgagttaaaaggcaaagcagacggcaaattaataaaccaaattgtggctgagctctgcaaatagttgtattgattctatggaggaagaccaatgattatcaaaagttttgatatgtcggtggattatgctggactatcttcaaaccaacctaatgaaacggcaaaactaacctcatatattcttgaacctgagcttgtttcaaaaaccctatggaacaaacgcccggctgttattgtatgcgccggcggcggataccgctcaaggtcaagcagagaggcggagacgattgtgcttaaatactgcgccgccggatttcatggattccttctcgattactcaatagagcctacaggctggcctgctcctacatgcgagctttcaaaagccgtcaagaccgtaagggctatagctgatgaatattttatagacccggacaaaatttttgtatgcgggttttccgccggcggtcatctcgccgcttcactgggagtatattgggacttgcctatgatacagaaaggttcggaagcgacaggagaagaaaacaaaccgaacggtttgattttgtgctatccggttataatagaagacgacggaaaaacgcacgacggcaccaagcaaagatttacggagggcaaacctgaaaagcttgaatattttggtttggacaagcacgtaacctcaaacacgcctaaaagttttatatggcacacatttgaggatagttcggtgcctgtatacagttcgatgcggttcgcgtccgctctgctggaacacggagtagaatacgaacttcatatatacccaaagggaaaacacggactgtcgctcggcaataagctgaccggatgcgaggaaaagcattttgtacccggcgtaaccggatggatggagctttcaataaactggataaacagccagttataatatttacacatgggggtgtaatggtttcgacagggtcgtagaggcctgaggagcgagccgtggcgggcgccacgttaaaagcccaactttaaaattaaacgctaaaaataataacgtagctttagctgcctagttgcagcttgtccgcctgagtttaccgcagactcaggttagggcatcaatgatgcggtgaacgtgagccgggaaagctttgacccggccatgaattaatgaagctaccgagctatgcagtttgtcaatggactgcacagtgagggaattttaaccattgactacgctcgtagtgcctcttgaggatacttctttggacaggggttcaattcccctcacctccaccaagtaaaaaatccaaacccaattaaaacgggtttggatttttaatttatcagagcaaaatatcaaaaaggagagtaacaacacatctctaacgccgccatgttccttttttatttgtttaaagctattacttacccaagtatactttctacgtaatataataccatttttttaatattttaaaatatatcaagttaaaaactttccggaacaagtgcaagcttattgattgactcatgggctcttacaagcgaatcatatacggctaagacatcttctgaatcccaagtgcgcaatgatttttcatcaattacttcactgctttcgtttataattttactaagctgtgtctcatctgcgacagcaacaactgcctgtacagccgcgttactttgtgctttttttaagttcaatattaaactatcaatagaacctttggattgcacttcaaaaacatagatagctttacccatattgccaattttagcttcccataccacatcaacaatcgcaccggtagcaatctttacctctgaacggctttcaaatccaagaagttcgccgatagcaactaatttttccttaatctcatcatgcagagatttataatcattatcacttacagggcttggtttaactgaaatggagtcatttttcacctctttctgttcagcaagtggaagaatttcatcccacataaaataatcaacagccaaaaggtcataatcttctgcaccggattcttttaaaattctagcaatatcctttgcaattttacatacttccgcatatttttttccagtatactgatagttatatttcggcatatcaggtataccaagataagaaaaacaaagtatagtagttttattgaaaattatatactcatctggattgatatatgtaagtaattcgcttatcgtcgcgggtcctaatccttttatagactttaaaaacgaatcccatcttacttcaatttttgcagaaccaaataaaagctctgctaactctttttttaaggttttaaaaccattatcttcaattagcttatccacaacatattttttattaccccaaataagcatagaccaaagtttgcttatatattcgaaaaattcatcctctgtcatttgtaaaagtttttcttttgtgtatgactgataaaagttctttcgctctttacgctcagaccaattttcattatagtacgaagcattaatttttttattcttaatatactcatctaataatgactgtaattttaatttatccattttgcaacacaaatcctctctatgtaaaaatattttaaaacaattaataaattttactttgatattagtataataacacaaatagatttaattatcaatagtgtatcatctttaaatatatgtatgcgaaaaaataatttattttattaataccgaaatttaagaaagaaggactttaattttcaggaattagaaacttaattaagtacaaaccgacaatttttttatgattgcttttgataagaatctcatgttcataatagtagtcctctgcgctgtattctattcactaaagtattttttattatatatcaatttgtaattttaacttatttgttaaatattcatctaaatttattcaaaaaagttgtatatatgtaaatttcatgttataataaatttatattaactaatggggatgaaaccatgaaaaaaatattatccattgcattaatctttatattatcattttcttttcatttatatgctattgccgcggataactattccccggaatattcaatttgtcctttaatcgaacagattgataacagcttgatacgttcttctgatggaatgattgcttatttacaaaacggaaaatacggatatataaatgaaaccaacggagaaatattgcctgctcaatatgatcgtgcgtatgatttcaaaaatggacttgcacttgtgcgccaaggtgaatatatgggcgccattgataaagcgtctaatgtactcattcctttcgaatataattgtatatcctcatctattcttgttgatgaaacaattcccgcaagtaaaataattgacggagttgaaaaatggggaaagattgacatctccggtaatgtgattacaccatttcaatataattcgtacgatgagtgttgcagtgacaaaaatggtataggaatgaatatcattgttcaggaaaagaattctgaaaagcagtatagtttggttgatacaaatggaaatacaatagtgccttttgggagtaatgagattactaagaatcaagatagagaaggttttataataaaatatccaaaccccgatataagattaagctatttatatcaattctgcaatatagatgaaaatgggaaagcattgttttcagacatatatgattatatttatcctaacaacgacggagctttgggttctgatggaaataatcttatgctggttcgcaaagacgacaaattggggtatattgatctatacggaaaagttgctgttcctcttatatatgataaggcagaatttttttccgaaggtctctctgccgtcaaaaaagatggcaaatggggattcataaacacttacggagaaacagttatcaattttgaatacgattttgatttatacaataatagctattattgttcatggtatgcttgttttcaaaatggactttcgctggttcgaaaagatgagaagtttggaatcattaacaaaagtggagacattgtgatacctatagaatatgacgagataaaaaatgattataatttcaaatgtttaattgaaaacaacgttattccagtcaacgttggaggcctttggggattgacagatataaacggaactctgattactgaatgtttgttctcagagatacaggattttcatgaaggttatgcgtttataaaagaagacgttccaggtatcggagaacgttatggtattataaatacttcaggtgaaattactgcacgatatttaaatattactccagaatattattatagcgcattccacggtcaaaaaggatgggtaaaattccctcattatacctatttcaataacggcttgtctgcagttcaagcggacggaaaatggggatatattaatacttcaggcgaatttgtgatagagccgtggttggatacagctttaacagatacaactccatttacaaatggaggatatgattttaacaaattcggttatgccaaagtattttacaacgggggttggaatattatacatcgttatggatatcttacgttaaatgagtggtgggataaaattattgaaaacgacgactattttatttgtcaaggcgaaaaccgtgataaaataatatcttccagctgtgaatcagttttttatggtgagaacggagaattatataacgaagattctgagttaatactaaaatatgagccgaacagtattgttcatataggaggcaatatattcagctataggcatgaaggtataaccggtgtacttattgttaataaaacaaattaaagcatttgttaaacaatatcaccatgcataagtacaaagtttatataccagatattgcataattgtattttccgcaaattatttttaaatcggtaaaacacagaattatattatttcgccttacaatgaataattaaaaatatgatttaaaatagtattccaattataccgatatacaaaggagtttaagatgaacaagattgatttatccttgtttgaaactaaaggtgatttaatggaatatttcgataaaaattttgctaattcaaccaggttcaacagatatttttttgattactataataatgatgaaaattatttgggaataaatacgctaatttctttattaagaaaaaaagaattagaaatactagaatatgactatatctataataactcattacataacgaatcaaaatttttaaatccgctatgggaaaaagttaggcatcgatttactagaaaaggaatttatattacaccgcttcgtatgaatgtaattcactttattacagcatcagaaaatgtttttaatattgacaaattcaatgtagaagttgttgacagaaactcacttctttttgaagattttcgtactcttataattatgggaaatttaaattttaatgaattaatcagtcttatgcagaaatactataatcaagtcaactattttttatttttcccatacccaaaaaataacagcaatattaaccttgagattttgaatcttcagcatttctattcaatcacgcttacacatgaaggattgaaaagatgcagaaacgtaatagaagacagaataaaagaagccggggaaataatggatagattacttaattctaattcatgacaaatatacatttctatatatacaaatatatctaatataatttgttaaactaaaatccttacttttttagatagcgataacaaaaaggaaatgaaaaattatgaatcagataacattagattttaccgggtgcaagtcaccattaaaattacatttgattataaaagatacttttggatttcctgatttttatggaaataatctgtctgcgctatgggatagcttatgggaatattgtcctcctgacacagtcatttatgtgaaaggtgttaatactctgccaaaagattttgatgagtatatgagtaagatatttgatatattcaaaagattagaagatgaagatgaaaatataaaatttgaaattatgtcttaaatataaatataagaaataactagattaataaggtaacaaagtaaaaccacagttttagctgtggtttttattattttgatgtctcttttattacatatatcggcaatgttttatattttgttccatatgtgtcggtgaaataattttatcttaatatcagataaaagctaacaaataaatacagatatgttattatatattataagaaatatcttgggggataaatatatgaaaaaagaagtaggttttgaaaacagagaccgtttcgttgaattgggattgatgatttctgctttaagaaaagttaaaggttacacgcaatatgaactcgccgaaaaagctcatattagccgttctcatcttagctctattgaggctcctaatattacttcctctttttcattagaagtattctttaatatcgccgatattttagaggttaaacctggtgatttgctaaaccttaatttgccctcttcctattttaataatgatgaaaaagagaaaaaagcagaagattaataaatgaagtggtaaaatgtatttaaaaagattaagaactttgcgtttaagttcaggattaaaacaaacagatattgctgatattttaggaatacaacaaactgtatattcacgatatgaacgaggctttcaaactataccattacactttttagtaaaacttgcagatttttatcatacctcaaccgattacatattgaatcgaactaatgaaaaaaatccacgttaaaggaataatatataactaatataatgaacactacgtgttcagatgatagctcacctaacgcggcaaactacgtttgccctaccgatgttcgccgaagaccaacttttttgaacagttaaataaaataggaactcggaatatctattttcacggcagcttacaaagtcaacgggaaagttacagagctttttcttttgtgcgcagagcgcaaaagaaattagcgggggcgagcgccccttggagccgcaggcgacctaagcgagcaagcactttttctttggtgaagcgtttctttttcttgcgagaaaaagaaatggttcaaacaccattattatgtaataataaaattttttatatggggtcatatacatagtaaatatataatttataataataaactattaatcttggttattataaaacattatattaaacattaatacataagcccgccgatttttatataaaaccggcgggctttttacttttaatctagaattttattaaaattcgtccttagcttaaacggataccttagcttcatatggagtacccactaacggcgtcatattagttacatcatcccataccataactttcagatttccgttcgccgcaggagcatataccgccgtgtttgtctccggcgtcacacctgcactctttatgtcaatcaatacgccttcatcgttataaagcgcaaatataactgtcgcatttgcgcgtccgtcaaacacattcgaacttacggcggctgtgtaatttccttccgcttcagttacttctaatccgctgtctgcagatggcgttgcgctcggagcaacatccggtgttgcgcttgcatccgggtcaggattataattcggatttttaacctcatatactccgtgcaaagtctttacattcgctacccacttatctttaacatttccttctgtataaaatacagcataaaggtcgtgttttcctgtcacgccttcaggaacagtaatcttgcccaaatcctgcgcgctgtacccggttgctgtaaccatactatgtgcgatttcaggaccgtccttcgaatccagtcttatagaaacatatccgtcagtcttagcacgggtatccaattcaagcgaaagactcttaagtctatccatagtacagtccggataataatatccaacttcacctgctactccgccgtgagcgggataatatgtgttatatataaatcccacattgccgtttttctctatcctaggcaattgtgaatcgttgacagaattaaagaaccctttagtatccgtagctaaactatcccatgtcgcttctatatattccttttcggtctcgccgaagttgtcaattgtataagtcttaccagctgacgcgttaaatgaaagcaaagtctcgtcctgattaagtgttccggtcactacgttaccttcgccgtcctttataacagctgttcccatgtacttattgcggacttttaactctccgtctgttgctgcagtaacctttgcttcaacaggtttgccttcactccaagtcagatcaactgtagctccgccgagtgctttaagccccttaaagcttcctgcctgccaatctgaaggtattgccggaatgaggttgattgaaccatcatggctctgcataaccatctctgttataccgcttgccgcaccatagtttccgtctatttggaagttaggatgctggtcaaataagtttggtgatgtacgggttgtaaacaactgattaagcaatgtcgatgcaaattcgccgttaagcgcacgcgcatttaaattgattctccatgcgacaccccagccctgaccgctgccggctccgcgtccgctgacagaactctgatatgccttaaatatatcctgctcgctttcattttcgctgtaagcgctcaaatgcttgcccgggaacatctcccaaagctgtgaacaatgtctgtgtccgttattattgtttgcaatatgctcatttatgcttgttgacgcacctgtaaacgggttaattatattcttatattttccgcttccatcagcaaccgtcgagaagtcaaaagcaacatctccgcgtgcccactctttaataaggcctttttcgtcaataagattcggcgcaaccttacccggctcatctgccaaataacttgacggcatctgttctgctatcttagccagcaaatcagcgtcttctgtctctttgcccaaaactttagccgctttttgaacagtgtcgtaaaggtttctaaccaactgtgtatccattgccggtcccggctgaactccgccctgttcaggcgagcatgacgccgctgtaattaaatatccggttacagggtctttaaccaagtactttgtaaagaatgatgcagcacccttaatatatggataaacttctgccaaatactcggtatccaaattatactgataatactgccaagcatggtcaagcagccatactccaccggtaggccataagcctgctgttgcgttgtctataggcatagtaccgcgccacaagtcatagttatggtgcattacccatgggtctcccggctgatatgtgtcatcgcctcggtcgttatatataccgtactggtttgcggcagttatagaaccgccctgcgccaatgaggcaaaagtttctatcagcggcttttcattttcagccaaattgagcggctgtgccggccaatagttcatttcagtattaatatttatagtatactttccgccccacgaagcgcttctgcttgcgttccattttcccgcaagggtcagaggctgacttatttgtattggaatatctccggttgcggcattaccatcacgtcccggtctcgaacccgatatgagcagatactttccataattgaactccagtgctgccagctggttatcaccgtctccataagcgctgtatacgccgtttgcattagcctttgaaagtgagctgtctgctcctactttataaccgctgtcaccgtttacatcttttctgattctcttctctgtaggaacattagaattattaacgccttctttatttgcaagagataaagatgtgcgggtaaactgcccactgaaatcttcaaggtgtctgctctttattgtctgataatcttttgatttaacgttgcttacgtaaaccgcacagtcgtttgctggcttagcgttgtcaacattcagatagtccacataattcgaagctccgacaacatagattgtagctgtctttccgccgcttatattgattgttgtattatcatcagaaactgttaaaaccgctcccggctcgctgtccactatcatgtgagcttcaaaacgtataacgttaggaccgcccggctcattgctctttcctccgtctgtaacgcgcgcggtaagcttaagttcattatcgcttactttttcaaacttataggctgacgcgtcttgattatggtatgtatggaaagcagcgtcaaaattaaggtcgccgtctgattcgatatgcgtagccactgtttggtcaggatagctggcaaagctttctcttgtaaagtgattgccgttataatcatagtcaacagtaacggtaccggtttccatatccaaagcctttgtataattagttacgtcattatgactttgattaaagtcaagatatacttcaacaaacgacttgaaaactttctgtgattttggatttcccaggaatgttgattccaccatgcgctccatactgtatctgttttgaaccgcttcgttcgtagcagagttatcattgtttaaagcctgatttgagatactcttattggcaaacgccgggaagttagttctaaatgtttcatctccaacaacagcgtcagccgaacctatttctgccggatttccgtttacgtcagcgccgcggaaatatctccagccgccctctttgctgccgcttgtctggttaactgccgaaatatgctctgcattagcgatagcagtagtatccgtgtttgaattgttcgatacaatttcgccattctcattctgcaaatccgcatagggagaaccgctccaaatggtatcctcattgatttgaatgatttctttgtcgatagctccggctaccataccgcccattctgccgttgcctataggatatgcgtgagtccataggaattcagcatatgaccacttatctaacttttcacccggtttcgcatatggactttgaacttcgctcttgtccttattgctccagtttggatccatgcttgagtaattttcatccacattttcaaccatattatttgtccacattacagtttcagggtcaaagttctttgccgccgaaacatctgaggactgcgacagaaccacaccgccgaaagctgcagcggttaaactaacgcccaccgcaaaacttaacaatcttttccagacttttctcattttcttttcctcctatttattaggtaaacatattatacctcgaaaataatttattttatagaaccgctttaatgttgattttttggtaccaatttagtataatactattagttatatttttgtaaaaaaacttaaataaaaaagcaggataaatcattgttttggaggcaaattatggataaccttgaattctacgctgacccaaatgcaaaacttcctctttataagcagctctataaccatataaaagacggtattatctccggaaaaattaccggcggagaacggcttccgtcacgccgtaaattagcgcagaagcttaacataagcacaaataccgtgctcggcgcatatcagcttctcgaaagtgaaggttatattgtccccaaggcctcaagcggattttatgttaatcctgattataatctttttcaagactccgttcatctcgattgggagacgcagagcgatgcaaaatatatattcagccaaaacggtcttgaactctccaaaattccgaaaaaatctctcgccaggatttaccgcaacgccatatacgaccagccggacttattttctcacggagaaaagcccggagacccatgtttaagacaagcggttgcaaagtatttgtatgcggtcagaggtataaaatgcgacgaaaatcaaattattataggcgcgggaattgattacattcttacatgtctttgccgcgttctcggaaaagatacagtttggggattggaaaatccgtgctaccgccgctctttcagcagtattcaagacagcgtttcggaaataagattaataaatatagggtttaatggattcgatataaaaaatttattaaacagtgatattgacgtgctgtattttatgcctaatcatcagtttccggtcggccagattatcagtgaggatagacgccgtgaaattcttgactgggcaaagatgggcaaccattatatagttgaagacgattatgacggaagctttatataccaaaaaaacgcgcctagatctttattcactatggatgattccgagagagtaattctcatgggtgatttttcccgcagcctcgcccctggaataaaaattgcctatttagttatgccaaaaccgctgatagaaaaatggagccttaaacttccgttttataattgccttgcctcacgggcagaacaatttgctgtagcggagcttattaaagacggacacgctatcaaatatgttaattccttaagaaagatatacaaagaaaaacaagatattttgatatccgccctaaacaatcttccattcgcaaaccggttaacaatacatggagacaacggcggaacgcaccttttagtaacttttaaaactgaaaaaacagaacaggaactcaaaaaatcagcatataaggccggagtaaaaataatgccgctttcagccttcctttttaaacagtctgacaaactcccggataaaacattcatattcggttatggagaacttacaaacaacgagatagaagaaggaattgccgctctttcacatttgcttgattagaatatatattatcaacagtaaatagataaaattagtttggaaaatatttcttatcacaagtgtataacaaatattatattgtcaataataagtataggtgataatatgaataacaatgaggaaggagcaaaaaaaatgctggattataacaatattcctgttggtctgagcatggcgcttgcacagaacaccggagctcttgagcattttgcaaaaatgactgacgcggaaagacacagcgtaataaacaaagcccgctgtgttcagacaaaacatgaaatgcaggatttggttgccgggctgagcgacaatttttaagctaacttatattcgaaaatatccgaacatcatcacagcgtgttcggatatttttatgataaaaacacaaaaaatttcctgaaaaagtattgattttaatttcaatatatgctataattcattattgttgcagatacatataacaagataacggggtgtggctcagtttggtagagtacctgaatggggttcaggtggccgctggttcgaatccagtcactccgaccataccgagtgttcttacaggacttgaaaagttctgtaagaacactcggtttttaattttttgaatcaccagtctaatgaatatgcttcacaactactgtctgcaaatggcgagttccattcactttagctgacattcctgctgtgataactttatggaactgtcctataacaatttctgcaaacccatattatactgccaaatccattatacacctgattttatcaaataccactcttttcaaaaaatcaaccctatagtattaatattcacctttattatagcctttaattttttgtgaaacataattgaaagactaatcgttcttgtaatatttttttgttcatgtttcaataatattattataaatcttattgatttctttgttccttaactcctaaagaaattattttgtttaaagcttcttttggtatgtcgctttcaatgataatttctactcctacaactaaagttttgcttgtatttaccttaatgtaagttcccggctcataataatcttcggcatttccttttttcttaaacgatagttctttcctttctccattctggttatacccaataagattatattcttttcccttttcctgatttactccgtccttattgacaagccatgaatcttcatttacttcatctaacggaatctgtgtataaaaactatccgatgctacataacggtcattataatagcctttaaccataaacgccccgcacataactataacaatagtaactatgatagttattatttttttcatttcagctttcctcctaaaatttcaattcttttttctcaaaactgaataccgatattacgacaggtaacaccacatagacactcaatgctgcacacatcgtcgatatgtcccatgttccattctgcaaaaaggcgctgcgaatgctatatagctgagatgtataaaaatactttgtcatatctccaatcatatttacaaataattcttgtcctaaaatcatagtggcaagaagcattacagttcttgatgaaagcagaacgtatactattgtgccgttcactgcattttgtgtataaaaaaccggtatcgctgaaatacatatatatcccacagctcgtaatgcttcaactatcacgctaagaataagctctatgacctgcgcctgattcaaagcaagtcccaataccacaggagctaataatgttaaaataccaatacagaagatagacgcaaaaatcaacaaaatactttcaatgacctttgacagaacaactttatgtcgttgaagtccatatccaatcgccacctgaatggatttacttttgaaatcatcataaaacacagaaagaaatacagtcaaaccaacaaagagaggaaaaaaacctaaaaatattgtcgtttttgcaacataagcatccgccgtatatgtaggattaaaatatataaacatcattatacaaaacaacccaatatatattccgattgtcctaagaaacgattttttatgacaaatacgtttaatatccgctaaaacataattactcacatctttttcctcctaccaaatcaaaataataatcttccaaagatttataagccgaggattcctgcaaaacaggaatgttgttttgttttaaaacagaacgtgccttttccaaatctcctacataaatttgaaccgcgcttctttttactttcaaatcatcatgtgtaatttcctttaacacagttccctgatgaacaaacccaaatttatttgcggtatgttccaattcaccgagaatgtgagaagaaacaataatcgtcatattttgcttcctattcaagcttacaataagagtccttatatcagcaataccttgagggtcaagaccattaataggttcatctaacagcagaatttcagggcttccgagcagagcatttgcaattcccagtctttgcttcattcccatagaaaaagaaccgtatttagacgttacgccttccaatcccacaagatttaaaacacgttttacttcttctttgtctttaatatctttcaactgcctgtaatagtgcaaattttcttctgctgtcaggtaatcatagaaattatttcctataaaaaaacctatttttttacgtttctgcggcaattctgtttttttcttactgccggcaatacacagcgttccgctttcaaattcagttaatcctaaaataattttaaaaatcgttgtcttcccggcaccatttttcccaatcaaaccataaatctccccttttgctacatgaagattgacatccttcaaaactttaagattatcataattcttatatatttttgataatgtaatcatctttacctttctcctgtttatacatttttatattgttcttactttttttctttggaatttttttggcaaccagcatttgtacttcttaatagttcctcagaagatacgccatataattctgcaatagcaatcaagtttgaggtgcttggatcagatgttccgctttcccttagttaaagatatgaaccctatttatcagtctacttttccaataaatcggtagtatatctctatttcctgtattctttcgttctcctcattcgttgttgcctcatgaataaggattttttctatcattgcatttaataacggtgctgtcagttcctttggtacggaatactccttgattaactcaatccacttttcagcacctatcatatcctgttccattttacttaattcttctcttaggttggttatctgctgttctaattctatctgttccttttgatatttccccgacagcataatgaagtttcgttctgttatcttctcacaggctctatcttcatacattttcgcaaataaacggtcaatctcattttgtcggttctcggctttcttcaaggcactcgcctttttcttcttttcccgtattcgctctgcattgccgactttctgtattttgttcaataccttttcttcgtcctgctgtactgccttagcccaatactgcaagcgttccaatacagcttgatacagcacatcatagcggatatagtgcatagaacaataacctttgccaaactgtccgtagaaactacaagaataataactatatggtgttttattcgccttatttgtcgcaaacctcatagaccagccacaatccgcacacttgacaagccctgcaaatatcggcgttgccttttcctttgtctgtctacgccttgattttatctgctcctgcacacgatagaacacttccttgtcaataatcggttcatgcgtgttttctactcgaaaccattcgctttcgggctttcgtactttcttcttgcttttgaaagaaacggttgattgtctattatgaacgctgtttccgatatagacttcacttttcaatatcgcctttacatgagcaatcgtccactcataacgcttgctttcgggctttccctcaaagatatgagcaaaagtaccgtaccttgtaaaattcaaccaagacgctgtcgggactttttcttctcgcagtatttttgtgattttggcactaccgtaaccttgataggctagagagaagattttttcaacaatccattttgtttcctcatcaaccaacagtttccctttgatgtcggggtgtttcttatatcctaacggagcataagccccataatacgcaccctctgcaaatttcgtcttaaaggctgatttcactttacggctcgtatctcttgccacccattcattgatgatgttcttaaatggtgcaatctcactttcgcctttttcgctgtccacaccgtcgtcaatcgctatgtaacggacattatggctgggaaaatacaattctgtatattgtcctgtcataatataatttctaccaagtcgtgataagtcttttgttacaacacagttgatttttcctgcctctatatcctcaatcattctttgaaaactcggtctttcaaaatttgttcccgaccagccgtcatcaatatattcatcaatcacattcaaatgatgttcttttgcatatagacgcaacatacttctttgtgtggtaatgctggaactttcgccctgtaattcatcatctcggcttaacctaagataaagtgcagtattgtaaatctgttgtttcattgtcagttatcctcctttataactaacccgcgtttacaatacctgcttgcaagtaaagtataacacgggtactttttgtcattcaatctatttcttacaactgcaccgattttatgcgattgtctgctttgctttttccaacatgacatcagttagaagttcttccattgtctttcccttttcggagaaatgctcttttacaacaatctttgtctttcctctgttgccaatgccacacttgttatttttcttttgaattgtttttacagcattatcaataacacataccccctttctgtaaaatctttctaagcaattcaacggcttttgtcatagcccacaggacttccacctctgcatagttcttatgtagccgtacccattgcgtgcgacgcttttaacgctcaagctgtggctgtacgggagtatcattatctgacagcacaggtcatggcgataaaagaggacaaatcttttacaagaacacagataggttgtcgctcacttttgcaggagaaaggtcatggcgtatctgtttcaatggctcgctgtctgtcaaaggtattgaattgctttattcagttgtcaaagagcgattgaaagaagaaaatcatctttcctatatatcgcgttggaaaagagtaaaagcgtaaccaatattcaaaacttttttcttttcttgtaccatatagggaaagaaattgtcattctgctaagttgatgatgaaaagatttcttttcacaccctaactacctatgcaataccgttactgccaactatgaaatgaaagattttctttgctccatatagggaacgacaactaccaaatgttaagttgagaatgaaaatattttcttcttttcacatcaacactcaactgctaatacctgtttgaatacaaattgaagatactttttcttctttcacataacactgtccactcatcttgaatttccgacattttttcaaaacttttcttctttcactccatatagggaatggaaaccttgatttgatgacctattttcaaaaaaagttagatttccttttctcgtaccatatctgtacacaagttgatgttttgttgcagatattttgaagaaattaaaaaataccgtcattctcttgtgggacagcggtatctatgcgttcttctatggttgatttttctaattgtaataagtgtttatgcttatctttgagttctgcctgctcaatcatatctttcagtatcgttgtatgattttctctgtctaatgcttgtaccatttttatggttggtgcaacctgtctttgtaaccaatgcaacgctttttgtaaagtataaggttctggatttgtagttaatcgtatcggctctctattttcccctacaaaccatgcccaatcatcatttgttttccattgatttttgggtttatcatcttctctatctacaaagcggacataatgattgatgatagaaaaagcggtgcgttcagcgtcccgataggtcaataaatctacaactgcataataggctcgttcattcttcatgcgtatttcaaagcggttcttaatctccgtatcttcaacttctatgccattcttgacatactgctcataatttttctgataagcacacatatataattcactactggttgaaccgagatataaggtttctcctgtattctttggtaaatcgctaccacatttttccgtaccgctgtaatctttctgcatacggaagtaggagatacattcgcctgccttgtatttttcctttaattttggaatatctaatattcctgctttatcattgattgccaagtcaagccgtttcatcttaccacctgccgttaaacaatcaagcataaagtcataccatgagcgttcctgtgccaatagataactttccatttgccgacaccctctgccttttagttctaataaaacacctaaatgctcttgcatggaacacatgatgttgatgtcgcctaaaacatatttgctttcatatccgtacttgccaaaatcttcataaagcatataatcagattttaattgcaacacatcacgaataatctttaatgcgtccgtagtaggaaagcggacacgaaagtaatcaatcaataagaataatggttcttgtggattgaaacgctcaatctgtttttctaatgtttctttcaattcttccgtcaatggaaatttccctttttcaatgcggttataatactcacgactgataccacaggcaacagcaagtcttgtctgtgttactccgtattgttcacgcttttgtcttaattcttctataaagtatttatcattcattcttcaattcctccaatcaaaaaggcaactaccatatttgataattgcctatacttaaatttctgcaaaagaaaaagacaatcaatttcttatttgaaatcaactgtctttcctatgtcttattcaatttttcttagtgataatggcataatttatatcacaccatgtaaaatgcggttttgccttataaatacagcgttttccgcttagtagtgtctattgtctcttgttttttgtgccccccttgttagataacgggggcttactgttcgctcgcaagctcgctcaactgccgaagtgaaccagccactaaaaacggcggaaaaatctaagagattttcccaccgtcgtgtctggatcactccgcctgttatgttttttcgctttagcttttaaccccaagcatattatacctctaatgcacgaattagatttaccatttcaatagctccctgtgcacattcagagcctttatttcctgccttactgccagctcgttctatcgcctgttcaatcgtatctgtcgtaagaacaccaaacataactggtgtttcagtatttaaactgatttgagcaattccttttgatacctcactacacacataatcataatggcttgtactacctcgaataactgctcccaaacaaataatcgcatcatattttttactttttgccattttagacgctatcaaaggtatttcaaatgctcccggaacccaagctacctctatgtccttttcaccaacattttctcttttcaaattatctaatgcacctgctaatagcttagaagttataaactcattaaatcttgctacaacaataccgatttttatattttctgctactaaatttccttcaaaagtgttcatttatttttcctccatattcaaaatgtgtcccattcggtctttctttgtctttagataaaaactatcataaggatttgcttctatttcaatcggtactctgcttgaaattttcattccataatcttctaactgataaactttatcaggattatttgtaagtaaatgcaatgattttattcccaaatctcttaaaatctgtgcaccgatataatattctcttaaatcgccttgaaatcctaatgcaaggttggcgtcaagtgtatccataccgttatcctgtaaatgataggcttttagtttattgacaagcccgatacctcgtccctcttgtcgcatataaagcaatacaccagaaccattttctgcaatcattttcattgctttatctaactgctgtccacaatcacagcgtaaagagccaaagacatctcctgttaagcactctgagtggacacgacatagcacatcgtttccattattcaaatctcccataaccaatgcaacatgatgttctccattcaatttattgatataacaatgtgctttgaaattcccatattttgtaggcatttctacaactgaaacacattctacaagcatgtcatatacttttctgtattcctgtaattctttaattgtgagggttggtatatggtgtatttgggaaaattgaattaaatcagatgttctcatcattttcccgttttcattcataatttcgcaacataagccacattcttttaatcctgccaacctcaataagtcaatcgttgcttccgtatgtccgtttctttctaaaacacctccgttctttgcaatcagaggaaacatgtgccccggtctacgaaagtcaaagggatttacattctcagtcacacacatacgagccgttaatcctctttcttcggcagaaatacctgttgtagtatccttataatcaatagaaactgtaaaagcagtttcatggttatctgtattattttcaaccataggggaaagcataagcctgttagccagactttcactcataggcatacagattaagccttttgcataagtcgccataaaattaacattttctgttgtcgcaaattgtgccgaacaaattaaatccccctcattttctctctctttatcgtccataaccaaaacaagttttccctcttgtaacgcctgcaatgcctcttttattttttgatatttcataattcctttatcctttctgctaaaatccgtatcggcataacaactctttcgacaactctgtttcattgctgttgtctatgagtttctgcacatatttccctaatatatcattttcaaggtttaccatatccccgacttgtttattcttgagaattgtttgctccaaagtatgagggataacggataccgaaaaatctgctttcgatacttttgcgacagtaagactaataccgtcaatagcaatcgaacctttttcaacaattagatttaagatttctctttgcgtattgatttgataccacaccgcatttttgtctctacgcacagacgatattctacctgtcccatcaatatgccccgtaacaatgtgaccgcccaacctgccattcataggcatagctctttctaaattcacaaggcttccatgtcttaacaggctaagagccgttctgttccatgtttcattcatcacatcaactgtaaaagattgtcgagtgaaacaagtaactgtaaggcagataccattgactgctatgctgtcgcctaaatgtatatcctctaatatttttgaagctttaatggatagtttacagttacaagtatctttctgtattctttctactttaccgatttcttctattattcctgtaaacatggataaatcacttcgctttctatgaaataatcatttcccacttgagaaaaagcatatggtttaagcataatggcgtcattaggaaaagcaacaccttgaccacttacagggctttttgcactcccaccaaatattttaggtgctatataaatttgcacctcatcaacaatctgttgctcaagagcactccaattcaacgcacttccaccctctaaaagcagactgtctatctgcatatttcctaaacattgcattaaattcattaagtcaatatgattaccttttttcttcgtataaataatttcacaaccacattttctgtaaagagcaattttactttcatcaatagaagaagtagcgatatatgttttaatgtcattcgctgtttggataatttttgatgtaatgggtgttcttaaatctgtatcacatacgatacgaataggatttttcccgttttctaatcggcatgtcagtaaagggttatcttgaataacagtatttactcctaccatgattgcagtaaccttatgtctgaattggtgcacttgttttctcgctttttcgccacttatccattttgattgatttgtataagttgctattttcccgtccattgtcattgcatatttcataaaaacatacggaatacgctttgtaatatacttcctaaatactttgattaactgttgacattctatttctaaaatgcctacatcaacttgaatgttattttcctcaagttgctttacaccttttccagacacaatcggattacagtctaaagttccgacgactacccttgtaataccacttttaataattgtttctgtgcaaggtggtgtcttaccatagtgacagcatggttcaagtgttacataaagcgttgctcctacaggtgactctctgcaattttttagtgcatttctctctgcatgtaatccaccaaaaacttcatggtatccctgtcctataagccgattattttttacaattactgctccaaccataggattaggattgacatagccagcacccttttttgccagttctattgctattttcatgtattctatatcgctcatttttacacctccaaaaaaatacataccttgaataaaatctatccaagacatgcaaaagaggatttatgcgattaaagaaaatgctctgaaacaatataaaatcattccagagcacgcaaaaaagcataaacttacttttatcttctttcatccagactatactgtcggctttggaattacaccaaatcatgcctttcggctcgtgggctataccaccggtagggaattacaccctgccctgaagatagttattcaattacagacaattataatatctgatattatatctgtcaataaaaagtttttttctcgtttatccaaatacaataatttgcaagcaggtaaacacaggttatttcttaatatccttttgtttgggaaactccattttcccatttagaaactgcctgtctgctaactcctaatgtttctgatacaaattcctgcgtcattttacagcgaagtctgttttcctttagcacttctcccaaagattttcgtattgatttcttttcttctcttatttcttttgtattgatatattttttcagtgctctgacaaccaacacaaaaagataaacggctgctcccgcaactgctatccaaaaaaaacaatatagcagagcaactgttacagttaaaaatctagtcgtattcatttattctcctttcaatttgctttttgtgaaaaacatcgtttcatttgcttttctgtacatattctatcgaaaactcatggttgcttccaccaactattccgcaatttttagttgcatttgcagtttacatggtgtttcatggcttttacatagagttatttaataatttcttttaatccataaattattatacttcaatacaacaatctatacaagtgctccttccaataaaaactttcacactcgttttcttttattagttacacattgaacaaatcttaccgttataataattcaggtgagaccaaagcagttttctgtcgttaagcaaatatacatctttctctgttttggattcaggagatagctgttttgcatttttaatatttattttaaatacatttcctttcgtaatataacttgaatccttaataaaatatacaatggcaaatagagcaaaaactgcgtttcagagcgcaaaaatgctccgactttcttacgtcagagcattataaaaatatttaattttgaggttaatactgactactgataatcaaaaatctttattttactgagtttttaaataagttctataagaacaccagttcaccaaaatagaggttcctttttgaaaccaccttcttttgctgttagtttaatacagcaaaaatttttttgaagatataattaaaatgttactgttattttcgtaccttttgaaacctcactgttcatagttatttttccatgatgaattaaaacagtatgttttactatagacagtccaagtcctgtgccgccggtctcttttgaatgacttttatctactctgtaaaacctctcaaatactctgtcctgttcttcttttggtatgcctataccgttatcctccactgatataaattttttatctcctgatttacctactgttatctttacttttccgccctccttattatatctgatagagttatcgcaaagattaaatatcacctcatgaatcaggcgctcgtttccttcgatactttggctgctcccctcaagctcaagagtaatctcactctgttttgccttcatctccagctcgtttaatacgtccccggaaactttgtataaatccacatcactcatctcaatgccattaccctcgtcaaggcttgacaatcgtataatatcatctattaaagctaacaaacgttttgcttcagaatttatctgacctaaaaacctcggcatatcctcaggtttggctattccggctttcataatttcactgcatcccattatagaagtcagaggggtcttaagctcatgagaaacattagctgaaaattctcttcgcatttgttctgacgcttctttctcagtcacgtcgtgtataaacatcaaaacagcatatattttattgcttccattccccgcagaaaaatccttggcaacagatgatattgatattctgtatatacgttctccgcgttccagcgtaatatcccctgatattccatgaaacgccttttctacggcctccatatactttttatcacggcatatgcttaggtaatttatctttccgttattactgctgacattatcaaaatcaaatattttttttgccgccatattagccgaaataatatgtcggccgctgctaatgattattaatccgtcattcatatgctgcgttataaattcgttttctctctgagtgtcataaattgtgcttatctgctcaatcatttccttgttttgggtatcgatttttacaagtaaaggtgacagttcatcataagcctttgccgcggtgggattatctatatcaagctcattaatagggtttactatagtttttgtaaggaatccggcgactgacatagctatggcaagcaaaattataattgagaacaatattcccggcatagccttaaaaattactccaaacatactggatgtttcacatgcaacacgaagtatgtcgcctgaacttagtcttacggcgtagtaatatgtctttttaccgaatgtgtcagacgttctggtactctcgccgctccctttttcaagcgcgtcctgtacctcaggtctcccaatatggttttccatatcattaaagtcgctgtagttgtcatacttaaccgttccgtcagaacctataagggttatacggttctggcccctatttcccagccggcttatgtccatagtcacaggagaaatattctgaatttcacttatatattcagcttcgttttttatttgtgtttttgtttcatttgatagattgttatataaaagtccggcgactataactgttgtgaaaacaacacttattaacgttgttaatataattcctccaaaaattctgctgctcagtttcataatgacgccccctttctttcaaatacaatttactgtgccgcccaacagttaactcaatatatcattcctccgcccggtatcctacgccccgaatagtctttattatatttcctccgtgacccagtttttgacgaagggttcttatatgtacgtcgacagttctggtctcgccgtcaaaatcatatccccatatctgttcgagcagtatatccctggttattaccgttccttgatttttcataagcaggcgcaatacttcaaactcctttaacgtcagttcgacactatttccatcgacctcaacagagtgcttttttgtgttaagcgttatgcagccgatgttatatacacagtcgtctgagacagttccctcatgaccgcatcttcttaaaaccgctttaattctggagattaactccataattccaaacggttttgcaacataatcgtccgcgccgctgtctagaccgataaccttatcatactcggaatctttggcggtcagaagaataaccggcaagttcctggtcttgggattggcacgcagctttttaagtatactgactccgtcttcaccgggcagcattatatcaagcagcaccatatccggcagactgctctcatccaatccgtcaaaaaactgttttccattttcaaagcctttagccgaaaatcctgtattttcaaggctgtatacaaccaattcccgaatcccgctgtcatcctcaacacaataaatcattttttatcctcactattctctatgaactccggtgatagaaaattctacccactcagctatgtttaccgcgtggtccccaattctctccaaatactttgaagtcatcatcaaatcaagtgcagccgaagcattctggggattttcagttatatattttattaaatcattatttacttctataaataaatcatccacttcatcatctctgtttattacatcctgggctaactccagattgcttccgacaaatgcgtcaacgctctcagttaccattttggaaaccgctttagtcatttttttaatatgcgcgctgttatatccgtccattaattcggtgtggattactatctcggctatatctgccgcctggtctccgatacgttccatatccgtaatcattttcaaggccgcggaaatcaatctcaggtcacttgccacaggctgctgctgaagcaggagcttcaaacacaaaccttcaatatccttttctatctgattaatctcttcctcgatagacagagtttcatcagctgtttccttatcatgatttaacaaagcccgtatcgcgcaatcaatcgcattttcacacagagcacccatctcaatcagctctctgtttagtttgtcaagctgtctgtcaaatttgcttctcatagtatcaaccaaaccttcccgtaatatagtcttctgttctcttatccttaggaattgagaatatctgttcagtatctccgaactcaacaacttcacccaaaagaaaaaatgcggtcttatctgatatacgcgttgcctgctgcatactatgggtcactatgacgatagtataacgcttttttaattcaagcgcaaggtcttctatttttgaagttgaaatcgggtcgagagccgacgttggctcgtccataagcaacacctccggttcaacagccagcgccctcgctatacacaatctctgctgctgtcctcctgacagaccaagcgcgcttttctttaatctatcttttacttcattccatatagcggcgcgctcaagcgacttttggactatctcgtcaagcttagcctttgattttatcccatgcgttctaggaccatacgctatattgtcataaatactcatcggaaaaggattaggcttttgaaaaaccattcccacccgtttgcggagcaaattagtatccatgtccttatatatatttataccgtcaagttttacctctccgtctattctgcagccctcaaccaaatcattcattctgttaagggttttaagtaatgttgatttgccgcagcccgaaggaccgataaatgcggttatttcatttttaggtatttccatgtttacactttttaaagcatgaaaatccccgtaatgaagatttaaatctttaatggatatcacactcataactttttatccttatacttaaatttggattttgctggaatccataaacccaatattatttactggaaattttcttagccaatgccgatgaagccgcgttcagtatcactactataataagcagcacaacggctgtagcgtaggattgattagtgttcagcccctcactccacagagcgtacatatgtacagcgagggttcttccagaaccgaacaaaccgctcggaatctgagctaccgttcctgctgtataaattaaagccgcagtctctcccacaattctgccgacagataaaacaactccggccaaaatccccggcaccgctgacggaagaactattttaaacactgttctgagcttcccggctcctaagccaaagctgccttcacggaaagtatccggaacagctttaagagcttcctcagtggttctcattatgacgggcagtatcataataaccaaagtaaacgctcccgcaagcagggaatatccccacgaaaatgctgtgacaaacaaaaggaatccgaacaatccataaactatggacggtattcccgaaagggtctccgcagtcagtctgataaggccaactattttgtttcctctctttgcatactcaacaagatatatagcagaaaacactcccaaaggcaccgctataaccaatgacagagccgtcataacaactgtgtttatcaaggccggaaaaagcgagacattttcagagttgtattcaaaactgaaaaggtctagcgacaagtttggaattccctttatcaatatataagcaataagacaaataagaacgccgaatgttataaacgccgctgtatatacaagagttcttaaaatcactgactgtagctttgatttattcattccgctgcgcctcccggcaaatctttgttccgccgctgcctcgcctgacggtctcaaaattattctcatttattttccgacctccttttcaaaactgaaaaagagacgtttatgattaggataaacacaaacagcaccaccgcggtagctataagggcctctctgtgcaaatctgcggcatatcccatttctaaaacaatgtttgcagtcatggttcttacgccgctgaacaatcctctcggcagagccgcctggtttcccgcaaccataataaccgccatagtctctccgatagcacgcccgacgccaagtatcacgccggccataactcccgaagcagcagccggcagaactaccctaaatacgcttctctcgtgacttgccccaagcgccagcgaaccttcataataactttcaggcaccgctcttatcgctgattcgctgacggatattatagtcggcagtatcattattcccaacacaattgacgcggctaacatactcgttccgctcccgccgaacaaatcacgaatcagcggaactattaccataagcccaaaaaatccgtacacaaccgatgggattcccgcaagcaaatcaacagccggtttaagtattttatacagccatttcggacaaaacctcgtcatgaaaacggctacaagaatgcctatcggaacgcctaataaaatggctccggcagtaacatatatacttcccaatatcatcggcagtattccgtatatattattattcggcttccactgtcttcccatcagaaagtcaaacagaccgatttctttcatagccggtatgccgttcgcaaataaaaatacgcaaatcagaagaactgccaatattgatacgcacgcacagaataaaaacacgccgtgcataaatttttctttaaatttcgtcataataaataccccattatatgattggtattaatgaatatcatcccaaccggttgtctctccggtataaatctgtttaacctgctccgatgtaatattatttaaaggattttcattgttaactataaccgctataccgtccagagctattaccgttgcacttgcgcccttttccttttcgctgtccttaagctcacggcttgccattcctatatcacatactcctgacaaagcgttggtcactcccgttgttgagtcactctgctgtatttcaatttcagcgtttggatttaattcggaatatgcttccttcaacttttccataaccggcgtaactgaagatgatcccgatacgacaattttgcctgacggttttgtgcccgcataatttccggtgttcgcttctgaaatataatgattgtcttcaaccactttttgtccttcttggctctggataaactttataaagtctcctgtcacttccgaaacgttatcttttgtcactatattaaatggacgtgaaaccttatacgtgccgttctttatattttcagccgtcgcttcagcgccgtccacgttcagcgctttaacgctgccattaagcgaacccagcgaaatataacctattgctctcacattgcctgatacacttgtcatcattacagaggtgctgtttgttatatctgctgtatccacagtcatgtccatcttttcaccgttagttgtctcctctattccaaaaagttcaataaacgctcctcttgttcccgaaccgtcttctcttgaaataaccgtaatatttccgcctttgccggcggtatcagaaccgcatgaagttaaagccatacatcccaacactaaaaccgatacagccgccgctaagataaaccctcttttaattttcatctttttctctccttttaattgttttaaatcaactgatttgataataccgctgattctgttagcaaattctgcatttcttaacatatttatattattaccctaatgttaaatccaaaatcatgctaatgttaaatttaggttaactatttttattgttgtcccttaatttaaaaatattataaggttttaatactccaatctaactctttcagcagtattttacacagttggtttgtataattaagtcgctttttgtaaaaaggtttaaggcaaattttattgacaataggaatattttaagctacaataatcattgtgttgcaatatagtaacatatctgtaatattttggaaggagaatcctcattatgtttgggcaggatattggaatagatttaggaacgtctaccgttcttgtttatgtgaaaggcagaggaataatagaccgggagccatgcgttgtggcggtggactccggcacggacaggataatagcggtcggtgctgaagctcaaaaaatgctgggtcgcacacccggaaacatcatagcggtaaaacctcttaaagacggtgttatttctgactattcgacagctgaaagaatgctcaagcattttgttcaaaaatcgtcgggacacagttttatcggagcgtttataaaaccgagaatggttgtcagcgtcccaagcaatataacggaggttgaagaacgcgctgttattgacgccggaattcaggcgggcgccggaagggtcagcctggttgaagaacctttggcggcggctttgggagttgggataaacgttgaggaagcaaaaggaaacgttgtcgtggatataggcggcggaacctgcgatattgccgttatatctctcggcggaatagtgataagcagttctattaaaacagccggagacagttttgacgacgctataataagatatatcaggaaaaaatataacgttctgataggtgaaagaaccgcagaacaattaaagataaaaatcggctgcgtctataaaagagacaagcttttagcaatggaagcacgcggaagaagtttggtttcaggtctgccaaagacaattcaggtctcaagcgatgaaattttagacgcgcttaaggaatccgccggagctatagttgacgccatcagaacgcttcttgaaaaaactccgcctgaacttatcggtgatatttgcagaaacggtattgtactcacaggcggatgctctaaaatttacggtattaccaaccttatctggcgtgagctcaatatgaaggccaaagtcgcagacgaccctgaaacctgtgttgtaaccggtctcggaaaagccatggatcacccggagctgttaaaacgaaaataaaatcttacttagaaaatacctgcacaattttataaacggcaggttaaatgttaaacctttggcaattataaaaaatagaatttgttttaaatcctaattataaaaacagatcagcaaaataaagtttaaattaaaaaaggaatgcggctaaaccgcattccttttatatattttcttaaaattacttgttgttaacaagatcctttaacgcacggccagccttaaaagccggaacctttgcagcaggaatattcatttcttcacctgtgagagggttctttcctgttctggcagctctgtctctaacttcaaaacttccaaatccgattaactgaactttttcacccttcttgagagtatcctgaactgtttcaataaaagctgcgagtgctgcctctgaatccttctttgtcaaacctgatttttcagccatagctgaaagtaattcttgcttattcattttttgtcctcctaaaaaaatatataaaataattattttttcaaagctttaagtagggttaatatctgcatgtctgtttcaggttaacgtcttagaatgaccgtttgccacaacaatatagttatagcctataagcactgcaaatactcccatccccttaatccaccaatacgtatttattttactacaaataactgcaaatttccacactatttttttgatttataaaatatttgtataaataaacaaatttttgagccttttgagccctgaaaacatgaatttatagtaacttttcaccaaaaaaaggaagatatttttttgttccaatccaattttgagttcagtccacgttttcacggcttgctttatatcgtcattttgatgaatttataagatttttcacttaaaatcatttttagcaattctttgacaaatattcaactctatgatataatatcttattaaaaaaacgacaattaatttttaatttattatctaacaaaattgccgtaatatatggataaaatatcagctcatatattgttatataagacgcgtgatattatacattttttaccggcaaacttaaaatcttaaacttacttaccgtactattcacaatattaattttataggaggatataaatatggcttattattacaaagaaccatctcacacatttagtgaatacttgcttgtaccgggttactctgattctaactgcattcccggcaacgtctctttaaaaacaccgctcgtaaaatataaaaaaggtgaggaacccgcattatctatgaacactccgcttgtgtccgccataatgcagtcggtttcaggcgttgatatggctattgccctcgccagagagggaggcgtatcctttatttacggctcacagcctatagaaaagcaggcggaaatgattaggaaagttaaggcatacaaggccggttttgttgagtcagactcaaatataagcccggacaagaccttagccgatattcttgcattaaaggctgaaagaggccactccacaatagctgtcacagaagacggaacacaaaacggcaagcttgtgggtatagtaaccagccgtgattacagggtcagccgtatgtcgcctgatgaaaaaatctcaacttttatgaccccgtttgacaagctcatcacagctcctgagggcacaactctaaaagaagccaacgacatattatgggaacataagctcaattcactgcccattgttaacgatgacggaagactagtggcatttgtattccgaaaggattacgaacagcacaaagagaatcctcttgaactgcttgattcacataagagatacgtggttggagcaggtataaacacgagagattacgaggagcgtgtgccggctctcgtagaggcaggtgtagatattctctgcatagactccagtgagggttatacggaatggcagtcgagagttataaaattcatacgtgaaaaatacggcgacacagttaaagtcggagccggcaacatagtagacagagagggatttagattcttagctgaggcaggcgcagactttataaagataggaataggcggcggaagtatttgtatcacccgtgaaaccaaaggtataggacgcggacaggctacttctgtcatagaggtagcagaggcaagagacgaatatttcaaagaaaccggagtatatattccgatatgttctgacggcggtattgttcttgactatcatataacattagcgctcgctatgggctgcgacttctgtatgctaggcagatactttgccagatttgacgaaagcccgaccaataaagttatggtcaacggcagttacatgaaggaatactggggtgagggaagcgcaagagcgggaaactggcagaggtacgacctcggcggcgcggcaaagctctcgtttgtagagggagtggactgttacgttccatatgccggctcactgcatgataatctaacaaccaccctgagcaaggttcgctcaaccatgtgcaactgcggagctacgaatatttctgaattccagaataaagcaaaactgacattggtaagcagtgtatcgattattgagggcggagcccatgacgttgtagtgaaggataatgtaaatcatgagtaataaaaatatccctgtctaaactagacagggatatttttgtgtccaaaaattgcaggtcttatatgctcaaattaactttatttataattccatttaatatttattattttatctactgaaataattatctatatactttgtatatgaccccatataaaaaaatttattattacataatagggtgtttgaaccatttctttttatttgagtattcatattattgacattgcaggttatggaaaaataagaacatatgtataatacacactttcaaggaaagtgtggtcacactcgtaagaaaaagaaacgcttcacctgtgaccacacctgaaaggtgtgtgtaataaaaagttacttgttttaaataacctacaatgtcattattatgaatactcaaataaaagaaaaagtactgctcgcttaggtcgcctatcggctccaaagggcgctcgcccccgctaatttcatcatgaagcatgcttcatgatgaaaaaagccctactattttcccgttgactttgtaacctaccgtgaaaagagatattccgagttcctattaatttactcattaaaaaagtcaagttttcaatctagattaataaacaaaaaagcaggtttttcagcgaacttcggaagggcgcatttatgcgcctcgttaggtgagctatcatctgaatacgcagtattcaatatacgttttgactttataatataaatttataatcttaccaattctactggttaaatttatataaattcaaactataatcggttagatttttgtttttatatgctataatataattatatatatttgattatatatatgaatttataaaataaaaggagaatacttatgaaaaaagaagtaggctttgaaaacagagaccgttttgttgagttaggcttgatgatttctgctttaagaaaagctaaaggctatactcaatatgaacttgcagagaaggctcatattagtcggtcccatcttagttctattgaagctcctaatatatcttcttccttctctttagaagttttctttaatattgcagatattttagaggttaaacccggcgacttacttaatcttaacctgccttcttcttattttaatgaagatgaaaaacagaaaaaattagaagataagtaaaggaagtgataaaatgtatttgaaaaggttaagaactctacgcttaagcgcagggttaaaacaaacagaaattgctgaaatgttaggaatacaacaaaccgtgtattcacgatatgagagaggttttcaaactatacctctacattttctagtgaaacttgccgacttttacaatacctcaaccgattacttattaaatcgcactaataaaaagaatccatattaaagtaataatatttataaatataaggaacactacgtgttcagatgatagttcacctaacgcggcgcataaatgcgcccttccgatgttcactaaaaaaccgacttttttagttaattaaatcaatattaactcggaatatcttttttcacggcagttcacaaagtcaacgggaaagttacaaggctttttcttttgtgcgtgaagcgcaaaagaaattagcgggggcgagcgccccttggagccgcaggcgacctaagcgagcattaaaggtgcataaccgtaactacaataaattcccgatgcgtccgcttaattggaaagctccaattgactacatcaactcttttatcaatttcggcgaaatcttttaatcttttttgtaacacatcattgacaaacctacaaaattttctttttatttttgagctaaataactatatatttttatatcttattttattccttttacatatatcgtcacatgcttttttgcattatgtttttataagattagatatatataacaattgtaacaccattaaacaaacattaatatataaaaacaattggaataataagataagatgctgtcttaggacatatcataatataaagaaatatgaagctatttaagaatagccaatttgactttactgcaaaatattcgcgtcctacagaatacaactcaccctttcataatccaattatctccttcttttattactgtagccgattgacataaaggctgcatagtatttaaaccgctccaccacataaccttaattatttttgcaccgattgcctgaacatcaaaattaacatcataaacattgcggctttctgtctcagccgcaggttgactcattgtaagcagtctgccatttgcatcgtatactgctgcaaacagaatctccccttcaaatataggaccatttagttcgattataatattattatcagctacaccaacactttgtattttctgttgaaccgtagttacagaaacttccttatccatcttcgtacggtccatttcaagaacaagaatccaagaagttgcgtcgggtgttgtaagaggccacctaggtatagttacttcaacatcaattgctccggttgtttcactgagcgacgttatctccaacttaggcgaaccgccggttatggtcacaagagtaaaatagagtaacttatcctcaaaaaaagaggcgtcatatttattcctatcaaaataaagcggtatattgttatagtgatattcgttaatataattatcaagttcttccacagaaaaaactttcaccgcttgcggacggctgtgatcattcacccctactataagtgaagcgttaatctcatcggcggttaattcattaaaatcaattgtttcatctttcgcacttacataaaatcccgaaaatactgttgcaaacataaaaattgcagcacaaaaacttataaatcgtttattcattacttaaccccctacatacagtattaaattttaatcacaaaactcattttttatgtaaagcaaattttatttctagtacattatcactccccacctttcatacaccccattaacgattttaaacaaaatttatctcaaaatccttaaaacttacaatattactttgttatatcttacatcttcattaaatagaacgttttattattatagtttttgagcatttctaattaaagagttcttaaatttaattatatatattatataattataaaaatactttttatttcgcattatattaataatataacataatatctttattttttcaacgatacaaataatatagatgttttttctatataaccgacaaacattattaaatatttttagcaattattactaacacaaaatatatttaatagtatacgaaattttaaataatatattatattactcaaatagaattattttttctaattatagtcatttcttcacaacaatttttaaagcaaaataatgattatcatatattaatagcaaaagcataacagcattaatcatataacatttgtttgattgatataatctgctgttaatatttttatttatataatacatatatttttctataagatttttcttccgataaaacaaaaagttcagttacaattccaaagacttgccccttcttcttctatcttgctttttatttttgattttctgtataatatgtatagtgaacacaaaaaatttatttttgaaatataaatattatttacatttaattcctgtctatatattatgtctttttagtatattgtccctttattttacaaataatattgttacaaaatttgttagcttatgttttgacaaatttagtgctgtatggcaattacaataaaatataaaaaggagcgttaatatatgaaagcaaccggaatagtcagacgaattgatgacttgggacgtatcgttataccaaaagaaataagaagaactttaagaattcacgagggcgaccctcttgaaatatacacagacagtgacgggatggttatatttaaaaaatattcacctatcggagaactcagcgaatttgctcatcaatatgccgacacattaaacaagtctacaggtttactcacctgcatcacagacaaagacagtgtaatcgctgccagcggaaacggcaaaaaggaacttaaagagaaaaaggtttccggtgaagttgaaaaaataatggaaaagaaaacaatgttctattccaagcaaaatgagaacactatcaaaatcattgatgacagcgacaaatacaaagcaggagttgtagctcctatcgtacacgacggcgaccccgtcggaacagttatattcatagccgagcctgaaaagagtatgaacgaagttgagcagaaattagcggaaacagctgcaggatttttaagcaaggctctggaataaaagacatagaatacgcccacggctttaggctatgggcgtatgtttttatacaaaatccgacagtattatatttgacacatatatataatcagattttatttttattatgtccccgtactcttccattgttttgagcaggtttatatgcttattcagctgttttccgaaaacatcaaaaatatcttttccaaacatattcataaactttttttttgaaattccacggtcaagtctcagacccaaaaacacaaattcacacattcggtcatattcagcagttttatcaatctctataattccacttccgctgttatttacacgatctatatatccgctgacacttctttcgttgttaaaacggaacttccctatacatgaatacgctcccgctccaaatccaatataatcatctaaattccagtataaaagattgtgacgtgattcataccccggctttgcaaaattcgatatctcatatctgttatacccattattatcgagataatttacgcagaagtcatacatctccctatttttatcatcatcgggcaagtctaaatttccgtcgttaaaaagtctccaaaagggcgttccctcttcaatctttaatgaataagccgaaatatgttcaggctccagctctgccgtcttttccaaagtctctttccataagtccaacgactggttcggcaatccaaacatcaaatctacagaaatattttcaaacccggaattcctggcacttttaaaacattccaaaaaatcattatagttatgtaccctgcctaaactttttaacatatcgtcatctgacgactgcatacctatgcttaagcggtttataccgcatcttctcagcctgctgagtttttcaaagtccgctgttccgggattgcactctatagtaatctcggcgtcctcttcaatcgaaaaattatttttaacagcctcaacaatcttctctgtcagcgcggtatcaatatatgtcggagttcctcctcctatatatattgagctgagtttagtatcaggcaattttaattttgccgtttcgatttcctttatcaaagcatccgcatatgaataactcatatccgtcattcccgaatatgagttaaaatcgcagtatttacatttttgtttgcaaaaaggtatatgaatatatgctccggtcataatttaatctccaaaattattcatcaagcttcaatacggacatgaatgcttcctgcggcacttctacgcttcctacctggcgcatacgctttttaccctccttctgcttttcaagcagcttacgttttctggatatgtctccgccgtaacactttgccaaaacgtctttgcgcatcgccttaaccgtctcgcgggcaataatctttcctccgacagcggcttgtatcggcacttcaaacaactgtctcggaataacctcttttaacttttcagccattcttctgcccctggaataagctctgtccgaatgaacaataaacgacagtgcgtcaaccatttcaccattaagcagcatatccagtttaaccaggtctgacctctcatatctttcaaactcataatcaaacgaagcgtatcctctggttctggatttcagcgcgtcaaagaagtcatatataatctcgttcagcggcagaaaatagttgagctgaaccctggtttcatcaagatattccatatctatataggttccccgcctgtcctgacagagctccattatactgccgacatattcctttggcaacagaatcgaagccctgactatcggctcctccatataatcaatttctgaaacgtccggcagatttgttgggttgtctatagttaaaattgttccgtccgtttttattaccttatactcaaccgacggcgcggttgttaccaaatcaaggttaaattcgcgctctaacctttcctggattatttccatatgcagcagcccaagaaatccgcacctgaatccaaatcccagagccaccgaagtttccgcctcaaaattaagcgccgcgtcgtttagctgaagtttttccaacgcctcgcggaggtcgtcgtatcttgctccgtcagccggatatataccgctgtataccatagacttaacttccttataacccggcagagcttcctcagcgccgttttcagaagttgtcaccgtgtcgccgacatgaacatcctgcacgtttttaatgctggcggtaataaatccaacctcacccgcagaaatttcatcagctgaaaccaaaccgttaggatgcagataacctacgtctacaacatcaaactcactgcctgtcgccatcatttttattctctgaccggattttagcttgccgtctataatcctaacataaacaataacacccttatacgcgtcataataagagtcaaaaataagcgctttcagcggtgcgtcttcatctccggccggtggagggataagctcaacaatcttttcaagaacctcttcaatattgattccgtttttagctgatattaaaggcgcattttctccatctatgcctataacatcctctatctcctgcttcacctcgtccggtcttgcgctgggaaggtcaattttatttataacaggtacgatttcgaggtcatgctccatagctagataagtgtttgccaaagtctgcgcctcaataccctgggcggcgtccactaccaaaacagcgccctcacacgcagccaaggaacgagacacttcatagttaaaatcaacgtgtcccggagtgtctattaaattaagctcatactcttttccgtctttagctttataaatcaatttcacggcacgcgcttttatggtaatcccgcgctcacgctccaattccatattgtcaagtatctgcgcctgcatctcacgctgggttaaagccccggtaaactccaaaagcctgtctgccaaggtgctttttccgtggtcaatatgagcgattattgaaaaatttcttatattatcctggcgattcattagttttcctccaagtcggttaatcaatataaacgaacatgactgttctactgacataatattctaacataaaccgccccaaatatcaacatcaaatttgcctataatctatctgtatctgtctacatccttgagtgttattccatcatttacggcaatatttatcccatttgccaccactgaagatatatcgtcaattatagtgtcaacatctttcggcgcaactataaagcttccgaactttggttttataacctcttttataagctcatacttttcgtcagccatttcaccgattagctttaaagtctgtcttgtcggcaaatctttcaaaactcctgccttgccctggctggcagcattaaccagcatgtccagcgtatctccggcaattgtagcagcgtctacaaccgtgggtactccgattgcaattacaggcgttcccaaagtgtcaatatttaagcccttgcgcttatttccaaccccctcaccgggagttataccggtatcagatatctgtatagttgtgttgacgcgctccatttttcttgagcagagagcgtctatagcaataacaagtttgggttttatcctgtcaaccagaccccttattatctctccggtttcaataccggtcagtcccaacactcccggcacaatgccgcagattgagcgcacaccgttctgaatctcgtcagggacatactcttttagatgcctggttatcattaatgacgatatgaccttgggtccaagtgcgtccgcagtgatattctgatttcccaaacctacaaccaaaatcacatcatcgtcttttgttataaacttatcagtcaggcttttcagttcctcagcgcatacctggcacattttttcatatattttctgttctccatagaacctgctgggcatttcaatcgttatatagtcacccttaggctttcctaggttttcttctccctcttcatttaatatttttacgcgagtgacttttattatattttcaatagaatattcatcaacggatataccaccgacctcatcagctttttctgccgtttcggaatataattctttcgcttccagcgctaagtcgcatctaacttgttctgccattttatcacctcataaaattttatatagatatattttttcgtttatcttaatttatatactataagattatttataaaaacacacggcgctgagaattgaaactgtttttggattaataaaaaaatttaaaataattttaaaaaaagtcttgcattatggaaaatataatgttataatacgtaatactgatgtaaaaatcaaatcgttattgtttggaggtgaaattatgcctaacattaaatcagctaagaaaagagttaaagttattaagaaaaagactcttcaaaatcagattattaagtctcagctaaagaccgctatcaagaagtttgaagcttctttaaagcaaggacaggcagctgcctccgatgcttacaaggttgttgttaagaagacagatcaggctgttgcgaaaggtattcttcataagaacactgcttctcgcagaaagagccagtattcaaatatgcttaacaaaatcgcgtagcataatcaagatataacaggcggtatgcctgcaataaattgaatccatggttgcttaggcaacatctaacacttggaatcattaaaattctacaaatgatcggagccggacgcggctccttttttatttttaagttgacataagtcatattatatgttacaatacgttcagattttaagattggagttgaaagaatgcgtaatttttcttgctgatattttggcataacagaattatggaagcggatccttccgcctgtttgttatgcccgcgcaggaaagttaccaattcatacaactcaaaatgtttttatatatttaacctttttcattattatgaaattttttgagctgccgggatttactttcttgcagctttcataattttggaggaggtctttttatgtcccaaattaatatttcaaacctgacgtttgcctatgaaggcagctatgacaatatttttgaaaacgcgtcttttcagattgacaccgattggaaaaccggatttatcggcagaaacggccgcggaaaaacaacgtttttgaaccttctaatgagtaaatataaatacagcggaaccatttcatcatctgcaggctttgaatactttccgtttgatattcctgatgacaatgttgacacaattgatattgctgaatttattttcagtgattttgaatattggaaactttcccgtgaaataaacttgctcggcatgagcgatgatattttatatcgtcctttttccaccctttccggcggtgaaaaaacaaagtttcaattggcagttttatttttgaaagaaagtaaatttctgcttatagacgaaccaacaaatcatcttgacgctgagggacgtgaaacagtcgcaaaatacctcggtcagaaaaaggggtttatccttgtttcacatgacagagcctttcttgacaagtgtgtagaccacataatctcaataaacaaaacaaacatagaaatacaaaaaggaaatttttcatcatggcttttaaacaaagaacagcgtgataatttcgaactgaccaaaaatgaaaagctaaagaaagatataaaacggctttcacagtcagcgcagagaaccgccaaatggtcagacaaagtagaaaaaacaaaatgcggaaccaaaaattcaggtctcagacccgaccgaggttttataggccacaagtccgcaaagatgatgaagcgttcaaagtctatagtttcaaggaaagagtcggccatcgaagagaaatccggcctgttaaaaaatatcgaaacaactgactcgcttaaaatacaccaagtcccatttaaaacaaaacaattgattcatatggaagatgtatctataaaatatgacgcaaacataatttgcgataatataaacctggatgttctgcaaggtgacagagttgcaatagagggtaaaaacggctctggaaaatccagtatactcaaactgatttgcggtgaaaaaattgagcatggcggcactgttcaaataggaagcggtttaatcgtttcatatcttcctcaggatgtctcttttctttcgggcagcttaaagaaatattccatagagaaaaatttagatgagacattatttaaaaccattctcagaaagcttgatttttcacggacacaatttgaaaaagatatgaacaactatagtctcggtcaaaaaaagaaggtgctgatagcgcagagcttatgtgaaaaatccaatttaatgatatgggacgaacctctgaactatattgacatattttctagaatgcagatagagaacttgctctcagaatttaagccgacaatgatttttgttgagcaagacaaaatattttgcgatagtatcgcaaacaaaacaatccatatataaatgtattccgcatttgtaaaatacgtagtataaatttgctgactaatatactcgaatttactcatcctgcatattcaatattttcaggctgaatacatatttttcagcccgaataccatatttgcagcccgaaattctctagatttacatgacagcaaaataatgttaagcaaacttgttccgcacttacagccttatatactcctcatttacaatcaaacattttaaaattaaacagaaaaccagacaaaaaattaatggtgtttttagtgaacatcggtaggtgtgaccccacctgtataaggtgggtgttgatacatagtgacctgttttgactaagctacaatgtctataaattacttagttgtgatgtattgcgcgcttgcgcgtctcgttaggtgagctgccatctcacgcgaggcgtgggtataattaaaacagtttgtcataatcctttttattaataaattttcccacgactgcgcgccttacgcggcaaactccgtttgccctaccgatgcttgctaaaccgcatttttataactttataattttaaatattttcttatatgcggagtttttttgcgaacagcggtaggtgtgaccccacctgtataaggtgggtatgatacaaagtgacctgttttgactaagctacaatgtctataaattgcttagttgtgatgtattgcgtgcgagcacgcctcgttaggtgagctaccatttcacgcgaagcgtgggtataattaaaacagtttgtcataatcctttttattaataaattttcccacgactgcgcgccttacgcggcaaactccgtttgccctaccgatgcttgctacaccacatttttctgtagtttttatattccttttcattaaatttatccttaacaatctgttctatttatagtaaccgttccatttcgtctcattctttcatatacataaacttacttcttttatatagtaatcgtatattgttcattgtagcaattacgtctgcagttcttctcagagacaaaatgcttactaaaataatgccaaataaatgctgtatcataatataattgacgtcttgaaatggaaattattatatgttataattatttatactgacattgaaacattttatataaataaattttagaatggagtgatttttttgaacgaaacaattaaaacactgctggaaagaagaagtatcagaagctttaaaagcgaacaggtcaaaaatgatgatttggatttgattctaaaggccggaacctatgctccgacagcccgcggcacacaagcgccggtcatggtcgttgttcaggacgctgagaccattgctgaaatggagaaattgaatgcggaagttatgggaaatcctgaagctagacctttttacggcgctccgacagttattgtagtattctctgacacccgtcttaccaataacgcctttcaagacggaagccttgtgctcggcaacttaatgaatgccgccttttctttaggagttgactcctgctggataaatcgggcgacagaaacgtttaaaacccctgccggaatagagcttatgaaaaagtgggggcttgatgaaaattatattggtatcggaaactgtatactgggttacagagattgtgaactccccgaagccaaaccgcgcaaagacggatatataatccgaacataaaccaaaataggagagtatacaaatgaattttaactggttgaaaaacaaaaaatttactgttatagccgctgtattatcggcaatgcttgcggcaggaactcttgcaggatgttcaaatgtttcaaaatcagactttgacgccctggaaaaacgtgtagaagcactggaaaaaggcacagacaacgagagcggagataaaaactcatctgagacaaacaaatcaggcaaatcaactgcttctcccaaaacctcatcaaagccaagctctgataacggagagtttgactccgaaaatgtaagcaaggcaattgatgttcaggaatacgactatattgacgcagatgacaataagttttctttctttatctttgataacacttcaaacttcgacgtcaatgcccgaatagaaatagtatgcaaagacgcagacgacaaagtgcttcaggaaagcgaaaaaaaagttcccggattatcaaaaggcgagagttcattcgccagttttaaggtcgacaaagacaccgaaacaattgtcagaacagtgtattatgaagaatataaagggaaagacgtctcaatcggcgatatatccgctagagctataagagcccagggcggagccaacattaccattagaaacagcggctcggcagaagctgaagatataaaatatttgacgctgtttttcagcggcgatgatttggtcggatttgattccgataaagtcccggatattgaagcgtcatccagcaagaccctggcttctgtctgctacgaagaattcgacagccctaaggtttatgttgctatagacgacgaataatccgagaaaaatttatatataaatttattaaaattgggaacttatcaaaaattattacgtcttataaaatatagggagaagtttcaaattctgacctatctttagcaaagacggcaaacacagatgaaagtgcgtattcctctgtctatcaccgccgtctttgctaggcacccttataaattattttatggaagtaatccaaaattgggtttgttttcaatttattttctgtaaacaaaatagagcttcattatattgtgtcaatcttcaaatgttagattttttgtctaatttcaaaggtcggctcatattgcttgaagccctatttttttattatctcatattatcgcatacagttattcacatatttcaccggaacgtccattctttcggccgcttcttccactgtcattccgctgtctataaaacgcttacatacgcttttcatattttctccaacctcaataatatgtttatcagggtcataaaaacggacaactctctgtccccacctatgctcgtataccttatgaagatagtctatttcaagctttgatagcctttccgtaaacttgtcaaaatcatcttcttcaaaatatatttccgcatcgtttccgccaaaagaaatatctttatctgacgcattaataaactcgagccacgagtcttttgtttgaagacacaaccctcccgtcagagttatatttgctccaaagtccataatcacacgcagacccaatacttctttataaaatttctttgaattttctaagtctgttactattatcattggattttttaatttcattttgtctacctcactatttttatttaatatcaactgatttataattatctatacaaaacttctaaattgccgttatatcccatactatccgactttcccggcgcttttaataatttgcttttttcattctttattcctgattttttcgataacagtccctatgcccactcctaatatcattccaaataccaagccgtaacacataaattttcctattttcccctgagaaacacctaaagcacaacctactgccatccccagtattgttcctaaaatcatacatatggtgattggtttactaattttttcatagaacatctcttcacacttccatcttcactctcgataagcagcaaactaaaaatcaatacaataactatttataatttttatcctctaaataacattatgaatttatatttaaaaaagttgcttcataagcgggcttcacacacatgcggaggaatattctctataaaaccattgggacgcaattgacagcaagacaatgcgctggacttatccttaaacgcttctgcataatcataacatatatcaacaaattctttataacttttcctagacagctgtaataaaaatcaaactttcctccgccagcccacattttgccccaaaacctcgcaaaccgtacaaattatattacttcacagcggttacattaattctcctgaatgtttcaaagcacctgccgtcaggctgaatcgtcctgctaatcatttcctcaacaacttcgctcctgaactcttcttttaattcgtcaggtatctgctttataaaaggcacaatgctcggctggtctatccatctaatcatttcttccttatcagcaaaaaatctatcttcatttttttcagacacttcagcttttgagaaatttactgatttgattaactctatatactctgcttttgacggcataaaccagggccattcaaaatctttaaaatactcagcgtatttattgcttttcattttttcccgtataacttcaaaaaagtttgaacatgttccgccgccggcaaagttccaggctatttttccattgggttttagagccttataactcctctccaacaaatttttatggtctataatccaatgtaaagcggcatttgaaaatattaaatcaaatcttttttcaaaatccataaaatttacatccatttgaacaaattctaaattttcacagctcagtttttttgccgtctcaatcattcctaaagatgcgtcaatccccaaaacactcccacggggcgttaattctgacaactgctctgtcaagactccgtctccgcagcctaaatccagtattatttcgtcaccgcttaactccaatcccgaaatcagtctgtttccccattctttctgatgtttagaagcctttttgtacttttctccgtcaaattcatacgttcccaatattaaacaactccttattgcagttttaattcaatttattggattattaccaatattttaaattcttttttatttaaatttttagaatattaactcaaaatgtataaatccaactagaaatgataaactccaaaaccgacgtatactctatagaattcaacctttatagaatttattatatctaagaatatactattctgctatctgatttaaaaaatctttaaaactacattacttataaattttaacatataatattaaaaaattccagctttatagaatttattatatctaagaatatactattctgctatcagatttaaaaatcttaaaaactacattgcttataaattttaacatataatattaaaaaattccagctttaataattattgttgagcacaaaatatgaaatttagttaacaacatatttatatgcaataagtatttatataattatttgggtttggatatgcacgcgcagcgcgcggcggctgctcacctaacgcggcacataaatgtgcccttccgatgctcgcttcaaatcttggttttgctatatcttatttttaaaatagtaaaacaaaattgattatgtatataaccattttatatatttatgtagaaaaaatgtgcatttacactcaaaacacggtctattttttaattaatcaatacaaaaaataaaatatatatttatctatcttaaaaagcagatattttggcgagcatcggtaaggcgttcttgcacgcctcgttaggtgagcagccgccgcacgcttagcgtgcatatccaaacccaaataattatataaatacttattacatacaaactaaacgcatttttaagctattaaataaacagatatattactgaaagcttcttttattatataaaataaaacagaagctcaaatattaaaataaatatctgtgcttctgcttaaaacatattttacaaatgattataatctaattatatcaatttacttttttacaatcggtagccatacttcgctcctgtaatcttccgcctgctgataccgctcaggataaacttcaatatccggcgccgcagcatattcatagcctgatgttgggagccattcagatattatacgctgctgtgtattttgtattgattccggcattggtccgacgctttcaaacattgcataggtagtctcaggaataatatattcttccatcccatcaggaacaggtttttcagtagcgacagctataaaatatccggaaaaatctcctttgtcacaagttgaaactcctaatattccctcaggctcactgccgtccatcaaagcgcacaacttgtcaattccgccttgctcgccaacatttttccagaactgcggaactttttcgaaacagtcttccattgtcataggctcttttatagaaaaccctacgatacgaaatgattttttagtcttaattttgtaatccattgcttcttctccttttattgataaagtgaaggtgatacgcggaaaagttgtaagccggactccctctgactttgccttagacggtgaaacaccatgtacactttgaaaagcacggttaaaagctgtcggcgactcatatccatacttaagtgacaaatcaataatcttttcatgaccgtttatcaagtcaaaagcggcagcgctcatacgtcttcttctgatatattcagaaattgtaactcctgcaatataaggaaatattctttgatactgaaacactgagcaggccgcaagctgagccgccttctccatttctatagtttcggtcaaattttcctcgatatattctattgatttatttagtccttctatccaatccacttttatcaccttccaaagctattatacaaaatattatatttaaaaacctctctgcctctgaacaattaaagagagaatttgaaaagtcagcaaaaaataggcagaaagtttaaagttgtttcttttgtgatgtattatgaccacatctgcaagttgggttacatcttcgggtgcttgccaagcacatttttataattttattgaattattttcctatatactatgttctcagtgaacatcggcaggtgtgaccccacctgcagggtgggtgtgagcccaaatatctctttatccttaaaccttcaatgtcaataaattacttagttgtgatgtattgcgtgtttacacgcctcgttaggtgagctaccatctcacgcgaagcgtgagtatattcagagcaatttatcataatccgttttatactaaactgtccctcgactgcgcgccttacgcggctaattccatctgcattgagtatacatattattttttgcgtattcatattattgacattgtaggttaatcaaaacaagtcactatggcttacacccgccctacgggcagggtcacagacattgtaggtttatcaatacaaagtgatatgtataacacacacttttaaaaaaaagtgtggtaacagccctgccgatgcttgctaagccacattttttatataatttttattatattaactttaatatttcagtttaatttattgcattctctccaattgttatttgagtataccacaggttttataaaaacatattaaggacatatccgaatattaaaacggcataactgaaattagttatgccgttagtattaattttcttaaccggatatgtatgatttacactactaagaagttgctgaaatcagcatagccgcccttttcaccgacacaagcaagcgcaaattttgctcctacccatttgccctgcatacattcaaattcaccaagactgatgaaatcgcttccatcaacgctgtatgatacacggcagctcgcttctttactatttgtgcaggaaataacttcaagccttaaatatgcctcggttgtgccgacacacttatcagtaactttccattctctgttatcagtcttaaagttaccgttacagtattcaacaattccctcatcagtcagcgctacataaccatatttttgaccaataaccgccagcactgccttattgtttccaacgcccttaggcattgaaactttaacagttgcaaccatcgaaggcgcctgccaaagctgggttaaaagattcggaagattccagagatatttatcctcttttgtctttaagtcctcactgtacagtctcagacttcctttattttcagtaagtgaataccattcttctttattattagcctgccactgccactggagaccaagtttatctgatgaaaaatcatctgaagtaggaattgtggttatcggatattctgcgccgacatttggcttcttacaacgcataaccggttgtccgcacaggcctgtgtccacgttttcacccattaccggccatccgtcaacccattctaccggctgaagatgaataattctgcctattacctctaaatcctgaaaatgtacaaaccagctctctccgctttcaagctcaaccagtccgccctgatgaggaccgttgatttctgtaagaccttgacgcaatacaatgtgatcttcatatggaccgtaaacattctttgacctcattgccacctgccagccggtaggaacccctcctgccggggacaacacataatacattccgtctcttttataaaatttggggccttctatagtcggctgacttatagttccgttaaatataatcttatcttcgcctatagcttttgttccgtcccaagtcatttcgcagactgcaatatggctcttgattccgcagcggctgttggcgtatccatgaactatgtatgcttttccgtcatcatcccaaagaggacaggtgtctatgagtccaaccccttctttaacgagtatcaaatctgaccactcgccgtatggatcttctgtccaggtcataaatatacctatatcagggtcgccgtaatatatgtaaaactttccgtcattatatcttatagccggcgcccatacaccgcagccgtgaatcggcttattatatctgtcgggaagctttttgacagcgtaattaataatttcccaattgaccaaatcctttgaatgcagaatcggcagtcccggaacatatgtaaagcttgaagcggtcatataaaaatcgtctccgaccctaatcacatccgggtctgagtaatcagcatacaaaattgggtttttaaaagtcccgtctcccaaatccgcaatccattttccttccagtgtgttcataattttcctcctaaatctaaacatatcctaaatcaggcggataaaaatccgcctgataattttataaatacatatactatagttataattttgtattttgttaaaactaaataatatcgtaagttttctaattttaatcaaaaatgacgatatgcaataataaaaatttttagcaatacttaatcacctgaagaaaatatataggaattcttagcctaaaatttatcaacgttagggttaagtttttgcaaatattttagcaaacaataatcccttattaaagaataaagttatattatttaactgataactttatgacagcaatattaactgcttaatacaattttctcaaatgatataccgttaaaactcaaccgctattttctctcatgatacttttatcaaaaatcacataaagcgatttcctgacttttagcagttgccatattttaatataaattcatcaagattctacgccaattatctcatctaaaacaactctaattgattatttcgagttttcagaacttctcactccatcgtaaagataaagcgaaaatctctgcgtataacaatcagtcaaatctataaaaccactccgtctttaaagatagaaatttcacgataaccgttcttctcgttatttgtctgtcttccgtttgctacatctataacaaaatcaaacaaatcctgagtgagaacttcgccgtctactataggtcctgcattaaaatctatccagtgcggttttctttcagccagtcctgagttagacgaaatttttacagttggaaccggagctcccagaggagttcctcttcctgttgtaaacaaaatcaaatgacagcctgaagcggtcagatttgttactgcaacaatatcatttccgggacctgtgagaaggtttaaaccctgctttttcacatgctcgccaatctgaataacgtcaacaacatcgctggtaccactcttctgcacacaccctaacgacttatcctcgagcgttgttataccgccctttttgttgccgggagaaggattttcatatacgacctgattatggcgcataaaatattccttaaaattattgataagatcaacagttttgtcgaacgtctccttatcatgacagcggttcatcagcagagtttcagcgccaaacatctccggaacttcggtaagtatggtgcttcctccgtgagatatcaaaaggtctgaaaactgaccaaccagcggattagcagtaagtcctgaaaaaccgtcgcttcctccgcactttaatcctacaaccaattttgaaacatcacatttctttctggtaaacttctgagcgtactcaacaagctcaccgattagtttcagtccctcttcaacctcattatcatagtcctgagtggacataaatctaattctttcaggattataatcccccagtatacccttaaaaaccggaatattgttattttcacatccaagacctaaaactaaaacaccggcagcatttggatgatttacaagaccctttaaaatcgcctgagtagttttttggtcgtcgcccagctgagagcagccaaacggatgaacaaaattaaatataccgtctgtttttccctcaaacagcttatttgcttcacgtgcaagcagttctgatgtcttgttaacacagccgacagtattgacaatccatatctcgtttctgatacctacgcttccatcatcgcgcacataacctttaaaatatgccttttcgtctgccttttccacacctttaagctgcggctcatatttgtattccaatataccgctgagattagtttttatgttatcggtatgaacatgctctcccttttttatatcgcgtattgcatgtcctataggataaccgtattttataatatcttcgccctctttgatgtcccggtttgcggtcttatgcccgtcaaactctccgcccacatttacttcaacattgtcaagaggacttattttaatttttcccatttgtttatctcctttctcaaagcgaaagaattaacatatcagccgtttacaacttcttccatagcggctctgatacccttttcttctattgattttagataaccgtttattgagtcttttaacatacttaaatctgttccccaatattcttcttttgaaagaatattgtcaacagaagccgtcttcataaattccataacatcaggattatcgttagcagcgtctgttctatagaaagctataagtgcagccagcgagaacacaaggcactttggctccttattgttctcttttatatattcaagaactgacggcagcactctgacctgatactttgatactgaattcaaagctatgctgagcaaatagtgcttgatgaaaggattctggaaacgctctataacatcattggcaaattgaatcaattcatccttaggaaggtcaagagtcggtataatctcatcaaatacaccggtcttcataaagttgaaaacaagctcgtcatccatagcttctttaactgtttcaagccctgcaaggtgtgcagcaagtaccatcatagtatgcgcgccattcagaattctaacctttcttttcttatatggcgtaacatcatctgtccaaagaacgttaagccctatcttatcaaaaggaagttcctctgcatatttcttatcgccttggattacccacaggtggaaaatttcagcagtgtctataatattatcgagatagccgtattccttctccatctcagaagcagtatcacgcggataacctgtaacgattctgtcaaccagagtattggtgaagtaattctcttcctcaacccacttgataaagtcatcgccgtagccaaagtctttagcatacttcaaaacacaagccttaagctcatcgccgtttttatcaataagttcacacggaagcagtaaaaatcccggaagcttattatcaaatcttctcttcatgaacaaagtcagtctgccagggaatgtaagacctgcaaaatcatcaggattttgattcggcttatactcaataccggcttctgttgtgtttgaaattatatatctgagttcaggatttgaagcgcactcaaagaattcatctgtattctcaaatgggtttatacctcttgtgatacagtcaacaactcttgtctcctccaccttttgaccgtcctgcaaacctctcagatacaaggtgtacaagccgtcctgctcgtttatcatagggataagaccctgtgcgagaggctgaactactacaactccgccgtcaaagtctgcttccttattcaatctgtcaatcatccaatcaacaaatccgcgcagaaaatttccctctccaaactgcaaaaacttctcagtaagctgacatttttcttttctctttagtctctccataaattgttcctcctaaaaatatattaacgttcaattttcaagcacagcttatattagtctacgatcttaacaatctcctggttctcattgctctttgcaacaccgttcactgctaaggtagcattagattcagcgtcagtttcgataaaatcttttgccgtaggcgaaaccatagagttgcttatcataatatcctttgattcttttatttcaacagccgtattgcttccctcagaagtgagaccgctgaccttaaccaattctgatttttctatgattattgaagaagttttttcaacatccaaatgcacgttattaaaacttacgtctttcatattagcgcagtagaaaccgtgaccctttgtcggctcaatatgccaagccataatcggcgcacttgccacatcatgatcaccttttgtcatagaacatacaaagttatcaacatgaagactggtaacaggcatctcaggaataccatatatatatccggcagcacacttaacttcacgcgcggtaacattgcttatgtatatattcttaaataccggagtgctgtcttcaaccggttttttatcaagagagaataactccatatcattagggtcggttcctccgcatttataataaccgtttattgtaagcggtgcgaacacgtttgtcatcataatattgtctattctaatatcctcaacgcttccgcctctcttacggcgcgtcttaattcttatacctctgtcggttccgttaaacacacagtttgaaatcgtaacatttctaactccgcctgacatctcgcttccgataacaactccgccgtgtccgttattcatagtacaattggttatcgttatattttcgcatggatacttcttctgcaaatagtcgtcctcggttcctgatttcagagtaacacagtcgtcacccacatcaacctgacagtttgaaacatgaacattagaacagctctcagggtttataccgtccgtattaggagaatcagccggattctttattgagataccgtcaatcgtcacattgcggcagcacataggatgaactgtccacattgcagaatttatgatactgataccggaaagtcttacattttcacacataattggttggaaagccctgggtctctgttcatttttaggatttgaccaccagttatatcctcttccatccaatgttccgcggcctgttacagttatattttttgcatttcttgcggcaacaagtccggtatgcccttctctgttatatccttctaggtcttctttagttatcattgggtagtcctcaggatcagcacttcccaaaattgtagctccgccttcaagatagagcgtcatattgtctcccaagattatcgaaccggtaacatattctcccggcggaaaatatattgttcctccgcccagctttttcagttcaccaataacctcagctatttttttagtgttattggttgttccatcccccacaacaccaaagttggtaacatcaagaacagatgaaatagtgttcatttgtaaaacctccgtttttactatatccaaatttttatttcttttttattatcttacttgccgtttaatactctttttaaaatactatatctaacaaaatactaatatataattgttttactatcaatatatctaataaaacataagctttcaaatttaatatacttcgtgttttaatctaatcagccgggtattccgcaaatttcccaacatatgacatcaacgtttccgcctcgtcatgcgtcagctgcctgctccagtccgcccgttcagacacatctatcagatgtccgtgagaatctgtattattatattccaaatatctggtattcttcgcttctgtcccctcttcaagcctccacggaagccatccaaccggggcgcagtcaaaattataggtacattctataaatgcagtatgtgaattgattccgtcgtcctgcgctctccatgggcgtcccaaatatatacattcacaattttcgtttgcgcttatataacaatgataaaaaacaaaacctgcttctttgttttcagaagtgtttgccgccgttatataagattttgagcgaacacaatttatatcacattcctcaaataacgctgccgcgtctccaaaaataaaatcaacgcttccctcaatataacagtcataaaaaaactgtcttgtttcgctgccatgaatatacatggtatcctgccagcccaaaaaattgcaatgatgaaaaactgatttatcagcaccgcagcttattgcaagcgcctgcgtcacagctctgtcagaatcaattctgttatagctgttctcaaacgttatgttttccgccttaaatccaaccgccgtttcttcaacagtcactgtcgcagatgtaaatgtattatattctagaccattttcatcacaattccccgaagcggcgtcataggtcaatgttacaaagccatctccaaccaaagttagatttttttttgcaatatttatcttttctttatatattcctgacggaataacaataatatccccgtcatttgctgcttcaacagcactttttacagttttgtagtcacgtcttacatatatattcatatttttttaccctaatacgcaagacaactgccaaatatagcattcggcagtatcttgcgttttattaaatttagtgttttagttagatttatttattacttaaatctaatttattatcttactgagcttttgcaagttcagcattttctttctcaatttcagcctttgttctctcataaacagttgtctgaagttcaataaactcctgcagaccaactttgttcatgtcagaaatatacgcgttccactgagcatcattgttaggatcaacatcgcctgagaagaatctctggagatattcatctctcttagcgttaagagctgtctcaaggtcaccgaacttctgctcttcatcctcagtatatctcataggaatctgatcgaagtagtaatacttatcctgtgcctggaaagcgtcccaaagagcttcaactttcttaccgcggatattgtcaaacattgtctgctgttttgcgaattgtgaaccgaatgaaccgaattccttagataaggtcttatctgtcttcttatctgtagccggattactctcgtcataccagcctggaagcatctgcggctcgccgttaactatttcataactttcgccttcaacaccatatgtcatatacatctgaccttcttctgtagcataccagttaaacatcttaagaagtgtgttgtatctgtccatatcgtctgaaataccagcgctgaatgcaggtccccagtttgaatacagagggtctttcttatagatagtacccttttccgggaaagctgttatcatattacctgtccactgccaatcagatactttatcaggatttgttccctttgtcttcttattaaactcgtctatgttataaacatagttataagttataaagcagttatcctgtgcaagtcttgatgagaaagtatccttgtctagtgaaaggatttccttatccataaagccagcgtcattgaacttcttgattgtcttatacatttctcttgcattatctgttgtcaaagcgtatggaacatactctttagtaacagggtcaacatatgaatgctgagttaagataagctcaggaatccagtaagcctggaagaaacctgtgagcgcgctgcccggtgaagttgttcccataccattacaagaaattataatcttatcaggatatgcagctttaatctttgcacaaacatcataaagctcatcaattgtcttcgggaactcagttattcccaactggtcaaatacatcttttctgtaatcccagcacatctgagttttttcctgtctcagtgtaggcagataatatagttctccgtctgaactcttagcgagcgccaaaacctgcttaaagtcttcttcactccataagtttttccaatccttcaagattggattatcacctgtataagcttcttcaggaatcgggtctaggtatttattggtagcccatttcttatactgaggctctttaccgcctgttgtgaaatctgcttcgttaccggttgaatatgaaatgtttgtctttgtttcccagtcacctcttgggattctttcatattcaagttcaacgccaaacatgtctttcattctcttagcaaaatcagtatcctgaccttcagcatactcggtttgatcctgagtatacatattcatacgataagtataaattttattgccttcgctgtcaacatacgagcctctacctgccgagccgcaggaagccagcaaagaagaagccagcactactgatgtagctaaagccacaaccttctttaatttcataagttttatcctcctaaatatatttagtttaattatgcttaacccttaacagaaccaaccataacacccttaacgaaatacttctggatgaatgggtatacacacagcataggcacgatagagataaacagcgttgcatacttaagtgaaacagtacttactgttacagtgttaagttcgccggcagcctgcgcttcagcagcaagctggttctccataactatctgtcttataatatactgcaaaggatacagattcttaactctgtcgctcagataaagcatagcgctgaaccatgtattccacatatacacaccatagaacaaacctacggttgcaagtgcagcctttgaaagaggcaaaataatcttaacaaaaatagtaagttcgtttgctccgtctataaatgcggcttcttcaagctcaaccggaacgctttcaaagaacgaacgcataactatcaagttataagttgaaattgcaacaggaagaatcaacgcccatcttgtatcaagcagtccaaccatctgaactatcaagtatacaggaatcatacctgctgtaaagaacattgtgaatacaatcagctttgtaataagaccgtgaaacggaactctgtcctttgaacgcgacaacggatatgcaagcgttgttgtcagcgccagggaaataactgtatacaaaactgtgttgattactgcctgcaggaatgacattggaaccgtcttacctgtaataatttctttatacgcatctaagttcggctcaacaggccacaaaacaactttacctgcctcaaaagcggcttggctcgaaagtgaaaccgagaaaatgtagatgataggatatagagttacaatcatgagcaaaatcaaaaatatgtaaataactacatccaaaataattgatgatactgtattgtcttttaccattttttagtccccctctcttaccacaaacctgtatcggtgagttttctcgataagaagttagcgaaacatacaagtataacgttaattatcgagttaaacaaaccaactgccgtagagaatgctatctcaccctctttaagacccttgttgtagatatatgtacttagtatctgtgaatgtttatatgtcgcaggctgctgcaaaagcaaagctttgtcagcgccgagtgacattatcttaccaatctgcataacaagcagaattacaattgtaggctttataagctgaatagatatgtgccacattttctgaattctgctggcgccgtcaatagtagcagcttcataaagctcctggtcaacagctgaaagagcggctatgtaaataatagcactccagcctatactctgccaaacatctgaagcgatatagaccgttctgaaccactctgttctctgaaggaatggaataccttcttttaccagatgcagtttaagcaaaaactggttgataataccttcatttgcaagacttcccgcacctacaggagtttgctgtgaagacaagaacaatgtgagcataccagcaactgccgcaactgatacaaagtgaggcagatatgatactgtttgtacgattttcttaaacttagcacctctgagttcgttgatgaacaatgctaaaataatagccagagggaacagccaaatgatatgtaaaacactcaatacgatggtattccatacgtagttccaaacatcaggtatggtgaagaatctaataaattccgcaaaaccataattgtctgcccatggacttccaagaatacctaatcttggctgataatctttaaatgccgctaacaaaccataaaaaggccaatactggaaaattgcataaaatgcaacacccggaatcatcagcaacagcaagaactttcctctggaaaatttgctgcattcatttttgaaccagccggcgataccctttttttctttctttgtgctgccggcactggtatcagacgccgcagccgcggccgcagccgcttttttttctttactcaaagcgtattcctccccttctcaataggataataggcaataaagccatttctataatacttatggtattattatataagatttgcacaaataaatcaagaaaaattctaccatttttgcaaatttcacaataaaactttaaatattataaaaattacaagttttttgtgctttttacataaattttatgctggaatttagtctattttgacatctattttgacataaaattataaattacaacagccgcttctgctctattagcataattgagagggttgaaacaattattttggtcaccctgcataattccaagagcgtataaagcactcacgtatggtcttgcccaatccgaaatcatatcagcgtcgctgaactcctctgtcaagtctccgtaaactgctgttgctccgtccacggctctgcatatcatagccgccatttcttcacgcgtaacatttctgtcaggttcaaacgtcagttctgttgtaccgttaatcaatccatatccatatgctttgtttatatactcggaataccattccgacttatcaacatcagcaaatgaatgttcaccctcagtgatcaccgcatttggatttttagcttcgtaagcaccgacgagcatttttgagaactctgcacgggtaacattaagttcaggattataacatcctgttccgtctcctgatactataccctgctgagtcaaatttgcaattgcgggttcagcccattcaaatccggctaaatcgctgaatgcacctttggagattctaaaatcactcagtttaaattcagacaccttaaagtcttctgctgaagctccgaacagaccaaagtaataattttcacttaaatctgtctcttcttctccgactttcagccactcagctccgtcctgagaatactctgcggtaactttattgcccgtcttgtttattctgagccaaacaggtgtatttttatatttctgctgacctattttttcatatactttgcccttttcagagttctttgtaaacaattctccattataaatttggaaatagaacgcataggaattgtcgccggcactcagtccgtctctcagcaaaaatcctacctggtcatactcgctgacgtcttgggcctcaactttgaatgaagcagtaaaatcaccgttcatacctgtataagcatatgggtactcctcgtttgcaacatccgctactccgaatcctgttccgtatatttttactgtgccgtctgaattaaaatcaaaagcacctctcatcttgctgtctccaacactgacagcgtcccagcccggcatagctgtaaggtcagatacgcctatacttacagacgcgctgtttttggctccgtccttatcataagcaacggcagtaacccagtggctgccggcttccaatccgtcaatcttaacattaaacggagctgaagcgtcttcctgatacaacttaccgtccacatacagttcagctttctctaaagcttcactgtcgcctgaggttacattagctgttatttcatctgttgtataatactggttttgttcagagcttattccgttacggtttgagcttatagaaagctcaacgtcgggaatagaattctcgccataattatcaagagtcaagtccttatatttgccccaagcatatgttgagatttcattggtttccttattgccgtcctgagcaactccgccgtaatttatacctgagaagttaaccattgtctggctgaggaggttccagtctataccgttctcagaatgataagcggatactgtgctgccctctttaaccagctttaaatatctcggcaatacttcaagctttaaaaattcacggttatactttccgtcttgtctgtatttgaaagctatacctgagccgcccttttctatttcgtagttaaccataacgaaatctgacttttcagtcaactcatcacgaatcataagtccgctggcacagttgttattcagccttgaaaccgaggcaatctgtgtagaaagaactgcgttttcatcaacaggctgatacatatatgagaatgaatcagtagtcggatcgcccagcgctatattaaaatcatttccgggaccgataagaccgctgctcttaactgtataaacgccgtctcggtatgaatagcttccgtccattgtggactcgcctatatcggcagtcagccacggcgaaactgaatctgtataattaatatttataacctttatctcagaagttgtagcttctccggcgctgtcaaccgctcttgccgacatatacgctatcccctcttccgcattgttcagagtgaaagtatatgggctggattcagctgttccaaccatctcatcatttttatagaattcaaccttagaaattgaacggccgtcagctgctttggcttcagctttgagttctatcggctctccgtaattgtaacacgtattgtttttaatatttaaagtaacttcaggattctgaggctcagccgcagattcaactataccgttaagataattttccaggtttgtatatccgttgtctgcaattatctttccgtcagccggatcagatttatttaaaccgttctgatcctcataactatccggcattccgtctccgtcagaatcaaaaggtgcttccgcgctgtttaaagttggccatccgccgacttcagattcattattaaccgctcttccggtaccgtttttggtgtcattaataactcttgcatcatatgaatcacgtctcggaacagtagcgccggcgtcaacaagtattttttcgtatgcttcctgagcagtgtctatattatccataggaataagcgtatcatagacaggttcgtcaacatagttcggagcttctgcaccctcgttcagaataacgccctttagattatcgtttgtaacctcactgtttccttccaaaacgtttccgctgaaatagaacactccggcctttgacggattccaaattctgttctttacatccgcatttgtaataggaccggttttgtaatagttatttataacgtttactgtagcttcctcggctccgtaagcattattaaatccccagttgtaaataacgttgtttaccatatcgttgtcatttatcccctcaaaatccgggtgtgtgcttgacaatgacgagtatctcggcaaacggctggtgtgtgtagcaacaagattatgatgatatgttacattagctccgccccatattccgccgtaaccatgacggcctttggcatgaacagcaagcgcaaggctttcgcttatcatacaccactgaactgtggtattggctacgccatacaaagacatggtttcatcagttgaccagctggtagagcagtgatccagaattatatccttttgataccttgcaaacacagcgtcgttttctgcatgagaaatatcgccgggtctgaaacgcatatatcttatgataacgttatccgccgcaataacaatattgtagtctccgacacaaataccgtctccgggagccgtctgacctgctatagtaatattgggctggtccagctttaaagcagatttcaaatgaatggttccagaaacatcaaatactattgttctgttaggtttgcttaccgcgtctctaagcgaaccttcgccgtcatcgtttaaatttgttacgcggtacacttctccgcctcttcctccggttgtatattttccgccgccttctgcgcccggaaatgccggaagattaattgcctgagcctgctcaggtgtcataaatgtttcattttccaaagctgcttcttcagcaaatgcagccggcattatactcacaaccatcataacagccataagtaatgaaacaatatgtttaatactaaagtttcttctcataattgattcctctcttatataaagatacactccaaattaattttcttatgtttataaaatatccgatactccggagcataaaagctccggagttcttacatatataattatacgattttattcataaatgtatgtctcaaaactcaatccatacaagtttattcctgcgtctccataaacatatatagttgtggcttcaccggtataggtatactttgcgctcatttgagtagtcagaacagtcttgttctcacttccgtcattgataacaacgcttcttgttccgctgcttcctgccggttctccataaacgacaatatcagtagttccggccggaacttcaaacgaaacacatttgctggacttgcttccgggaccgcctattttatatctcttagggaaagatataccgtcaattgtttttgatttgctctcaagagttccggttgtagcaactgaaagacctgcatatgtctttccgccctcaagagatgttaaaccgctgaattcttcgcttgaaccaaagttccagaaatgagaatcgagcacttttttaacgtttgatgactggctgagctttacgctgacattatcaatataatatgaagcagtcataccggcttcaggctcaaacagaactgcgtttgttacatcgtatttcttttctgtattaatctgagcacggaaatcagaactttcaataccgctcatatcagcgcacacatttccatcctggtctttgagtaccatctgtgctgtatcaccgccaaatcccatatcagcaaccaaatcaacatgataccattttgaagcactgtattcataccctgtggactgtcctccgaaataaaccaatccatcgtctgcgaatgaaagtttaaatgccttatctcctgattttactctcagataaacattcattccggtcttatcgccggacatcatcaaatcagctccggcagtgattatattagtagaatcctcaggcaaaatatactcgcggaaaatatatctcggagacgaatagtcagaattagtagaaatcttcatctttcctgtctcgtttccgcctatactctcgtttgtccaggacgggttaagaacgtttcgctcctgcttctgccacatccaatcaagaccgtaattaaagttccataaaactgcgcttgaatcagatacttcctgcgctgtaccgtcaaacgggttacaaattggaatcaaatcactcaaattattccaaaggaatattttatatgtatccccatttacgcttccaacatcaacactctcgccgcttatctcagcgttcttagcgtcaaccagaaccccattctcatcgtatccgcacgcaataactgttcctgaggtgaaaccattgcccggattaatagtaaccacgccgttttcataactctttatatatgtttcggttccaccgccaaagctctttaattcttctgttgaaacccagccagcgtcagaagcggcgcttccttctccgcttactgtaccgaatcccatataatagctgtcgcctataccgtcgcactttatactggttaacagcacttttgtcttataaacggtcgagccgttttcagtttgatatatatttatcgtatctccaactttttcagcaataaagtataagttcgcagactggccaataacgtcagttacatcctgaacaagagtcatctcttcgcctgcgccgcttctcttcataagctggtatctcggcttaccgtcctcaccgatgtttccgccgaagtaatatgttacgccgtcggctgttaagtcgttctttataacaactcccatttgtttgccgtcctgcatacggcttctgtaatatatcctgttgtcgccgctgaactcctggcaaaggtatccgaatttgtcggatgttccgccaatactgccgcttgtatctgtagctattttataagtataatcattagttcccaaaacgtatgcttttacgtcatcgggagcatttcctatatcaactatctgccaaggtgaaatatcctgagacacaacaacgtcaacactatcagcacctgaacctaaattttcatcaaagcaatatacttgtaatgtgcctttagctacgcctgtaaattcaacaggaatattaatcgtttcttctctgtccagctcgtttgtactggaagcaagcggagcaccgttaaagtaaacccatacctctgttacctttttacccttatcaggagtaacctttacttcgacattagctgacagacccaatctgtcattattttttatattaacaatctttgcagcagggttagtttgctctgtcacaagctggcacacattaaactttgtaactgtctcgccttgctccacagctgaaacatatgcagaaaccgcagcgtttccggtttgttctccaacttcggcaaccttttcccattcagctaagcttgctcccgcatatagcgacagaacgccttctgactttgaaatcttaaacaacttatatttttcaatgctcttggctgcgccgtcccaaatctgaatatttccggcttctccatagtaaataacttgttcaaagttatcattatacatcttgcctataacaaatttagttccgctggtttcatcaagtgaagaaataccgctttgaacgtttatatttttattagaaagtttatctattcttgcaaccatgtcatagtcgccggaaatattagatttctccatctttccgccgtctaaaacagtatagtcatctccgtcataccacgcattttcagcagtccagccctccggcactgtatcaccggttacagagacggttttaaccgggctgaaaatataacttccgtcgttcttgataactttcactgtgaaatcattatcccctgttggaagttcagaaactgtaatcgctgcagctccgtttacaattgatgaagtttctcctaccttcttgtcgttgcagtacaattctgctttttcaatatttgaaactcctgcacctgatatgttaacagtaaagttaacttcctgattgctttgcacaacgtttttatcggcgcttataccagcttctatatcggttacaggagtttttgttattgcctcctcaacaaatatttcaagccaggtaagtccgtccggaccaatattcttgctgtcgtgaggattagttttgtcaagacccattttgtcttcccaagtatctgctatgccgtcgccgtcagcgtcataatcaccagctctagtctcctgcgcgagcgccggatatcctctgccgtcataatttgtggcgccctctggtatacaatccgtagggtcgtctacaagaccaacgctgcctttgcttccgattggagctgtgcgggtttcaacctcgcctattattcttgtatccacttcgtcacgctttggaagagtggctcccgcgtcactcagaacctcattataaacatcttctgcagcgtccagagttataggataattattatcatattcctgatattgttcatcaggcgtttcaattttcatattggtcttatccgcaacactataaacatttgttgcaacataaacaccggtatgcaaatcatcctgccagttgttctgattaacaagctgggcgtttttataatcgctgtcgccctcgtcaacatctattttatttccggaagcatatacgcttccaagcatattcggcttatacttctgcccaacgctaagctcaaaaattcttgagcgttttcctgccggtgttgccggacccggtctgtaaacattgttctgtatgtatgtcttagctccgttttcagttccgtatcccgccttatcgccccagttataaatgacattatttttcatatcaaccaaagtttggtcatcggtatatccctgggtcatagccacagtttcagatgtaccgattttaggattacggctcttatggctggcaatcagattatggtgtatagacagatttacgccgccccaaattgccgcataactgtgttcgcccttatcatgaacactttggttaagcgcctccgctataatacttctttggatagtaacatttttaacagcataggctgacaagttttcatcagtaccccagcttacactgcagtggtcgataataacattttcgcagtcgtcagttatttccataccgtcctgcgctcttgtgtctttgccctccgcatcatgagctccgacgcggaaacgcaaatatcttaaaattacattatcggctccgaccttaacattgttcgatctgaagcagataccgtctccgggagccgtctgccccagtatagtcatattgtcatggcttatagaaacattgctttttaaatctatatagccggacacgtcaaagacaactattctgtttccttttgaaaccgcatctctgaatgaaccctcaccactgtcattcaaatttgttacatgatatacctcaatctctccgccgttattataagcgcctctggctccctgggagtacattcctccgccttcagcgccgttaaaagctacaacgttcataatatttccgcctgcgcctcctccgccggctactgtctgcgcagcaaaaaccggcagggatacagcgcttaaaccaacagcggcggcagtcagcagtgagccgactttacgcactaacttacctctttttttcattagattttcccctttcctatgtatttaaataaataacaatgtctcagttcaacgattcagagctgaacttcataatataaatcaaatgaaacctgtcgcctaatcagacgaactgattcttctatataataaaaaattaattctcatataagcaccaaaaccgcagcaaatcataaacatttgccgcggcagtttccggtattgccggaaacgtttggcgctttaccgacatttatctattcatttcatcctgatgacctgtagctttatggcttgcgattatgctgtctatttctcccaaactgctgcaggacatatcgcccattacagtattcttaaccgccgacatagcgtttccatactcaataaccttctgcatatcatcacaggttatcataccatataaggctccagccaaatatgcgtcgccgcttccgacgcggtccacaacctcaatattcatatatggctcttcttcatagaactttccgtcatagtatatcttagatgagaagttatgaattttagggctgacaacgtcacgccttgtggtgcacacaactttgcagccatattcttcgcagtaactcttcattatttcctcaagagttcccgttttctgaagcattcttcttgaagtttcctcggacacaaacaaaatatccacataagggaatacagaagtaacagtttttctggccgtttcctcatcccaaagtgacgcgcggtaatttatatcaaaggatattaccgccccgccctctttaaacttcttcataacctctatagtggtctctctgagctgctcgttaagcgcaagagttataccgctgacgtgaaacacagaagtctttccgtaaatagacgggtctatctcgtctatcttaagagtggtcatagcggaattggctctgtcgtatataacagaagactttctaggatatgcccccgtctcataataatatattccaagcctgctttgtcctgagtggtcgtatacgatacagtcgtcgctgacgttgccgtatctaatcatatttcttataaagtgaccgattttattttcgggaagctttgtaataagagcgctgcgaattcccaaaacagctgaacccgaagccacgttcagctccgctccgcccgcttttttgtcaaacgtgtagctttgagaaatcttatccgttcccggcggcgacagacgaagcataacctcgcccattgttaccaaatcatattctttgtttgaatttataaagtccataatatcctcctattttaactcccctgtcatcaaaatcctaaatttctatgccgaaatactctttagcgttattgaaagatattcccttaaccacagtctcaagagtgtccatatcatcagggaattctccgttttcaacccatgtgcccaaaaggttacacatgattcttctgaaatactcatgtcttgtgtatgaaaggaagcttcttgagtctgtaagcattccaacaaacttattaagagcccctaggtttgccagcgctttcatctgctctgtcataccgtctctctggtcattgaaccaccagcctgaaccaaattggatttttccgggaacttcattgccctggaaatttccgagcattgtagcaagaacataattatctttcgggttcaaagtatacaatattgtcttcggcagtttgctctccacctcaagcgcgtttaacagctttgaaagaggagccgcaatacaataatcgcttatagaatcaaaaccggtgtctgcgcctagtttctcaaacattctggtattattatttctgagagctccgatatgaagctggaaagtccagcccaaatcataatacttttcaccaagcttaaccaaagtcttgctcttatacgcgtcagtctcaaactgggtcagtttttcaccgttcattgcctttttgaaaatagcctcaacttcttcatcagacacgtcctcaaacggaacactgtctaaagcgtggtcagaaacacggcttccaacttcattaaagaagtcaattctcttatatacagcggaaatcaaatcctgataactgtcaatttcagctcctgcagtatctgcgagcttctctatatacggcgcaaatgtaggcttgtcaatattaatcataaagtcaggtctgaacgccggcagaactttcgcctttatatgacctttttctttaatctttaaatgccattccaaattatcaacagggtcgtccgttgtgcagataacggcaacgtttgaatcgtttatcagcttagacgggctcatttgagttgctttaatatgagcgtttgccttttcccaaatttcatcggcagtatcttcgcgtataacagtatctataccgaaatatctttgaagctcaagatgggtccagtgataaagcggattgccgatgccgtactgcaaagccttgcagaaagctctgaacttttcctggtcgggagcatcgcctgtcatatatttttcatccaatccgcatgaacgcatgtagcgccatttataatggtctccgcccaagaatatttgggttatattatcaaacggcttgtcctcatacatcatttgcgggctcaaatggcagtgataatcaaaaataggcatgtccgcagcaaaatcatgatataactttttcgctgtctcattgctgagcataaaatccttatccataaactttttcataggtatacctccaaatattacaaaatttttattactttataataggtttatatatttacaatatagttaagcgtatgatagaaattatttacaaaatattcataattccctcacatagctatccttgtatattatacactataacacactaatattgcaaatgtttttttaagtatattaacggattaattgacttatgcgaaaacaaaacctttcattttgataatctgtatttctctttagcaaattttctgtatttttagaaaaactattgatttattgccacggctatgttataataaatcagtacaaaagatttggagggatagcccatgggtttaccagaaggacgcgacatatatattgaccacgaggaaaacgacaagccttatgtgatgaagaattcacacatacacgattactacgaaatctactatcttatggcaggcacaagaagatatttcattaatcacactctgtataatatggagccgggtgacgttattcttgtcaataagggagaccttcatctcaccacgatgatttcatcagaacattactatgaaagatatttgatgacgtttaacgataactttgttgagcgcgtttcccaaaacattgaccgggaacttttcatgaacgcctttgaagttaaaaaggtacacgttcccgtctctaaaagatacgcatttgaggcccttatacataaactcagtacagaatgcgagcgcaacgatgaatatgcagattttctcgcatattcgcatatggctgaacttataatatttcttgacagatgctcaagccacagcgttgttccgtttgatgacatcagtgttcatgaggagaggattcagcaggtatgtaaatatattataaactattataaccagcagattactcttgctgacatttctaagatggcatatatgagcccgacttatttttctaaaaagtttaaaaaagtaaccgggtttggatttaatgaatatctaaataacgtccgcataaaaatggcgacaaacatgcttgttgagacccagtattcagtaaccgaaattgccagattctgcggatataaagacagcaattatttcggcgacgtatttaaaaagataatgggggtttcaccaagcaaatacagaaaagcgaattatacattttaaaataatatcagcgtaaacctgacaaaaacgaaaaatttacaatataaaaagcaccttctttggttttatctaccatgggaggtgttttactttgtcagaaataaatataagatacataaaaataaaaccggctccgcgaaaacggagccggttaactgtttatattttatattttagaatcagaataattattagattatacttacaaatttatgggctcgtttatgttactctttcagatttcataatcattaaactttttaaattttccgaattcttataacacgataacaaacattattcttataacccaatagcaaacattcttaccatcagaccacatcgtaatgtaaaacctcaaatcaaagcgcataaaattgttttattttatattctcaaaaataagtgaaaataatcttgaacataattattctaaattttcatcttcagccgcaccggaatcaatttttaattctacagggttcacatgaaccatgcagtgtttgactttaggaaaattagcttcaatcgcattgtgaacattctcggcaattgcatgggaatctctaagcggcgtattctcatccgctcctatctccacatcaacatataattttgaaccaaacattcttgtcataagcaggtcaagcgaaatgacgccttcctggcttttaatcaagtcggacatctttctttcagtctcatcgtcacacgacttgtcgaccattttgtcaagcgcttctttgcagatattatatgcggctttcacaatgaacaagcatataacaacgctggctaacggatcgcaaatggggaaacccaatctggctcccaaaataccgataaaacttcctactgaagaaagcgcgtcgcttctatgatgccatgcgtctgcaagcaatgccgtagagtcaaccttttttccataaaaccttgtgtaccaaaacatgccttctttaacaacaatcgaaataaccgccgcaactaaagctaacgccccgggcacagccaaatctccgtaattgccgccgaaaatttttttgacgcctgttattccaactccaataccggttataaacaagacaatagcaagcacgattgcagctatacattccattcggtcgtgaccgtaagggtgttcctgatccggatctttcgccgccgcgttcgccccaatcatcacaataatagtgctgaacacgtccgaaacagagtgaatcgcgtcacttatcatagctcctgaatttgctataacacccacaacaaactttatagctgaaagaagcacgttaacaactatacttatgtttgaaacacgcattataatctttttgctgctttggctgttaagtacctcgttctccataatcacactccctatgtctattgaaatcaatacttttaatatgtatgctgaaaaattaattttatgacatattttattccaaataatctttcagctttttactgcggctgggatgacgaagttttcttaaagccttagcttctatctgacgaatcctttcacgggttacattaaactctttgccaacctcttcaagagttcttgctctgccgtcgtccaaaccaaatctaagtctaagcactttttcttctctcggagttaatgtgctcaaaacgtccaccagctgctcctttaacaaagtaaatgtagcggcgtcggacggcgccggtgcgtcatcatcacggataaagtcgccgagatggctgtcctcttcctcgcctatcggcgtctccaaagaaacaggttcctgagcaatctttaaaatttctccaaccttgtcaaccggcatattcagctcttttgcgacttcctccggtatcgggtcgcgtccaagttcctgcactagctgccttgaaacacgaacaagcttgtttatagtctcaaccatatgaacaggtattctaatagtcctcgcctggtcggcaatcgctctggttatagcctgtcttatccaccatgtagcatatgttgagaatttatatccctttgtgtaatcgaacttctcaacagcctttataagacctaaatttccctcctggataaggtcaaggaacaacataccgcggccaacataccgcttcgctatgctgacaaccagtctgagatttgcttctgcaagcttgcgttttgcgttaacgtcgccctcgctcattctcttggctaggtcagcttcctcagcccctgtcaaaagattaacttttcctatctctttaagatacattctaaccgggtcgtctatgctaacgccgtcaggcacagacatatcctccagttcttcctctgtaacctcatcgctttcatccacaacaggttcagggtctatgcttccgacgatttctataccctgtttctctattatttcatatattttatctatctgctctgaatccaattccagttcttccagcttgtccgcaactgttttgtattcaatcattccgagctttttgccgtcctccagcaatccttgaattatctgagcctttttcttggcaacggcaatatcaacttttttcgtctcagccccctgtttttcaaccggcctagaactttcggaaacaccggcgccggtttttgaagcctgttttgacgatttatttgtcacgtcttttgaaccgctctctttagcttccgtattctcaacatccataagctcttgattttcagcattcttatttaattcttcattatttttcataatatataacccccgttattcttttttcttccgctttagctcaaagagccgttttaattcttcttcatccccggaactaatcgccttttctttaatacgttcttcttttgataaagcgataatctccaaaggttttttggaagcttcatatttatcttttatatttttatcacttattaaaatattggatatttctcccacattctcaggtgagcatctgttcagaatatcattcccttctgtgccctcgccgctctcatataattcaaacaaaagcgaagccagcctcttatgtaattctgaacgtataaaatcatcagggactattccggactctttgacaagccctataacccttttatcagtcatcagacacaaaagcagtctttcagcattaaaaagctctctgtcccgatgactggctgaaactcctcctgtcattatgtcccgctctctccgttgtttattttcctcccggcgtcttaaaatagccttttccttattttctattccgcttatgccggctgaaatactttccggactgatagaaagctcttctgctattttgctgatatatatttccctctgagcctggtttttaaccctagataaaattactgacacctcattcaaaaagtcaaccttatcatccaaatcatccaggttatattttaactccgcctcggcaactttatactcaatcaaaggccttgccttttcaatcagaacactaaacatatcagggcctttcatctttataaactcatccggatccttgccgtcggttaccgtcagaactcgcacctttacgtcagcgtcgaagagaatatctccggctcttattgtagcctttttgcctgcttcgtcgttatcataacataaaacggctcttggagcataccgtttaaccaattttgcctgttccggcgtgaaagctgtacccaaagacgctacggcgttattaaatccattctgatgaagagacacaacatccatatatccctccataagaagaagcctgtcagcctttgcgtttttagctatattcaaaccaaatagattatcttttttcttaaacaccaatgtttcaggcgtgttccaatattttggagcgtcggtaccgtcttttactacacgtccgccgaaagctataacattccctctgacgtctataatcggaaaaataactctgccgtcataaaatgcgtcataaaatgttccgttatcacgctttttcaccaatccggcgtccagcatatcattttcattatacccttttttctttaaaaaatttattaaatttgaccatccctcaggagcgtatcccaatccaaaccgctttatcgttgaattactaatcatgcggtttttcagatacgttaatcccggttcacccgccggacttgctaaacactcaaaaaagtatctcgccgcctgagcattaatctcgtatatcttttcacgtttttttgatatggccagctgtttctgcttgtccctgccggttctgttgtccggcatttccatatgtaccctgtccgccaaatattttaaggcatccataaaatcaaggttcatcgccgcctgtatgaaatgaataacgtttcctcctgcgccgcagccaaagcaatgaaacatctgtttatcaggcgagaccgacaaagacggagactttctgtcattatgcagagggcagagccccatcatattattgcctgtgcgttttaaagttgtatactcggaaataatatcaacgatatcgtttctcattacaacttcatctataaagctttgaaaatcagaaccagccattattatttcctttctaaaaaatagtattttaaacttaaaatcaatttacccaaaacttaggtataaacagctcctcataccttgcaatagcgaacgggtcgctcattccggctatataatccatagctattatactattatcgtctgtcctgctgttgtttctggcgtcggcaggaatcaggtcaatatcatttacaaatcttgaataaagcccttcaataatattttttgccttatcctcttctgttgcaacttctgcatttttattcaaataaacattgtcaaacaaaaactgtctcagccccatcatcgcgtcatatatatcaggctccatcacaatatcatgctccatcacaatatcatgctcgcttcctgagatagccgcctttatcatggtatctattcttgctgaatgtctgttgcctaacacatcagaaaactctttaggtatatcgttctcgctgagcaaacctccgcgtatcgaatcgtcaatatcatggttcacataggcgattttatcagcgaccgcaacaatacgcccttccagtgtgtccgctctttttgctccggtgtggcatacaataccgtctctcacctcatatgtaagattcagtccgcctccgccctccaaaacatcaaccactctcaaactctgctcattgtgtttaaacccggtcgggcaaatctcgtttaaaactctctcgcccatatgcccgaacggagtatgacccaaatcatgcccaagtgcaatcgcctcagtcaaatcctcattcaaacaaagcgagcgggctattgtcctggctatctgagcaacttccagcgtatgcgtcagccgcgtacggtaatggtctcccattggggatataaaaacctgcgttttatgtttaagtcttctgaatgcttttgagtagattattctgtcacggtctctttgaaaatcagttctaatttcacaagagttttcactgcgtactctgccttttgactcgctgctccgagccgctttctcagacaaaatttccctttctctgttctcaagcatttccctgacgctcaaacacgacacctccgcataaaacaatgttaaactccctattaatactcgctcttatactattctacaaaaatagattttttccttttatctattgacaaaatgtacttttaataataaaattattttatattactaattttgaaaggtgtttctatgattcctcctacattatcaccaagactaaacaaaatatctgaactcataaacgattcagacgtaacagcggatataggaaccgaccatgcttatctgccggtatctttggtatatagcggcaaatcaaaatatgtcatcgcctcggatataaaaaccgggcctataaaaagagcggaatcaaccgtaaaaaaatatgatatgtctgattttatcagcctcagacaaggcgcaggactggaaacaataacccccggcgacaatgttgatacaatagtaatagccggaatgggcggtcttgtaatctcaagtatcctcgagaactcaccggaaatcttaaatcaggcaaagaaaataatactccagcctatgactatggttcctgaacttagggattatctgtataaaggagactttaaaaatataaaagaatacctggcggttgaggaaaacaaaatatataatattatttcagccgaaccgggtaaagataaatatgaagagccgtcgcctgttgagttattcctcggatgcagtcttataaatgagcgtcctgaacatttcagctcttatgtaaagcggcaggaaaacaaagttctgaagattattgacggactcagcaaatcatcagaacctgaaaatatagaaaaaattaggtattataaaaatttattatctgatattgaaaaatttatcatcggctaggaggaatttatatgccaaaagtgaaggatattgccgaatatattgaaagcttagcccctaaaaccctggctgagccttgggacaacgtcggactaatggtcggtgatatggacagtaatgttgagagcgtatacgtaacccttgatgttacttctgaaaatattgaagaggctgtaaactgcggggctgatttaatcgtttcacaccatccgcttattttcacctcaataaacagagtgattgaacaagacgtcacaggaagcattgtcagaagtctaattaaaaatgacatttctgtatatagcgcccacacaaactttgacatagccgacggcggaatgaatgatatattatgcgataaactcggcctttcaggggtgcgccgctttactgaatctgaatgtactgacccattcggaaaaccgcttgaccaaatcggacgggtaggaatcctagatactccgatagaaatggccgattttgttgactatgtaaaaaatgttttgggatgtatggctatcagctacgtgggaagcgaatccgaaataatctccacagctgcagtgtgcagcggcagcggcggagacttgatttataacgcctataacgccggagccgacgtttacgtgacttcagaaataaagcaccacgaggcacagctggcattggagcttggaataaacttaattgacgcgggtcattttgaaaccgaaaatattatatgtgattttatggaagactatttgctaagccgatttgatgatatttcaataacaaaatcaaccatgctgccttataaaagaagataaataagtacctaatgcgcttttataatttattttaacttaaattcttaatctacgaaccatttatattaattgcaaagtttatataaagaattttttacagattatattatacacatgcagttgcttcattttgtactttgaatctaatacagtgtgaagtcaacagatagctagatataatttaaatggtgtttatagtgaacgacacatcggttgggctgtgaccacactttttaaagtatgtgtaatacaactcactttgtattgataaacctacaatgtcaattgtgactacacttttatttaaaagtgtatgtcttataaactatataatgtgatataaactataaatgccaataattaacttcgttgatataataatcaaacttagttgtgatgtacaaacgaagtacgccgcgtaaggcgcgcagtcgcggaaaatttgtaattagaaaggtttataacaaactattctaaatatgttcacgctacgcgtgagatggtagttcacctaacgaggcagacgtcgtctgccctaccgatgttcactataaacactgtatatacggaaataattgaaaatgaacaataaagtttatcgaaaagtttaggtatataataaaaataaatattaaaattctataaaaatgtggtatagcaagcatcggtagggcgtgcgaagtacgccgcgtaaggcgcgcagtcgcggaaaacttgtaattagaaaggtttataacaaactattctaaatatattcacgctttgcgtgaaatggtagttcacctaacgaggcagacgtcgtctgccctaccgatgttcactataaacactgtatatacggaaataattgaaaatgaaacaataaagtgtatagaaaagttgacgtttataataaaaataaatataaaaattttataaaaatgtggtatagcaagcatcggtagggcgtgcgaagtacgccgcgtaaggcgcgcagtcgcggaaagctcccattgactacatcaactcttttatcaatttcggtgaactcttttaatcttttttgtaacacatcattgacaaacctacattttttaatttatttatattttataagtaaatatttttaaataaataaaaatgcactgttcaacttttatatttttgccaaaataaattattttacactacagaccaagatgtctgcggcaagccgcgacatcttggtctgatattggctgttttattcctgattgtatttctttgaaagctcgtcaatctttccgctttctttcatttcagccaaaactttgttgatttggtctagaagctctttattatcttttcttacagctattgcatattcttctgtttcaaaaacctcagggtcttcaacaaatttgagaccttctttttgtgccagggcaactcctgtagctttgtcgattacaacagcatcaagcttaccgtttttaacgtcttgaactatatcaattcctctgtttgctcttgttattttactgtcatcaattgcgagatcttctgttactatgctgtcgcctgtgtaaccgagaacaacgccgactgttttgttattctttaaatcttctgcactgtttatatcagtgttgtcggctttggtaataataacctgtgaagctgtgtaatatgtttctgaaaaatcaacgctctgttgtctttcttctgtgattgtcattcctgctactgccatatccaccttgcccgattttactgcggcaatcagaccgtcaaattccatatcctcaacttgaagctctttgttcatgctgccggcaatttccttgcctatacatatatcaataccgtcataatttccgactactccattagttgttgtaaattcaaacggcgggaaagcggcgtttgtaccaagcgttaatttgtcgtctttgcttccgcagccagacagaacccccattgtcattactgctgctgcagctattgcagctgctcttttaaaaaattgtttcattcttcttcctcctaatttatattttataattatttacaaaattttgcccaaaaaatctttagtgcgctgattctgtggattcccaaataatttttccgggcttccttcctccactaccattccgtcgtccataaataatactctggaggcaacttcacgcgcaaaccccatttcatgagttactactaccatagtcattcctgcgttagctaaatttttcattacctctaaaacctctcctaccatttccgggtcaagagccgaggttggctcatcaaaaagcattatatccggttccattgcaagagctctggctatggctattctctgtttctgtcctcctgatagctgacccggatatgaattcgctttatcagaaagaccgacaatatttaataattctatagcctttttatttgtatcagaggcattttttttcttaacttttattggagctaaagttatattttcaattacactgagatgcggaaaaagattgaaatgctgaaaaaccattcccattttttcacgcagtttattaacattggttttgggggctgttatgctttcaccctcaataagtatttcgccttccgttggagtttccaaaaggttcaggcaccgaagaaaagtagatttgcctgacccggacgggccaataagcactatcttttcacctttgcgtacatgctgatcaataccttttaaaacttccaaatcaccgaaacttttttttagaccgcttacttttatcaatctgcagccctcctctatcgtatatcggattttctcaatttattttcaaatgcttttagcaatgtgctcactattttaataactacatagtaaataagtgcaattgaaagcataggcactacataatcataggttaaactctgtacttttctggcggcgcctacgaggtctatattggctatcataccgataacagcagtctcttttataagtacaataaattcatttcccagcgcaggaagtatatttttgaccgcctgaggtattattatgtaagtcattgtttggcgctgcgttagtcccagcgacctgccggcctcagtctgtccctggtcgatagataggattcctcctcttactatttcagcaatataagcgccgctgttaataccgaatgcaataacaccgaccatccatctgtcaatattgacattagcaaaaattatgaagtaaattatcaggagctgaaccattgttggagttccgcggataatatcaatatataaaccagagataccgcggaataatttattttttgataatctgccgaaggccattacaacaccaatgaccagacctaccaaaacagcaaaaaatgaaattaaaagcgtgtagccaagaccgctcaaaaaccattgccaccggttatccagtacaaatgttgaatacaaagaatttccgagctcagtaataaagttcattttatatcttccccctccctgtttaaactcttatatttaattatgatagcaaacttttcccaaaatagcaataataaatttgaataataatcaaaatttaagtatttttattattttatgtaataaatctttgattcacgtgttcgtttatatgacttaaacagagtttggaattgcatatttaatatatatatgttataattattaaattaaactcgaaaatttattttttaaaataaaataaaaattttaaataatattgaggtattatatgaagctatccggaaaatctgaactgatgtcagttctcaataaatataatttttctttttcaaaaagtttgggacagaactttttaattgatcagaatattttaaacaaaattgtcagcggttcaggtattaatgagaatacaaatgtactggaggtcggaccgggagcaggaactcttacaagagaactttgtttaaaagcaaagaaagttacagcggttgaaatagataaagctcttatcccaattttaaatgatgtaatgtccgattttgataattttaatctcattaacagtgatattttggagctgaatattaatgagttgataaaaaatgaattcgacaatgaaagctttactgtagtcgcaaatctgccttattatataacaactccaattattatgaattttcttgaaagtgaacttcctgtcaattcaatgactctaatgatacaaaaagaagtcgcagcccgtattcttgccgagcccggaacaaaggattacggtgctctttcggttgctgttcagttctatgctgaacccggaataatctgctctgcttcgcctcattgttttacaccgcagccaaaggtgacatcgactgttgtaaatctcaaattatatgataagccaaaatatgatgtgaaaaataaggaacaattttttaaaattataaaatctattttttcacagcgcagaaaaacactggtgaactcgttatcaggcagcccatatttggatcttagcaaagataaaataatcgacgttttaaaacaaatggaattgaatgagaaagtacgcggtgaaaaactaaatatagaacaaatagctgaactatcgaatataatttatgaaacacaggagtaatataaaatgaaaaaatatgttttagcaagcaaaaacaagcataaagcggatgaaataaaagaaatattaggtgaaaattttgaaattcagactatggatggggccggaataggaaatttagaaattattgaggacggtagtacttttgaagaaaatgctgaaaagaaggctattgaggtgtttaaagccacaggtttgcccactatcgcggatgacagcgggttatgtgttgacgcgctgtcaggaaaaccgggaatttttacggctcgttttgccggagaaaatgcgacagatgatgaaaatatagataaattgctgcttgaaatgtcagaagttaatgaggaaaacaggactgcaaaatttgtctgcgttatagcggtaattgataaaaatatatcagaaaatacacagtttttccgcggtgaatgcaatgggtatataactaaaaaaagagcaggaacaagcgggtttggttacgatccgatattttattatcctgaaaaacagtgcacattgtcagaacttggttcaaatgaaaaaaataaaattagtcataggtacaaagctctgaaaaaatttgcagaatctatatgaaaatgatataaaatgtttcatatgaaacaaaataaataaaaattcgccatatatctatataaattttaattttacgctattgaaaatataaccaggtgtgttataataaagtgacagtgaagaaggatggtacatattatgggaaaaattattgcggtagcaaatcaaaaaggcggagttgggaagacgactactgctataaatcttagcgcatgtttaggattaaaaagaaaaaaagtcttgctgattgatactgacccgcaggcaaacgctacaagcggggttggtataaaacctgaggacgctgaatattcgagctatgattttatagtaaatgatacacctattgaagacgttataatagagacagaatatacaaatatgtggatatgcccgggagatatgaatttggccggtgcagaccttgatttggctgaacaggataatcgtgagtataagttgaaaaaagcacttgaaaatgtaaaggataaatatgattttattattattgactgtccgccgtcactcagtctgataactctaaatgcttttaccgcctgtgatagtgtgattatgccaattcagtgcgaatattatgcgcttgaaggattatcacagcttactaagacaattaagcgagttaagaaaagtcttaataaggatttaagtattgaaggagttcttttaacgatgtttgacagtaggacaaacctatcagttcaggtagtggaagaggtgaaaaaatatttttcttcaactgtattcaatactgttatacccaggaatgtgagactgtctgaggcgcccagttacggtatgcctgttattgcttatgataaaaattcaaaaggagctgagtgctacaaaaaattggctgccgaagtaattaaaaaaaataagaaataatgaattgtttaacgtgaaacaaaatattataaggatgtgagcagatggcttcaaaatctaaaaaggggcttgggagaggacttggagcgctttttgatgacagtaagtcggagaagagcagcgaagggtttgattttttatccgatctatccgatacagaaatcgcagacagcgatagtataaaaatgataaaagttcgtgatatagagccaaataaaaatcagccgagaaaaacgtttgataaagaaaaattggaaatactgagcagttctatagccgctcacggtatagtacagccaattttagttaagccaaatataaacggaacttatatgatagtagccggtgaaaggcgctggagagctgcaaaattagcaaaaataaaagaggttccgtgtgtcatacgtgaattggacgagccggctgtaatggaaattgcattgatagaaaatctgcagcgtgaggatttaaatccgattgaggaagcggagggctacagacgtttgatggagacttgtgaacttacgcaggaagaggtagcggagaaagtgggaagaagcagaagtgcggtcgctaactctctcagactgaataatttatcagaaagagtaaagcaaatggtgattgatggaaaactatcacaggggcatgcaagagcacttttatctataactgatgataatgaacagtttgaattagccaaatttataatagaaaagggtttgaatgtaagacaggttgaaaaacttgtgtctgatacttcagaaaataaaaagaaaccaaaaactaaacaagtaaccggaatgatgaaaaaatatttttctgaggtagaaaatgacctgggttccagattgggcactaaagttaaaattagtgaaggtgcaaataagggaaaaatagaaatagagtattattctaaggacgatttggaaagaatattatttgaactaaaaaagtagttatatatgaaatatagtagatttactttaaaaaccgacttaaaaatttatacctaatttgtaaatttgaataatgtcctaagtaattatattaaaagaaggcaaaattgattctggacatgtttttagcttttatataagcaattggtttttgagaggaggaatgacattgggaaaagagaataaattaaaggaagatgttataaaatctgaaagttctaaaagtgagaaggttataaagtctgaaaagaatactaacccaaaaaagaagagtaatattgcaacatatgcagttgttatgataatttgtgttattattattattttaatagcagctatggctgataaccgcgaagaagaaataggaaatagggttatggaaactgaacagacaaacgcaagcttcgaaaatgaacttgtaaatttgcgtgaagaaaactataagctgaaaaaagagcaggagaaaaatgcttccaagatggaggaagagacaaagtataaagcagtgcttgaggtaatgagcaatatttggacaaaaataaatatgggagatacggaaggcgcaaaacaggatattatttctttggattcttcatcatttgatgatattcaaaggggatactatgaggctttgtgtaaaattttaagtattgacagcgctacaaagcagcctataacagaaaataacgctcagtaataatgtaaagatggaggataaaaatgttagatattaagttaataagaacagaaaccgataggatcaaaaaggctttggcacgaagaaaagaagaggtagacatagatggattgttagagcttgacaataagcgccgtgagttattgtttgacgtggaacaaaaaaaagctcagcagaatgtagtatctaaacagataccacagttcaaaaaagaggggaaggatacaaccgaaatttttgcccaaatgaaagaattatcggatagtatcaaggtagacgatgaaaaagttcgtgagctggacgaaaaaattcagacaataatgtatacaatccctaatatacctaatgagactgttcctgacggcgacaccgatgaggacaatgttgaaatcagaaagtttatggagccgacgaagtttgattttgagccaaaagctcattgggatataggcaaggatttaggtattctcgatccggagagcgcggcaaagattaccggtgcaaggttccatgtttataaaaagggcggagcgagacttgaaagagctattatgaattactatcttgatacacatacaagccgcggatatgatgagatatttcctccttttatggttcacagaaacagtatgctgggaacaggtcagcttccaaagtttgaagaggacgcattcaaagttgccgataccgactatttcttagtaccgacagccgaggttccggtgacaaatatgcacagggatgagatattaaacggcgatgacctgccccttaaatactgcgcatatacagcttgcttcagagcagaggcaggaagcgcgggacgggatacaagaggtctgataagacagcatcagtttaataaggtggagttagttaagttcacaaaacccgaggattcatataaggaactggaggagctgacagccgaggcggagtatgttcttcagggacttaaacttccttatagagtagttaaaatatgtataggagatttgggatttacagcggcaatgaagtacgacatagaagtttggatgccaagctacggcagatatgtggagatatcttcgtgctcaaactttgaagattttcaggcgcgccgtgcgaacataaagtttaaaaactcacctaaagagaaggctcagtatgttcatacgcttaacggcagcggagttgccataggaagaacaacagccgcaatactggagaattatcagaatgaggatggaacggttacaataccagagatactgcgtccgtatatgggcggcgagacagtaattaagccagactagtagtatagctgcaaaatggactttaaaaagtcattgttatggaagattaataaaaaccattgtaaaaggcttatcactgcttaaatacaatggtttttttatattttcttgttatacaaaaattggactatagattttttaagccattttatttttacgacaaaatgtttcacgtaaaacaaaattactcttttggttttgaatatatacagccgcagtagttttgcctgtaaagattatattgggatgaaagctctattgactttttaaatccctctttcttcttaaagtcagaaggtaaaaatgaaatttgatactcatcgcccagcatttggcctatttcattgattttctgtgcatttttaagaggacttatagtgagggtagtgcagaagtaatcgaaactattttcttttgccgccttagctgtagcttctagccgcagcttgtagcatttaaaacatctttcgccgccttcgcggcagttctccaaaccctttgaaatttcaaaaaacttttccgggttgtaatcagcgtctaatatattgattttatttatcgccggaagttcagaaatcagtcttatttgttcctgtttgcgttttagatattcttctttatttgttatgtttgggttataataaaaaaccgttatattaaaatatttatttaaatacgacaaaacatagctgctgcagggggcgcagcagctatgcaataacagcgattttgttgtattttcaccttcaattttattaattatcttatcaagttccagttgataatttatcttattcatgttttcacctgtagtatgtttaaatcattatatatgtaaaatcaccggtacattatattatatttttatataatccgtgatgttgttatcaaatattatcataggttaggtttcaattttcactgattcggttaaatagttcattggcttctttgacagttatttcatcgttatcaatcaagacctgaagccttgcggcaatattacttttcaaaaaagcacgatactcttcatacttaccaaattgattagccacatccgccggcataataccgttcataagcatttcttcgataacagattcctcggctcctgtaatcaacgaaagtaatagagttatattaccgctttcaacatcaactaacatatagttcactcctttctcaagtagtatattcaagttggcttatccttattaataaaatgtattatttttctttacacctatatcataacactttattgttaataattaatgaacgataggttaatattagttaaataattgtgaaaaattaatttataaaagttaattaaaagaacttgattttaatagaaaaaggtgttataataatatggttgtttgaataaagagtatgcgcctgtagctcagctggatagagtgaacggctacgaaccgttaggtcgggggttcgaatccctccaggcgcaccatataggaacggactttggtccgttcctatttttattctttttataccatttcgggaatatgtaacaatttttccatatcggtttcggctgataaagccatccctttatgtagaatcttatcaatatcattatgctgaaaaaagacaatataatctttatcaatgaaaccttgtggataaaggcatccaacataatcgtataatatagcaggatttttctttgttatttgctgtcttccgtaaatcataagcggccaagttccattctttaatacaacaactgtccctattggatagtatttcataatcataactcctttctcaaattatcaaataagttattaagcttaattttgcgatagattttgttattattcgatactgatataaccaaattttgtgaacgaaaaattttctccgccgcctcatttatatctctaactgttacatcatcgtacttcccaatcagttcatctatggagcaaaacggctcattttcaacaaatgtacgccatcctattaaaaaattcagttcatgcacatcgtcaagcaacctgtattgattgtcagtatagaaaaccttgtttgactgcatatcattttctgtcaagccgtattttgactgttgtaatatatcaaataccgccgtcaagctttcttcgatatttttgttatatacttcaaattcaaacgacattcttcccgagtatcccgcaaactcaatatttccgccgattgcacttgtaaatcctaatttctcccttaaaacctgtgacagcttggaggtgacgccgtatccgattatactctgcaaaatttcagccgcataacgatttacggatgctccgtctacatcaaatgaaatactaacatccgaaaatccgtcgcttgagccgtaaattctgtccgatgctgaactacgattacaaaattctttaacagtgtacttgggtagtataagatttgttatcgtatcaggcattggaagttgctctaattcatttgtaaagtgcgataaatcattacagctgaaatttccggttaaaaccacacagcagttctccggcacaaaaacgctcctgcgatattcattaatacaccttgcgctcattctgtttatatcggatatattccccattataaaagaacccttgggcgtactctcgtaatacttcatgtctgcctttgagtacaaggaattatacctgtcctcaatctgtcgcttgacaacacgcttctctgcctcaacctcctgcggccgccactcaaagcttttgaacacctttgatataagcaaaaatgcctctctgatttttgacggtgaaaccgtaatgtcaaggcagataaaatcagcgtatgttgccccatttagcgttgcgcctattttgtctgtttcaaaatacagctgcctttgaggtatgtcgcaaaggcgacgaaagaacatgtgctctgtcatgtgtgcaattccacagattttttccggtagctttcgcgcatatattccaatgttcacactgtgcaggtgttcattttttatatgctttactgtaagactgttatttaagatatttgtttcaaattttgtgttcatataaatatcttctttctctaaggtgtaacaatatttgcaggaatcgtccaccaaagcggcggagcaagagatggaagcattcttaaccctctgtatatggcatatcctgcagcagcagaagcgccaatgacaaattctttctccacaatgcgtttttgacaatatcactttttagtgcgtgtgcttttaatttattgtaattcataaggttcttttaacttacgtaagtaaaattatcaatatcacttgatttttacttacggatctgtaagatacaaatatgcaaatggatatctgcatatccgcaattacacattaacttgttgttaccggcagcattttaatgtgtattttcttttacaatcaatttacaccacgcctttcttatataacagattattttatttcttttcataatcattatatcagaaacaaaagtgacatagtgtgccatttattattatatcatatcattaatataacaacaatgttttatcattgtactaacacaatgtatctttttatataatccatttttggaataagccgatatagagttattgtgtccagattatttaattttgagattaatactgattattggaagtcgaaaacccttgattttaatatgtttttagcaaagttctatctgtatactcgcaccataccgtaacaaagttttctttgctgcgttttttattcaaaaatttacatatactttattacttcttcttttaaagaaaaacagcagattttgagagcctaggagttatcgggtaagtcaaaatatatttaaattattcacgctggccaagctataacaaatcgaaccacatacggcagattacctctgttgtttatgggttcgattttataataattttattttggctttataaggttgcaatgtttaaagccgttattatttgctgcaaattaatagaaaatttttatataaatttttacaccagataaaattgctcctcaaattataattctatatcaagcagtaacgcagtttcgattcaaattttgtatttaattttccgtcacaatcaaggctgcaaactagatttttaaattttacgctgtaactgtgaggattaaaacggttcggcaaattattaaatgatatgtggtcttcatagaattctttttttatttttccattacagtcaatatattttatgcatattccaaatcctgtaacaaccctttttgttcggccaatgtcataacaggccatatttgtattataaacatagcatagtatgaaacgttttaaatcgcagactgaaatatttttttgtatgcattgacacaagcatcggctattcatctcaaccgaccaggaattgctttccgcgcatatgacgtcatcacaggtgtttccgtatacgtatgctgtgttgtcaaacgtgacaggagtttgtttgcagcatggctctgagcaaacatataatacaaatgaaactgtgtaaatttgaccgggacacaacgttccaatataaataccactttgtgggttttcatttgttggtccgcatccgtcttttattgttgagcttgttttatagcataatccttgcggaatattatcatagacaactacattagtaagcgctgtactgcagggattggatattttcagagtgtagactatttcctcgcagagacagcacacggaggtcttgtcggcgtgctttgtgattttaagtccggcattaacaattctaacagagctgcatttacagcttcctaatccatatctgcagcaattgctgcagtctaaatagcaatacctgacgaaagctcggtttactatatcacaggatacagcatagtctacagacacgctgtatcttagttcggctgtttgacccggcggcagactgccgattgaaattccggtttgcagtgtttcctgtggttttggcgctggctgtatagaaccgggtattacggaaactccgggcggaagcgtgtcaaaaatttgaactgtgttcagcgatacatccgagtgatttgtaaactctactgtataggttaaggtatctcctatttgagcagttgatacgctggctcttttattggtactggtccaaatcaaacaactatcacatgcacagttgttcacacataatgtttggcaagggttagctatctgaactgtcttttgttcagttacaaatgattcgcatcccggtaaaatgatttcatcaccgtcacggcagcaaattagattgctgatgtctgttgctgaaccggggacaagcgatagtccgctgcagccgccgtaagtaatatcatacatacgaatgctattcgtgcaaaataatttatagtccagtttagcgtcagtattattacaattatttaatgctttgcaggaaaggtctgtcggcattgcatatttgtctcctttcaaaaaaagggaacgggataaccgttcccctttcataatttcctattttctaagaagctgtcgtaaaaccggaacagcacgaataattattgtcaatataatttgctacaaactgagctctgacaacacgttctgaacaaagtccaaagccctcgtccggcagaatgaactgtatgcatgaaacaagcacatctgaacaagttggtaatccgtgcggcggaatgacaaaggttttcataccacggggctgaatttcgttgtttggatctaattctgtcaaaatgaccgctaaagcaacgcgcctgtcaggacaaacatttagcagattaacatccagctgtaaaattcggcctgtgtcatttagctccaaattacctgcgtcaaactgtataaactcgttgcatccggtcagcggtatgtctatcggtgtagagcataagtcaacagggactacagactggcaatctacaaaaacagaaggattagcaaagctggcagtatttccctcattatctgtatatgaaatagattggtcaatatttttaatacctgaagtagtggcgttatgcttaatagtaaatctaaccgttgcgctttcggtagaagttgagccaagctggctaatgttccatcggaatgatgttcctgtcagcattgatatagtgcccaccgaagctgttggagtgccggtaataataaaatcaggatttattacctcatttattactatatcagttgcaccggggactgatatatttgccgctaaatctgcaaataattgttccagttcggagctgtccggagcaatagaaacatgtgttatatcggggtctgacgcccaattattcagagcgtcaatatcgattccgccattgccaacgagaccaattgtgtaaattgtaattcccatggcttttgcagcggcagcaattggagacggatttggaccggttgtggtttcaccgtcagtaaacataacaatgacgcggttgttggttgatgagctcaaaagcgacgttgcctgtgtgaaagcgtcgccatggtttgttagtccgtcggcagtcagtgacgctgcagctgatttcaaatttgatacagaagtgataagtccggtattttgaaccgccgtatctgcaaaactaactataccaatacggctgccggaaccaatttgaccgggacctccgtcggtagcgtcggagataatatctataaaagtattaacgccggttttcaaatcagcgagcggctgaccttccatacttccggaacggtcaaggactaaaacaatatctgttggattggtggtgatatccggtgcggcggtgattccaattgtaacatttaaagaaccctgacaattgatggagctaacgccgcctatagatttatttgaactaattattcccatttctataacctaccttataataatttgagcattacgctcaatatcaatatatgtcgaaaaatcatatatgttaatacattacggcaggtgtaattcatataaataataaaataaaagtatgtgaatagtgagcgtcggcaggccgcatttatgcggagcgtaaggcgagcaacgcgggtaggatataaaactaaaagtttatactgatatactattccacgcctacgcacctaacgaggtggtctgcgaccaccctaccgaggtttgaaaaccgcttcaacaaataaattgtaaaaattttaaaaaatatcgtgtactcaaagtatctgcaaatatttataagttataatgctttatataaaatattaaaggggtgtttctatgcaattaaatcaaattgttgccaaacgtattcgtatgctttgtgtggaacaatcaataaaccaatatggattattcttaaggagcggcgttcctatgacaacaataagttcagttctgcactgtgtacatcggagtgtgacgctgcaagttttatatgaaatcagcgagggatttggtataagtcttatagacttttttaactctccgctgttcgagcgtgaaaatatcgatgattaaaattgtgctctcagcaaaaaataaatttaatataagtttttatttgtttatttttagtgacttttttactgatatatgctatactgttattataatagttttaaaaaattggtgcagtatatcagaattgggggcgcaggatgttgaaagggagaaaacttttaaaaattaacctgctggtaagtattatattggtatttggcttcattataacttcatttttgagttataacgccaattacagaacctctctcagtaatgtggagcaggtgtcgtctctgacggccgaaagtatatattatcagctgactactatgttcacacgtcctgttaacatctcgcttactatgtcgagagacactctcctggttacccagcttaatgaagaaacaaagcagatgaataatgaggaatatatctcaacactgaaaaattaccttgagacataccgcggaaaatataattttgactctgtctttcttgtctccgaagcgactaaacggtattataactttaacggcgtagaccgcgttctgactgaggataatcctgaaaacgtttggtattatgatttgatgaaaagcgggcaggaatattcgttaaatgttgataacgatgaagttgacggcgcagacaacgccataactgtttttgtaaactgcaagatatacggagagaataacaaggttttgggagtagtcggagtaggaataagaataagctatcttaaggactttttgaagacctatgaggaaaaatatcatctgagaacctgtttggtaaatgaggacggcataatcgaaatatccactacgcatacaggttatggcagaaccgattggtttagcgaatacgacagggaatctatacgcagtcaggtgcttgactggaagagcgataagagtaatttagaattttggactgaaaacgaggataacagtcaggaaaaaagttttgtggcttcacgttatattccggagctgtcatggcacttggtagttgagcaggacaccggaagtataatcggtcagatgaaaataagactttatttgacagcagttattattatcggaatcattattattgtattgataataataagtttagtattatttaagtttataaagcaaatatcagaactcatggaggaacgtcaggcaatatttaaaaaggctactgaggaactttatgacaatatttatgaattgaatataactaaaaatggttatgcaaacgctcccacaaaacagtactttgagagtttgggcgcaaagggtctgccgtataacaaggcgcttaaagttgtggctgagaagcagattaaaaaagaatacagagagggatatattttaacgttttcgcccgaaaacgtcattaaagaatttgagagcggaaataatcatttaagttatgactttttgattactcagaatgatatggactatttttggatgcgtattgacgcatatatattcctgtcacaagaggataactgtattcacatgttcacatatcgtaagaatatagacgcggaaaaacaaatagagcgtcgggcgtcgacagatgagatgaccggattccttactaaaacggcgactgagcattctattatgtctgaattatctgaaaagccggaggacttatatgcgttctttatctttgacatagataattttaaacaggcaaacgaccaatttggtcactcatttggggattactgccttaaagagtttactgaggttataaggaaccatttcagggacggtgatatattgggacgtatcggcggagacgaatttgtggcgtttataccgattcctgataccagatgggtggaaagtaaagcgagagagttatcagcagctttaaacttcaactgcgtaagagaggaaaaggagtggaagctgtcctcaagtataggcgtgtcgattgctccggaagacggaaacgactttaaaacattgtatgagaaggcggacgctgctctgtaccgtaccaagcagagaggaaagaacggatacactatatattaaaagcagaataaagaggagactgccgcaagtttgggagattcatctaatttattttgacggtgtataataataggactttaaataatgatggtgacccacgaaaaagttagatttttggtctaactttcgtgggtcacatcattataaagaagttttattttttattgcctatatgcaagaaactatataaatttttttattgtttttacgctgaattatacgtttattaataattaataggctgatttatttatactgtaatatgaaaaacaccgtatacgttcatgttgtatttccaaatagttctgacttttggtatacaatttattgaaagcataaggtgtttagtctattgttttatattttaaggacaagttaatttaacagaaatattatagtgtctagactgcgaataaaaattttaaggattatttctatatatttctgaatttccataactgctattattgtctgttatgtttaaataattttttatattccgctggcatcattgagttcaaacaggttgccttcagggtctctgaaataggtgcagcgcataccccaatcctcaatagtctgtggttctcctaaaaactgtactcctgcctctttcagacgtttatagtccttttcaaggtcatctgaggggataacggccacaactgtatcaggctgtgaattgcagtcgggctggttatagcctttaaacatactcatattttctccgttaaaaattgcaaagcaaggcggagcgtctttttctacggcaaaagaggtataaggaccgtttctgtcaccccataccggagttaagccgattttatctgtgtaaaagtcaaaacattctccataattcttccgaaccaaaattctgattgtagtattatcaaaccgcatttgttttacctccaatatattttttatttagatattagttaaagctcgtcctacatatttcatgatttttatgtgatacctatgtgcattggtaattttcgcatattgtatattttatatcataagtttccgctgaatatttttataaagccaaatagaaaaactatattttggtttctttcctgtcagtaaataatatgttttcgaaacgccggggaattgttgatttataggttatgccattctccttgctgttatgagcaaacaaatgatatgtatattgctttttcagcattgatataccggtataaataaggcaataaaatttattactgccaatatccttgttgaaatataggttatttcataattgcatttaacataaatttttgcagaaacaagaagttattataattaaatattttggcggcagataaatttattattcattttcttttttatataaatagtaaaatacagaactgcggttcaattatattagtctttaaaattcattgacagactgattctgttctttttggtgtcaacatcaataatttttacctgaacaatgtctccgatagaaacaacgtcggtcgggtgcttaacatagttttcggacagctgggatatatgaacaagaccgtcctgatgaacgcctatatccacaaaagcgccgaaatcaattacatttctcacagttccggtcattatcatgccgggttttaagtcgtctatactcataacgtcacttctgagcaacggctgttcaatatcgtcacgcgggtcgcggccgggtttttgaagctcttttattatatcttttaatgtggggactccaatatccaacttttgcgcaagacttttaaggccgtgcttgtttactgcttcatctaggtttttcagaccatcgctgcttatatccttgaaaccgcactcagaaagcagcattttggcggcgtcatagctttctggatggaccgatgtgttgtccaaaatattttttccgtctgttattctgagaaatccggcgcactgttcgaaggctttaggaccaagtttagacacttttttcagctgttttctgtcagtaaatcttccgttttcctcacggtaactgactatatttttggctatagccgagcttatgccggaaacataactgagcaaaggtgccgatgcggtgtttaagtcaataccgacgctgtttaccgcgtcctcgaccacgccgccgagcgcttcagccagtcgtttttggttcatgtcatgctgatattgtcctacgcctatcgctttaggttcgatttttacaagctcagccagcgggtcctgaatccttctggcaatagatatagcgcttctttgggtgacgtcaaaatccgggaattcctcggttgccagttttgaagcagaatacactgaggcgcctgcctcatttgttataagatatttaacttttgtcccgggtatggtctttaaaagttctgctgtaaatatctcagtctcctttgaagccgtgccgtttcctatggaaatcaagtccacatcatgtttttttataaggtttttaataaattcggcggctgattttttctgcgcttccgaatgtgtgatataaataacccctgtgtctaaaaccttgcctgttccatcgactactccgactttacatccggttctgtaacccgggtcaaggccgataaccaccttgtccttgataagcggctgcataagaagattgtgcagatttgttttaaatatttttatcgcttgttcctgagcgttttcagtcagttcgtttcgtatttccctttctatagacggggcaatcagtctcttataagagtcgtccacagcggcgtcaaaatatttgtgttcgccgccgtcaagttctttccgttttaagtaattgattattttctctgtgtccggtatgattgatacatttaagactttttctttttcgcccctatccattgcgagaaccctgtgcggagctatctttgataccccttcagaaaaatcataatacatttcatatactgtctcggcttcagggtctgttgccttagaagtaatcacgcctgtttgaaaggttatgtctcggattttttttctatgttcagcattgtcggatatttgttcggcaataatgtccatagctccgttcagagcgtcttcaattgataatacttcattttcctcgcttacaaagtcttccgctcttttttcaagttcttcatcactcagcatttgtgagtatatcagcactgagaggggttcgagaccttttgctttggctatagtagccctggttttcctcttgggtctgtatgggcggtataaatcctcaatctctgtgagcttttctgctttatcaattgcctcagccagttccggggtcagtttgccctgttcctcaataatgcgcttgacgtccgctttgcgttcctccatgtttctcagataactgagcctttcatttaagtcgcggagtatttcatcgttaagctcaccggtggcttcttttctgtaccgcgaaataaatgggatagtattcccctcgtcaattagcttcacagtgttttctacttgccaagcgttaagtttaaactcctctgcaagcttctttagtatatccatgtatcaatttctccttaatatctatattttaaaacgaaatctgcgaactgtcaggtagactgtcaaggaccccgttttcgccgagaacttctataaccgttttagttattccggctctgtttttcaaatcttcctttgacataaagtctccgtcttcacgggctgacgctattgcttcagcagcgtttgttccaactccggcaaaggcgttaagcggcggaagtatttttccgtcctttttcccgaatttatatgggtggctttcgtaaaggtctacgggcgcaaagtcaataccgcgctcatacatttcctggcatatttctaatatagtaagcagatttttctcgtttgcggtggccgagttgcctttaatttttatcttcttcatttcctgaatgaccttttcttctccgtgcgccattatagcggcgtcaaaaaggtcggctctaactgtaaagtaggccatatagaattcggcaggatagtgaactttgaagtaggctatcctgaacgccatcattacatatgcggcggcatgagccttagggaacatatattttatctttttacaggagttaatataccattcaggcacgttattttcacgcatagcggcttcaaagtcttccggcataccctcttttgcggctctgccctttctgacaaactccatgattttaaacgccatgctgggttcaagcccatggtgcagaaggtataccataatatcgtcacgcagtcctataacttcggatagcgttgcggttttattcttgacaaggtcctgtgcgttgttaagccaaacatcagtaccgtgggaaagcccggatattataagcagttccacaaaggttgtcggcatagtgtcaaccagcattccgcggacaaagttggttccaaattcaggaacgccaaaagttcctaccttactgtcaatctgttcgggtttgatgccaagagcctcagtgctgctgaacaaactcattgtttctttatcgtcaagaggaatctccaaggcgtttatacctgtcaaatcttccagcattcttattgttgatgggtcatcgtgtccgagtatgtctagctttagcaggttgtcatgtatagaatggaaatcaaagtgtgtggttataatgtctgaatcctttttgtcagccgggtgctgaacaggagtaaagtcatgtatatccatggtcttggggcacactatgattccgccaggatgctgtcctgtcgttcttttcacatcgacaataccctttgagatacgttttagttcagcgtcaggggccactatttcctttttctcataatattttcttgcaaacataactgccgtcttgtcggcaatggtgccgatagtaccggctttgaatacgtacccgtctccaaaaagttcgccgacatatttgtgagccgtcgcctgatattctcccgaaaagttcaggtcaatatcgggaaccttgtcgccctcaaagcctaaaaacgtttcaaacggtatcgtaagaccgtcttttctgagcggcgcgccgcatttcggacaggtcttattcggcatgtccataccggtggggtattcgccgttgtcataaaattcactgtacttgcagtccgggcacacatagtgaggacagagcgcgtttacctctgttataccggacaagaatgcaacaaaggaggagccgacacttcctcggcttccaactaggtagccggcgtcgtttgattttttaaccagcttatgcgcaatcatatacataaccgagtatccgtatttaacaatacagcccagttctctctccatgcgctcctcaactatttcaggcaggttgtcgccgtagatttcatgagccttactgtgacacatatcaatcaaatcctgctcacagttttcaatggtcggagggtatgagccgtccttaacaggctggatatcctctatcatgtcagctatttcaacagtattgtctattactatctcttctgccctgtcgccaagataactgaactcgtccatcatttcggcggtggttctcaagtacagcggggcctggttgtcagcgtcttcaaagccctgagcgcccatcagcacgcgcctgtacatctcgtctttggggtcaagaaaatgaacgtcgcaggttgcaacagttttcctgcctatcttgtcgccaatgctcacaatctttttgtttatctcgattagttcattatcatctctaacttgtccattacgcttcataaaagcgttgtttcctaatggctgaatttcaagatagtcataaaattttgctatctctgccagctcgtcttcggatttcttatttataatagcccggtaaagctcgccggattcacaggcagagcctactataatcccctcgcggtatttgtggagcagacttttgggtattccgggcttcctatagaagtagtccagatttgacctggatattaactggtataagtttttgagcccgacatagttttgcgccagaagtataatgtgatatttcctggtcttcacgaccggattgtctttatccagttcgggaatctcagcttcagccgccgccgcgtctttccatgcggtcatatccatcatttttatgaagcagtaggcagttgccgtggcgtctgcgaccgctctatggtggttgttaagctcaacgcccagcctttggcacataatatttaacttgtgattgttttcatttttaaatatatttctggacatttccagcgtgtccattgttttattaggaaaatataatttgaggcggcgcgcatttgagtatataaatcccatatcaaattttgcgttatgtgcgaccattataccgtcgccgcagaatttttggaattttggcagaactttatcaatcgtgggtttatcctcaaccatttcattggtaattccagtgagttctgtaatttgctcagatatttccatttcgggattaacaagctgtgagaacttatccactataataccgtctctgatttttacagcgcctatctcagttattttgtcacggtctgaactcagaccggtagtctctaagtcaaagactatgtatgttcctttcctcatttcccttatgtcgttaaggcgtttggaatctatgtcgtcgattaaatagccttccattccatatatcattttcagacctttgtgagcctttgctgcctttctggcgtcagggaatccttgggcaactccgtggtcggttatagcgacagcgggatgcccccagaaagccgctctgtcaaccaaagacccaacggatgaaacagcgtccatagcactcattttagtatgcatatgaagttcaacgcgctttttgggataagtgtcttgtctgacaggcggagccggtatcagcagtgcagaggtcactttgattacaaaactgtgaagatactcgtcaaattcatagtttcctgctaccttgagacggttgccctctttaagcattccggtcagggctttcattttttcagaatttccgaaagcgctgcaggtggttgcccattcgtcatcacctatagaaaattttattgaggtgttggaacggttaccgcggactatgtctctgctttcgaaatcaataatttccccttcaacaacgcaatattttgtttcttcggtcagtttaattattggcgtcgggttttcatctatgtattttccgaatgatttcggcgattcggacggagccgccgccttttcgggtcttctttcctggatagaagcggccacaagcttagattctaactctgattgccgcttgagatattcctctcggtcggtttcggcaaaacaaagattaaccgtaacgttaagatcgattccaaacgcaatatgctcacgcataaaggctgaaaaattcatgttattcagagcagactcacagccgttaatatttttaataatgagagtattatcattaagctcccctgtggctcctattaaaaatgcctttccggcatcatggcttgcgagaaaagcgtcaagcagataagaaaaatattggtctgaaaaatcaagaccgggatacttaacaaatatttcaaaatcgttcagaccatatgattgtttggtcatgtttataaacgcttttgtttccgggattggcagcagattctgcccttttaggtaaagctttatattattataatttgtatctatattacaggatactatttcatagctagacaaaagcgacgcgtaattttcaagcacggtcaccctgtcaaaaatatccagtatggttgggctcattttatcatcttccttttaaaacttcattttattcggttaaaccattttattaatttcatcaatcaaacatggaataatctcgtcttcactgacctttctgattatttctccgtgcttgaacaatacgccgcagccatcgccgccggctattcctatatccgcgtctttggcttctccggggccgttgacaacgcagcccataactgcgactttcagatttttatttattccttccaccgcgtcgttgacagcgttggctatggaaataagatcaattttggttctggcgcatgttgggcatgaaactacttcgatataatcttcgtctaagtctaaagctctaagtattgatttggccgcggatacttccaaaattgggtcgtcagtcagagatactcttatagtatcccctattccgtcaacaaggagcgagccaatacctacggaggattttactatcccctgtttaattgttccggcctcagttactccaagatgcagcggataatcaaaagtttggctggcaagcctgtatgctctgacagttgccgcaacgttggaggatttcattgacagcacaatgttatcaaagtcaaaacggtttaggatttcgacatgccgttttgcgctttcgaccattgctttcggcaaatctccgccgcacttatcaagcagacctttttcaagtgagcctgcattcacaccgatacggataggaatatttttggcggccgcggctttggctaccgcttcggcattttcttcaccgcctatgttgccgggatttatacgaaccttgtctattccgcgctcaatacacattaaggccaggcggtagtcaaagtgaatatcggctaccagcggaacgtttgttttattctttatttcttcaatggcttcagcgctctctttgtccggaacggaaaatctaactatatcacagccggctgaggccaaatcgttaatttgtttagttactttttctatatcataagtcggaacgtttgtcattgactgtatagcgaccttatttccgccgcctattgtaatgtttccgattttaacaggttttgtatgtattgaaatttcttccataataaccaccccggataagtttttttatctatatattttatcacaacggcagtacatattcaagtaaataaaatgcgctgatttaattaaattttagctcattgcagggcattaaagtaataactgcatataattaaacggaggggataataatgcgaggcagaatcgaaagtataagttcagtgaaggataggaatcagattattacagttgttggaaacggcgagcataacggaagactgagtatgtttgaaaaaagagataaccggtggataaggctgttttcgtatccatgttcagtgggagcgggcggaatagctgatataaaaagagaaggtgataatataactccgtcaggaatgttcacattaggaacaatttttgggtgcgcggataatccgggaacagagaataattatctaaaggtaaatgacgatatgtattgggtcgatgatttcaattctgaacactataatcagctggtagatatagggaaaggcaaagttgattttgccagcgccgaacatttgtcagattatcctattcaatataaatatgcagttgctgtagactataatattgatggtattccgggcaaaggctcagcaatatttttacactgcaccgataatttagaaaagggaacttcaggttgtattgcggtagacgaggaagcaatgaaaaagataataattaatcttaaaaatgacgcggtaattataataatgggataaaaatatacttttaaaatttattctgtaactttaatttgtgctaataaaacggtatgtggaatattgagtataataaaaataaaatttgggtttaaatagcagtgtgccgtttaggcagcaaatatgttcggatgctgaaacaatgcggaaataaggctttaaggtgataattagttaagacaataagaaaataagacaattaagatagttatatattaatagtggaatgataactttataaatatataaaaaatacatagaaaaagacaattaaataagtccttgccatttggcggtcttaatatattttatgccagcaaagcaggtatgtactttgtttttttgttacaattagattataattattatacagcagtcaattattttcactagattaagttgattagcggttttggccgccttaaaaatattgatgttacttagtacagaaactaacactaaatatagtaattataaaaactattggtttaatttatgattgacaaatttggcataataaaagagccgctaaaattttagcggctcatatcttttaacttaaatatttttagtgagaaataatattctcagtatctttatcaaataagtgaattttatttgcgtcaagagcaaccgtaacggtatccccgtgtcttgctgtagaacgcggattaactcttgcagtaaagtcatttccggcaattttgaaataaagataagtctcagcacccatcatttcaaccaattcaatatttacctttgaacagcagtcaggaacacttgaaatgaatgcagggtcgtcataaatatcttcaggtctgatacccataataacttctttgccgttatactgcttaatttctgatctgccgcccttgccttcaggaagtttaattgagaaatctccgcatttgagatatgtgccgttagaagcgcagtcaacagtaacgttcaagaagttcatctgaggagaaccaatgaagccggcaacaaacatgttgcaaggatattggtataggttagacggtgaatcaacctgctgaataataccgtctttcataacaacgattctggtacccattgtcatagcttccgtctggtcatgcgttacatagataaatgttgtttgaagcttcttatgtattttaccaatctctgttctcatctgaactctgagttttgcgtcaaggtttgaaagaggctcatccatcaagaatactttagggctacgaacgatagcacgtccgagagcaacacgctgtctctgaccgcctgataaagcctttggctttctgtcaagcaaatgctcaataccaagaatctgagcggcttcaataacctttttcttaatttcatcctttggtgtttttctgagtttcagaccaaacgccatattttcaaatacagtcatatgcgggtaaagagcgtagttctggaaaaccatagcgatatctctatcttttggaacgacgtcgttcattaacttatcgcctatgtaaagttcaccctcggtgatttcttcaagaccggctatcattctaagtgttgtagacttaccgcagcctgaaggaccaacaaagattataaattctttatcttcgatttcaagattgaaatctttaacagctgtaaatcctcccgtatatgttttgtaaattcctctaagacttaaacttgccatttttaaatgacctcctgattttatatttgttctgaatcaatatgtatcacagaatttaactacctcattattctaacataattgtgagaataagaaaagggcgtatttcaccaaatttgaaattaagattttagtgattttgcatagctatttttaagacttaaatactttcgggtaaatatatacaaatttttgggtttcacttgatatattttgtctttgatagtataatgctaaacatgaaataaaatgctgtcgatttgctcacaatgcctatcagaagctgtttttaaaaatttatacggagttgatttcaatgataaaagtcggaatattaggcgctaccggatacgccggaattgaagttgtcagacttttgaccgcgcacccggaggcggaaatagtgagagtggtttcgcaaagttttgtggggcagaaaatctcggatgtttatcagaatttgaaggggatatgcgatttatgctgtactgcgctggatgttaacgatatagccggcagttgtgaccttgtcttcacagctttgcctcacggcgcttctaagaccgttattccgtcattgtatgaaaagggtttgaaaatcgtggatttgagcggcgatttcagatataacgacccggccgtctatgaaaagtggtatggagaacctcactcggcgcccgaggttttaaaggaatcggtttatggtctgtgcgaaattcatagagatgaaataaagacccatagactgataggtaatccgggctgttacacgacttgttctattatgggacttgcccctcttgccgcggccaagattgttgacacaaaaaatttgataattgacgcaaagtcaggagtgacaggagccgggcgaagtgcgagtctgcctaatatattctgtgaagtaaatgaatcgcttaaagcatacaaggtggccacccaccgccatacgtctgaaatagagcaggagctttcaatattatcaggcgcggatatagttctttcatttacaccgcatctcgttccgatgcagaggggtatttttgcaacttgttatgccaatcttactaaaaagatgacaacgggtgaagttttggatatttataaagaattttataagggtgaagaatttgtccgtatctatgacgaggggagcctgccggaaataaagcatatagccggctcaaactatgttggtataggagtggttgttgacccgcgtctgaaccgtgcggttgtagtgtcatgtatagataatctgattaaaggcgccgcagggcaagcagtccagaatatgaatttaatttgcggtattgatgagggaacaggacttagggcagctggaatgtatttataaagattgggggattagaaattggaagaacttataaaaaaggccggtatacttgttgaagccctgccttacatacaaaaattgaacggaaaaactgttgttatcaaatacggcggcaacgctatgataagtgaagaactgaaaaacaaggttatggaagatataaccttgctgaaatttataggcctgcacccggtgctggtacacggcggtggtcctgatatctcggagactttgacaaggtttggaattcaaagcgagtttgtaaacgggttaagagtcaccgatgacgagaccatgcgcgtggctcagatggtgcttatgggaaaaaccaataaggaaattgtttcgctgatttcacaaaaaggcggcaaagcattgggtctttcaggaattgacggagagctaattgaatgcgagaagcagtatgccaatgttgacggcaaaattgttgatatcggttatgttggaaagataattaagataaaccaaaaagttttggagtttttggctaacgacgactatatccccgtggttgctccgctgggagtggataaggaaggccgaagctataatataaacgctgatacagtggcaggcgcgatagccgccgcactaaaggcggaaaaacttatgcttttgacagacaccccgggaataaaaagctcgccgaccgctgatgatataatatatgaaattaaccaaaaagaaatatataagatgattgaagccggaaccattgccggcggtatgattccaaaggttaaaggcggacttgaagcattggcaggaggggtaaataatgtacatataattgacggacgtataccgcactgtctgctgcttgaaatatttacagacagcggtataggaaccatgataacccgataatacaagccgtatatgggagctgaatagagggatagtatgaaaaagatgttattagtatcaatgtttcagaacgttacaggtatactgaaaaaagtggaacctgaattaaagaataaaactgtgacatatatccctactgccagtaaggctgaaaagttaggtttttttgtaaaaatcggcaagtggacattgagacgattggggctgactgttgatgagctggatatatattccgcgtcttatgagactgccaaaagtaaactagaaaaaaatgatattatatatgttgccggcggcaatacgttctacttgttgcaggaattaaaaagaaccggaaccgataagttgttagccgatgaaataaacaaaggcaagctttacataggagagtcggcaggcgcaatacttacggcgccggatataggttattctgcagaaatggataatgtgggaaaagcgccggatctgaaagattattcaggacttaatgttgttgatttttatgttgtgccccattataaaaattgggagatggggaaagcggcacagataataattgataaatactcagaaagtttggatttaaaagttattaacgataaacaagctatatttattgacaatgacaaggtcaaaatattagacaaatagactgaccgcaaaggtgatcgccaaatgaaaatgcctgaagaaattgaaccatttatgtttgctccatgcggaatgaactgtaaagtttgttataagcacttggctcataaaaattcgtgcggcggatgtttgaaaattggttctgaaaagccgaaacactgccgtgtatgcaagatcaaggactgcgcaaagaataagggcgtaacatactgttttgaatgtgcaaattatccttgtaaacaggttaattatttggagcaaagctatataaaaaggtatgaggttagtttaatggaaaataccagattagttaaagaatgcgggatagaatactttatgcggcagcaaaagaataaatatacctgcgcaaagtgcggcggtataatttccttacatgataaagagtgcagtgagtgccgaaatagcggcggcaattagttgcagtacgtttctaaatggtaaagaaaagggaatgagatcatgtcagaaataaaagtcagcatagtaaatttaaaaaagcaaacagtatatggtctatggaaaaattcaaatgacagcacagtttcaaaagatataaagaatctttctaaaaaatatcatataaaggtgtcgtcgccgggcagtaaagtgttcccctatttagtgctgtcaaggaattataacgaactgagtaaggattttgaaatgtttgtgggaggcacaatagacaaaaaagggttagaatctttaactattccaaacggtgaatatgccaggataactataaaaccgaaactgggatttttgtggggattggctattggcgaagcaaagagatatttctataccaaatggctgcctaaaagccggtattcggcgctgaatatggaatatgaataccatactgagaagagtgatggaaagtctccggaaatagatatattttttgctgttaagagaaaataacagtaatgcttaacgccggaatagccgaacaataaccgcaaaggttttatagaaatagcacatttccgggaaaaagcgtctttggcagtcacgtcttgttttctcttagtccttgatacgcgcttcttatatattattgtccagcagcaaaacacggtaaatgggaagtgaaccatatctgttcctgttttttgaaaatattaaaatgcttttttatgtatattttcaatctgctattttctgttgcggcacagatatttataataaccgaaacgtgatactttttgaatcggtatacttttttgatattacacattttctaagattcctataaaactgaaattatatacatactttgcacttaaaaagatttgttttgtaatattaattctttatatttttgtagttttttaattcgtattcagcattacaaaagcgttttctatacctcaaaaaccgctttgactatgcttatcatatttgttaattcaacgatacgtaccgatattgttgattccaaatttttttactgtttcataaataatttttttgcctgtccgtacaatttttatagatgcagttttatattgtttgtcataaactgcttgttttataaaccggatcgaattttttaatcattctatactttctatactttgtaattagattattgtactatatcccaaataagtctttatactgcctaaaaaatttgaattatttcaaaagtgatgaacttttatttaggtgtacttttaatattcaacaatgaagacgagctgtcaggaacttacagcccgccttttgattatatctcgaaaataaaaatttaaataattttgcatatataaacccgagtgttcaggaaattaatctgtttacaaaaaataacgcgcttgagttgataaaatatataaataatatcattgagcgcctgattaatcaatgataaacatattattttaatgcgcgctgttataataattatagatttagcttatcaaatgctgctgcaaatggattgttggagtcgtcttcctttttgttttgattgcgaagataattctgcacatctcttttggaagcgccgctttgtcctctccgctccttgaaggcggagtatttttccctgtagccgcaggaacagtagaaactctttttttcaccgtcgcctctaagctccattttcttatgacattcaggacagcgtgcgtttgttattatgctaactgaacggcggtaaccgcagtccctatcctggcagaccagcacttttccttttttaccattgacctcaagcaaatattttccgcagtcaggacaggtctttttagtcatgttgtcatgtttgtattcggcgctgctgtttttaacggtcttaacaaggtcggcggaatacttttctatttcagcaataaatttttgcttttgggttttgccttttgagatcttttctaactcctgttcccacttagcggtgagcaggggttcttttaaatccggcggcaccaaatctataagctgaacgccttttgaagtaggaaccatgctgtttccctgcttttctacatagaatgaggagtataacttttctattatatcggctcttgtggccggggtcccgagacctccgcccaaatattctttcatatttttgtcgtttacaaaacgggagggattttccatagccgaaagcaatgttgcttccgtatatcgtgccggaggttttgtcttgcctgatttgacgaatgtgtttttgcagataaattcatcgctatacttcattttgggaagtatttgtttcctttcctgtgcgtcagcagtatcctcatcatcaaacgagtagtctgaggaatatactgctttccagccaagagaaacctcctctttgcccccggctgtaaacttttcacttccgcactcaaattcagctttgatttgtttatatttatacggacccataaaacaggccaaaaaccgtttgaccacaagattatatatacgcttttcttctgttgagagcgaaatcataggaaccttttgttcagttggtattatggcatggtgatctgagaccttgctgttatttatgcagcttttgttgatttttaatttcctgcggagtatatcttcagccgccgcctttgtatcgccgatggttacagcacgcagacgttcatttaacgtcggaactatatcgtcagtcaaatagcgtgaatcagttctagggtacgtcagtgccttatgctgttcatataatttttgcattatgttgagagtttgtttcggagagtaaccgtagagcttgtttgcgtctctttggagttcggtcaaatcgtataacatgggcgcatacgtctgtttgtcagagcttcttaaagatgtgagcttgaacggtttgcctttaatctctttggatattctttctgctttttcacggtcaaatgtagataatcccccgtctttgctgcgccaggaaacaaataatttgccgatatcggcttctattgtgtaatattccttaggaacaaatttctttatctcattttctctctgcactaatagtgcgagtgtaggagtttgtacacgtccggcggataactgagcattaaacttgcaggtaagggctctcgtaacatttaatccgacaagccagtcggcttcagcccttgcctgggccgccatatagagattataatactccttgccgtctcttagtttctgaaagccttcttttattgctttatcagtctgtgacgatatccaaagtctttttattggttttttaactccgcttttctcaattatccagcgggcaaccagctcgccttcacgcccggcgtcggttgcaataataacggagctgacctctgagcttcgcagctggcgttttacaatgctgtactgttttgaagtctgctttatgacctcgagtttcatctttcccggcagcatagggagcgtttccaggctccaggttttgtattcatctccgtaggcttccgggtcggccaaagtgaccaagtgaccgagagcccatgtcactatatatttgtctcctataaggcatccgtcagattttctgctgcactttaagacccgtgcaagttctcttccgacggatggtttttctgctaagacgagagttttagacatatgttttcctcctttatggggaattattgattgaaattttgtatcataaaattataccacaaaatttatattttgtacatagccggttaaattgacaatagagttaaaacggtgtagaataaataaaatacgagtataattatctattatgatgttaaatatttttataagagaattaggcaggaagggatgatataatatgaatatagaaaagtttgcatattatggtgataagaaaattaaaataaaagatgttccaacctcaagcaagccatatgatgtggagaaagaacggataattgacgaaaccgaaaaaatgaaacctcagatagaagacttgcaggagaaactctatgccgaagccaaagaggggcttataattattattcaggctatagacgcggccggtaaggacagcactattaaacatgtgatgagcggagtgaatccccagggcgtgtctgtaacagcgtttaaacagccctcatctgaggaacttgctcacggttttttgtggcgggcggaaaaagctgttcctagaagaggttatataggaattatgaaccgttcatactatgaggatgtgttggttgtaaaggtgcataatctgcaaaaaacttataaaatgcctaagcggtgcgtagatatgcccgccgcagatttctttaaaaaccgttataagcatattagaaattatgaggaatatctcagtgacaacggatatagggtaatcaaaatatttcttaatgtctcggctgaaaagcagaaggaacgtttcttagagcgaatagacaacccagcaaaaaattggaagttttctgctgatgatttatctgaaagagcgttgtgggacgagtatcaaaaggcctttgaggatatgataaacgaaaccgcaacaaaaacatcggaatggtatgtgctcccggctgatcagaaatggtttacaagatacttagtttcaaaaataatattaaagacgcttaaaaaaatgaaccctaagtatcctgaagtctccaaagaagataaagaggaacttgaggagtgcagaaacgaattattggctcaaaagtaagttcagaaatagtaataacaaaaccgcaccggaactgcagaatagtccggtgcggtttttatataatattttaaggcttgtttataactagtcgttaagatttttgtcaaggatttcaagctgtttcttaatgtcagccggaagtctgtctccaaactgagcaaagtattccttaatattctcaacgtcttctttccaaacttctttatcaacactgagcagagcgtcaagttcttcagcagaaatgccgaggcctgttgtgtcgatgtcagaagctgtgggaagcagaccgatagcactgtcatgggcgtcagccttgcctgaaacacggtcgagtatccaaagaagaactctcatgttatcgccgaatccgggccacataaagttgccttcatcgtcttttctaaaccaattaacgtggaatattgcaggagcattgtcaccgagctttttgcccatttcgagccaatgtccaaaataatcagccatgttgtatccaacgaatggtttcatagccatagggtcacgtcttacaacgcctacagcgccggcagcggcagcggtagtttcagaagccatagtagctcctacaaacacaccgtgttcccagtcgcgtgcttgatataccagcggagcagttttagcgcggcgtccgccgaatacaatagcagaaatcggaacgccctgtgggttttcaaactcagaagaaatacatggacagtttatagccggagctgtaaatcttgagttaggatgagcgaggttgccttcgtatgttgttccgtcaaccttttctcccagccagtttgtgcagttctttggaggattcttgtcaagaccttcccaccatactgtcaggtcgtcattgttaagagcaacatttgtgaaaatggtgttcttctttgtagattccaaagcattgaagtttgtcttttcgcttgttcccggagcaactccgaagaaacctgcttcaggattaatagcatagagctttccgtcttcaggattgattctcagccaagcgatatcgtcgccgactgtccaaaccttatatcctttttcctggagatattccggcggaataagcatagcgaggtttgtcttaccgcaagcgcttgggaatgcggcagcaatatacttaacttctccctgaggattttcaagaccaaggataagcatgtgttctgccatccagccttcttgctttccaagatatgaggcaattctcaaagcgaaacacttcttgccgagaagaacgtttccgccgtaagcagagttaactgacataatcgcattgtcctgcgggaagtgaacgatatatctttcttcaggattaacatcctttttagcgtgcagacattttacaaaatctccgtctgttccaagaacgtccataacttcctgaccgattcttgtcatgatattcatgttaagaacaacatagatactgtctgtaagctctataccgatttttgagaaaggtgagccgacaggtcccattgaataagggataatgtacattgttctgcccttcattgcgcctgtataaagagccttgagcttatcatacatctgacttggctccatccagttgttgattgggccggcttcttcttctgtcggagtacagataaatgttctgtcctcaacacgggcaacgtcgttttcagctgttctgtggtagtaacagcccggaagtttttcctcgttaagcttaataagctcgcctgttgatactgcctcagcgcggagagcctcaagctggctttcgcttccgtcaatccatacaacactttcaggctggcacatagcaatttgctcttccagccacttgtttactttttcattactgcactttgtaaattcagccatattcatcctcctaaaattcatactagtaatttaaaaatttaaacaaatttctagttagtttattttatcacaattctacctcaaatatttggctctgtcaaatagatttttacaaccattgatacatctttcacaatatctacagtcgtgatagttcttgaaaaaaatagctgaaaattttgtgaactttgcttaaaagaaaatgctacaaatttagtaggaaatcatttgatataaaatttatcttcataaacactttgtttaaatatttttttgtgaaataacaattttgataaattcaacttacatataaattgaaaaaataaatagagctgtatataacaaacatcggcagggtgaccgaaggtcagcgcgttaggtgcgtagtcgcggaatagcagctaacaaattaaaatcaccgttaacctatgtccgtatagtttgccttataaactgaaaaatacggaccgacggaatttgccaagagcagtttcgcgaaagtggtatgaataatattttaaataataaaagaaagataaatataaaatacatataaattaaaaagtaaatagagctgtatttaacaaacatcggcagggcgaccgaaggtcagcgcgttaggtgcgtagccgcggaatagcagctaacaaattaaaatcaccggtaacctatgtccgtatagtttgccttataaactaaaaaatacggaccgacggaatttgtcaagagtggtttcgcgagaatggtatgaataatattttaaataataaaagaaagataaatataaaatacatataaattaaaaagtaaatagagctgtatttaacaaacatcggcagggcgaccgaaggttaccgcgttaggtgcgtagccgcggagatgcaaaaaataaataaacataactctaaattaacacaaatcaattgaattcattaaccaaatagatgtgtgctgctgtaaaacacaaaatttgatttataaatttatagttattcttttatttaagagattttatgaacttataagttatttaaactaaatgtataacagataaacatgacatttatggatatataaattattgtttaagtaaaaaacagaccgaaacgatttcggtctgtatctaattaatctttatctattaaagcaaaggaaatttcaccttttgccgctacttcatcgccgacataagcgcaaacgtcagctttgcccattactgaacggaactttgtgagttctacctcaagtcttaacgtctcgcctggcaccacttgatgtttaaatttaaaattatttattccggtaaacacagccagcttgtttttaaattccggtttgctcagtataacaacagcgccaacctgggcgagagcctcacaaatcaaaactccgggcataattggattccctggaaaatgtccctgaaagaacggctcgttcatagtaacatttttaagtccaacagctcgggaaccttcctcaaactctactattttgtcaataagcaaaaatggatatctatgtgggattatatccattatttctttaatattaagttccatataataatacctccagaaatttttatgctaatattataactcaacaaaaaatattttacaataagtattttggtatagaaatataaaaataaaataacattttaatataccgaccgcgcagcttgccttacgagccgcaaagcggactgctgcagcccgcctttgtgttaggataagaaaatactattaaatcaccttataaaatttaatataaatagtgacttaaattatatgtagataaattaaataccttggaaaatattttttatatttaatatgatgtagagttttatgcacagttgatagttgcagaaaaaaatctgtcaaatgttataagatatgtaaattttttaatttttaaaaaaattttttcaaaaaagtattgacaagctattctaaatatgttatcatagtcaggtcgttaacgcgagacagcataaacggcgctaattaaacatggaggggttcccgagtggccaaagggggcagactgtaaatctgttgcatcttgcttcgatggttcgaatccatctccctccaccacaacggagcaaagttcgctttgctccgtttttgtatagaaaaaataagaaatgtcttatatatttttaagtgaaactgtctctgtcaccgttatttttctcagttgtggctattgccgcgcaatacacagctttggcgccggaaagttttaacactcttgcacattcattgaatgttgcgcctgtggtcgtaacatcatcaataaccaggatggttttgcctttaatattatcgctgtttcctttgagaccgaaagctccgttcagattttgctgtctttcaaagctagaaagctctgtttgtttactggtttgtctgattcgtttaaaaaggtttggataatattttacactgagcagtttggcagtcttttttgccagcgcaccgctttggtcaaaccctatttctttcatacgctggcgccgcggcggtatagctgtgatatagtcaaagttgacgccgccaaaatcatttttaaccattgctgttattaaatttgaaaatgtgttcactgaacttaggcttcgggcgtgtttgagattaattattcctcttttggaatttcggtcatattccacagcagcagtaataccattataataggtgcatatatctgacttagcttttctaaaacaactttggcagaggcggtaacgagggtttccaagcggcgtgccgcagactttgcagcgcttgcggctggcacagaattttatcttatccatacattcactgcatatattaatgctggatttttgaaaacttattaattttccgcagaagctgcatttagatggataaacaagatttacaaggcgtctcaaaatattcatagactatgatacctttcgcatataataattaattttacattatatgacataattttgcaagatatatcaaaaatttggcgttaaactaatctaggcgtgatttatttatgacaggaggacaggatttgatagaatttattacaaaaatagattttgcggttttggaatttattcgaaacacattaaacagttcttttatggattacatcatgcctattataaccgattttggttccggaggactgctttggattgcggtgggagtcataatgttatgcactgaaaaatatcgaagatgcggggcttcggttttgattggactgctgctgtgcttggttttgggaaacatcattttaaaaccgcttatcggcagaatgagaccctgctggataaatgacagtatagatatgcttgttaggattcccagggactactccttcccgtcaggacataccctggctgtttttacaacggcgtttataatttttggatattcaaaaaagataggaataccgcttgtagttttagcgtgcttaattggattttcaagaatgtatttatatgtccattaccctactgatgtattgggcggcatagcattagccgctctcattgcgtgggcagttagaaaatttgttaacgggacagtattcagccggatgtttcggaggtttgaagactagaagtttcggttataaaaacttaataattttttatataatatttataaaatcatgacagaacagagttgttttttaaaatcttatataatataataaaaagagtgactttttgaagtttataatttacagataaagcggtttaacttacgattgaggagaggattttttggaaaaaacagaagcaactaaagttgaaacaaaaggcggttcaaaaggaagccattttatgcagggggctttagttttgggtatagccagcctgattgtaaaaataataggcgcagtattcaaaatacctcttattaatttgattggcgatgacggaagcggttattttaatgtggcgtatcaaatatacacgtttatgtttatagtcgctacggccggatttccgatagctatatcaaaaatggttgcagagagtatggctagaaatgatgaaactgatgccaaaagagtatttcagacggcgatttcatttttggctgttataggattggccggcagtataattctatttgtttttgcaaaacagctggcaggtttggttggaattccggatgcagagcttggtataaaagctatttcgccggcagttttctttgtatctttggcgtcgtcaatgagaggctattttcaaggcagacaaaatatgttcccaaccgcaggttctgaagtaatagagtccagcggtaagatggttataggcttgctcatggcgtcgttctttatggggatgactattgttccgaatttggacaaggtgatagattttgtaacacgccaggtagacaccgcccatatgcgtacagtttatgcgtctgccggagccatttttggtgtgactgccggaactcttttgtcgttcctgttactgtcagtaatatacatatgcttggctataggtgcaaagcggcatgctaaaaatattgcgccgatgacagcggcccaggaaaagctgagaccgaaaagaaccattttaaaagaactgataatgatagcaataccaataactataggggcgtctgtttcaagtcttacaactcttatagatatgacaacaataagccgtaggctggttactaatccgaacgtgtttaacgagtacgcatttatgtttgaacaagggacgtcattctatgataaggccgttggagcaggatggaccggtgcggtgctcgattcacagaaagcctcaactctttatggaatgtacacgggaaaagctctgactatgtttaacctgccgttaaccttggttgtggctctgggaatgagtatagttcctgcaatttcatcagctttggctagagccagaaaaggcgaggcaggaagcatcactgagagcgctataagaattgccatgttgttcggtgcgccgtgcgctataggaatgtcggtgctgtccagcggtgttttaggtctgttgtttagtgacgacaatgcgcatgtggttttaagcattttgtcaatagcaataataccggttgccgtagtacaagtcacaaatgcaatactgcagtcatacggaaaagtctattatccggttgtaaatatgttgataggcggagccgccaaggtaattttcaactatatagcaatcccgtacttaggtattgacggagcgcctataggaacttttatctgttatttaatcatagcggtgcttaataccgttcagatagtacgtattgcagacataagatttaaacctattgatatacttataaaaccattgattgcggccggcgttatgggtgtatgcggatactttttatccggtattctgccaacttcaagagttctcactgttttagaaattcttatttgcggaataatatatgtaataatgattttcgctgttcgggctataaaacgtgaggatattatgaatatgcctaagggcgaaaaaatagccggtatactagaaaagtttaaactgataaaataattggagctgaagaggatgaattttaaagatacgaaagataaatatacgtttgatgacctggttgaaattgtttcacttttgcgtgcaccgggcggctgtccctgggatagggagcagactcatcagagtataaagaaaaatcttattgaagaagggtatgaactgattgaggcaattgacggcgggaatcctgaaaaaatagccgacgagagcggggatttactgctgcaggtagtgtttcatgcaataatcgggaaagacagcggagaatatgaaataaatgacgttaccgacgctatctgccgaaaacttattcacagacatccgcatgtgtttggtgaagtcgaagtagcggacagcggagaggttcttaaaaactgggacgctataaaacgtgctgacagggagcagagcagcattgctgaggaactgcgcggagtatcaaaatatctgccggcgcttatgcgagctgagaaaattcagaaaaaggccgaaaaggccggttataagtttgaaaatgagataaatttgtctgtaatttcggatgatgtagccgaagcagaaagtgcaccggagagggactgcggtcagctcctgtttgcggcggtaaacttttgccgcagagccggtgtggatccggaattggctctcgcttcttatactgagagtttcacagatgaatttgagaagtttgagaatagagaaaattaaatctatttgaaaaaacactaaggagaaaattgtaatgcgtttggataaatttttaaaggtgtccaggataatcaagcgccggacggtggctaatgacgcctgcgacgggggccgcgtttccgtaaacggacgcactgtcaaagcgtcatatgacgtgaagcccggagatgaaataaaaatattatttggtgaaaaacctttgaatataagggtcttaaatgtaaaagagaatgtaaaaaaggatgaagccagagagctgtatgaaatagtttaaattttacagataataaatatattgcgaaaaataattctgtctgtgtctgtcgggcagtattgggtttgacgaattaaaacaacttgtcgagtaaatacatgctgtttatatacctaagcggccgccgttaaagaccaaaaattattagttaaaacagctcattataggattaagctgtatctagcaaaaacctaatgggtttagttgatacatctgtttataaaactaagtagcagttggcagaaatataaatggacgtttttatgagttttttccgttcttatacaagttgggtgcaccttccgcagtatgatgaatacctacaattttatgttttttatttatttaaaaactataggacaggaatatagcgagcatcggcaggccgcttttgcggcacgtaaggcgagctgagcggacagtatataaaggtacaattttatataggatgctatcccacgcctacgcacctcatatagtggtatgcgaccaatttgagtattcatattattgacactgcagttacaataaaacaggttaatatggtttatctccactttctaaaaaaagtgggggtcacatctaccgaagtttaataatacattaattttatatttttaatattcaaagctatttataattagtattgaactaaagacaggaatatagcgagcatcgacaggccgcttttgcggcacgtaagtcgagctgagcggatagtatataaagatacaattttaaaaagatacttaaggcggaaatttatatatcgttttaaataatatgtccatactacggtatgatgtttctacttatatacagcaaatgcgctgtaatattttgctcgaagcagaagacatatatattgataattaaaacgttattattgctaaaatctgataaactttgcaatgtgcatttcgtttagtgtgctgaaaaaattgtcgtcaggcaaaaaattacttgacaaaggtctcacagcgtagtataatctatcccgtagacagcaaaggcgctgtgagtattttgctcgcagcgccttattttttatttagtcatttctatttacttttaaaaagaaaggaatgttttgttatggatcaaatgaacgagttattcggcagtgccgtatttgaagactcggtgcaaaaggtcagacttcctgatggaatttacaaacagcttaggaagaccaaagaggagggcacgcctcttacgcgtgaggttgctgatgttgttgccaatgcaatgaaggactgggcggtagaaaatggtgtaacccattttactcactggttccagcctatgactggcgttacagctgagaagcacgacagctttatacagcctgacggtatcgacagcgtgattatggagttcagcggaaaagaattgattaaaggcgagccggacgcttccagttttccatcgggaggtctgcgttcaacttttgaggcaagaggatataccgcgtgggatccaacatcaaacgcctttattaaagacggtatactgtgtattccaactgtattctgttcttatacaggcgaagcgcttgataaaaagacgccgcttatgcgttcaatggaagctctcagtaactcggctgtcagggttcttcacctgataggggaaactgacgtaaacagagttataacgacagtcggtcctgaacaggagtattttttaatagaccgaaaggtagctttaaagagaaaagatattacatatacgggcagaactttgttcggaactccggctccaaaaggacaggagcttgacgaccattattttggagtggttaagagaagagtttcagagtatatgaaggatttggacgaggaactctggaagctgggtatacttgcaaagacaaaacataatgaagtggcaccggcacagcatgaactcgctcctatttttacacaagctaatatagccactgaccataatcagcttactatggagataatgaaaaaggttgctgaaagacatggtatgaaatgcctgctctacgaaaagccttttgaaggaataaacggaagcggcaagcataacaactggtcgatttcgacagacaagggcgaaaacttgctgaaacccggcaagacccctcatgacaatcctagatttttattgttcctgtccgctgtgatagcggctgtggacgaatatcaggatcttttaagatcgtctgtggcaacggcaggaaatgaccacagacttggcgcaaatgaggctccgcctgctattatctctgtatttattggagatgatctcaaagaagtgctggattctattgaagaggacagtgattttgagaacagatgtaatgaggtgatgaactccggtatcgacgctgtgcctgattttgcgaaggatacaaccgacagaaacagaacgtcgccgtttgcattcacagggaataagtttgagtttagaatgcccggctcggctctttcaatttcaggaccgaactttattataaacacagctgttgccgagatacttgaccagtttgctgtcagacttgagaaatcgtcaaaccctaaatgcgagatttataacatagtaagagatactatgaaagaacataaaaggattatttttaacggtaataactattcagacgaatgggttgccgaagctgaacgcaggggtctttgcaatttaaagagcacgcctgaagcattgccggcttttgttactgaaaagagtatagacttatttgttaagcacggtatactcacccgtgatgaaatgctgtcaagatacgagataaatcttgagaattacagcaaggctatcaatattgaggcaaagacgatgcttgaaatggcaagacgcgatatttcgcctgctgtcgcgaaatatgttaaagaactcagcgatactgttgtttctaagagacaaatgggcggttcggtttcttgcgtgtttgaagaaaagatgattagattgctttctgagttagaacttagactgtttgaaacggttgaagctcttgattcaagcgttcaggaagcccttgctatggaagaaggtttggagcaggctgtattttataatgaaaaagtgttgaaagatatggctgaggttcgggaagtagcagaccaaatggagatttatactcctgaagaatactggccgttcccaacctatggagatttgctgttctctatccaggagtaatatagcattccggcaaaatatttctaagttataggttttaaaaagtaaataataagataatagacaatggggtctgagagtaattttctcaggccccattttcttttatatatatacggcgaaacagccggaattaaaaataaggaggaaaaagttatgaacattatggatttggcaacgggtttagatactgcgtgggtgctgctgggagcagctttggtattctttatgcaggcagggttcgctatggtcgaaaccggtttcacaagagcaaaaaacgcgggtaatataattatgaaaaatctgatggattttagtttaggaaccccaattttttggattttaggttttggaattatgtttggcgcaaatgtctttggcggctggctgtcggttccgtcatttttccagggagcaaacgctttgcccggtgattataattttgcaactttaatatttcaaacagtattttgcgccaccgcggcgaccattgtttcgggagcaatggcagagagaaccaaattttccgcatatattgtttacagtatggttataagcgcagtgatttatcctgtttcaggacattgggtttggggcggcggatggctcagtgaattaggttttcatgactttgcgggttccacagcagtacatatggttggcggagtggccgctctggtaggcgcaaaaattcttggtccacgtataggaaaatataaaaaggacgggacatccgtcgcaatacccgggcattcgttaactttgggggctctcggagtatttatactttggttctgctggtttggatttaacggatgttcaacagtagctatgtcagatacagagagttcgtcgttggcggcttcggtttttgtaacgactaatcttgccgctgcctgtgctacagttgctactatggttgttacatgggttagatataaaaagcctgatgtttctatgactctaaacggcgctttagccggtcttgttgcgattacggctggctgtgacagtgttacgccgctcggagcggccgtaattggtactgtggcaggtattttggttgtgtttgctgtggagtttattgacaagaaacttaagatagacgatccggttggagctgtggccgttcatgggtgctgcggagctgccgggacaataatgacgggtttgtttgcagcaaaaggcggtttattttacgggggcggtttcagctttttaggtattcagacattaggagttataacagtaatagcgtgggtcgctgtaacgatgaccattgtatttctaattattaagcatactatggggcttagagcgagtgctgaagaagaaatagaagggcttgatatacatgaacatggcctagcctcttcttatgcggactttatgccaaatgtgccgactattttgacaggaagatcagagacagtgggacaggaaactcccgaatctgctgtgccgataattagagtgccggataatacggaaaagaaagttgataaggacggtcatactattacaaaaataacggtggtgtgtaaagaatctaagtttgaagctctaaagcacgctttaaatgaaatcggagtaacaggaatgactctcacgcatgtgctcggctgcggaatgcagaaaggcagcagtgagtattaccgcggcgtacctgttgaggctaatcttctgcctaaaataaaagtggatatagttgtgtgcagagtacctgtatcagatgttattaaagccgctgttaaaatactttatactggacatatcggagatggaaaaatttttgtttatgacgtacgggatgtggtcaaagtcagaactggagaatcaggatatgacgcaatgacggatgatggagaaaattgttgagtttagaatgggtttaaggttaggtgaaataaggagcgggcgtaatgcccgcccctctttttattcatcagacagcatcttttttctattcattccgtctataactccctgacggtaagacgctttgcattcttcaatcatcataaggttattattttctataaatttaatgacgtttttacattcttcttcgctaagtttttgaggaataaagcgttctaatacctgtctaacagcttcggaggagcttttgtaaatctcctgctcgtggattaagtcattatatttttgactgtttttttgatgatagtacagaatgtcatagatgtactcctgaaggtcactatcaaagtaattctcaaaaaatttagatgcgttttcttccgacacaaaaatctcccttttcaattaaaattctttttatattatatacaaagtttgtcaggtatatacatcacccccaaaaaggaaacacttgagtgtttcttttaaatttattccttgacacatgtatatttttttcacacaatactttattatataataaaataaataaacattacagtaaaatttagatatttaaataaaatgtaaataatcacctatgaatattattttattataaaagcttactttattaagacgatttttatttaaaaaagttttacattaaaaaaataataagaaataaattaaacaaaaaaattgcaattaaaaacctgccggaaactccggcaggtaataaagatcccctattttttttgcgtaagtgcgaaaacatccttagatttgcctattacaacaagatggtcgcttggctggaatatatattcaggggtaggcaatggctttagaatgttttcctgttttattcctattacatttacttcatacttttgtcttatattaagcgaatttatgcttctgccgatccatgaagggacaacaggtatttcgtatattgagtattcgcttgtcagtttaatatagtcaaaaatattgtttgcgttatagcgcatagccagtttttctgcaatctccttctcagggtacactacctcattcgcgcctaccaattttaagaacttagcctgtctgtcctcgcgtgcctttgaaactatatagtttgcccccaggtctttgagcatagatgttatttccagtgaagcctgaaaatcttctccgatagccacaaaacacaggtcaaaattgtttattcccaaagcccgaagaacgccttcctgccggcagtcgccgatttgtgaatcagtgaatattgaagaaaactgctcgatagtcgaatcatctttatcaactatcataacatcattaccaagcgccagcattttggttgcaaaatgcctgcctaaacgtcccattccaattaccaatatagatttcataatcagacctccaaaacttatataaaaacttattatcctattaatatatcttcaacaggccgcataagagccacaggctctctgttttcggcaagcaccagcatgagagacagtccgcctaccctgccggcaaacatcagcactatcagtattgactgggacacaacagacagcgacggggtgagtcccattgaaagcccgactgttccgattgcggaactgacttcgaacagtatttgtcttattgtatatggctctattgagcaaataataaaagttgataccaaaacagccgttaaatagattgatgatatagcgctggctcttttcagtgtgtcgtcgctgagacggcgtttaaagattacaacgttattgtttttccttgatgatgcaaacgccataagaaataaaacaacaaaagttgtagtcttgatacctccggctgttgaaccggggcttcctcctatcagcataagcacggttgtaagcagagaactgctctctgagagcgaggataagtcagtagtgttaaatccggcagttctgggtgtaaccgcttgaaaaaatgagtgcagccatttatcagcagtggataatcctgcaaaatttttattcttttccaaaataaagaacagcaccgtagaactgattaacaaaaccgcagttattgagagcacaatttttgtgtgcagcgaatagtgtttaaagtcgagcttagcctttattatattattccaaaccataaatcccaggccgccgataacaataagaccgcagattgtcagattaacaaccggatcgctttgataatgtatgagggaagagttaggttcaaattttcccataaggtcaaaaccggcgttgcaaaatgccgagattgagtggaagatagcgttgtatataccttctaaaaaccccatctcaggacaaaatcttgttgccagcaaaatcgctcctgcgctctcaaatattaatgttccgaaaaaaatacgtctgacaagctgtatcattccgctgagtttagtatttccggcggactgcatcaataattttctctcgtgaagagaaattctccggcccataaatatagaaaccgttgtaataacggacataaatcccaaaccgccgatttgtatcattaaaagaataaccagctgaccgaaaacagaccagtgcgtatatgtgtcaaatagaactaagccggtgacgcatgtggcgctggtagccgtaaacagcgagtcaaaataagacgtccaggtgttatcttttgaggaaataggcagtgaaagtaatcctgccccgactactatgataaccaaaaaaccaaaagcaattatttgggtataggttgccttatgtttttgtaatgtcctattgttagatgacagctcaaaatcaggagcttccataatattttcctcctatattaccaatgcagcataaaaatgctgttaaaatttgtcggcgcttataaaaaattcacagccgacgggagcaacgtcgatttctattatactatctctgacaggcactatttcaggatttgatatgccgtgagagaaaaatgaaaaatcaccaaactctgaaatgtcaatatcaatatgtttggattcaaagctccggtttacagcgcaaattgccaaactgtttttacagcagtttccaaatgcgttctttccattttttgtgaaacgggcgtatatatataggtcgccgcttgcataaactgttttataatatccaagcgtcaaacagtcggaattgtttcgcagtgcgccaaggtcagtataccactgtctgaggtcagggtcaatagcccgccacggataagttcctctgttaaacgggtcgctgccgccctgcattcctacttcgtcaccataatatatacatggaacgcccacaaatgtcatctgtacaaaagacagcatttttagccgataggttgcgagttcttcgtttcctgaggacaatttctgtgttccgcagtcctgcgaaagaccgccgagcagagtttttatacgcattgtgtcgtgagttccgattatattcatcagggagtacagcgtctcttttggataattctcaaaaatagacataaaatgcgcgttcaggcattcagcgtctatgtttcctaagagaaatgcaatcatattatccttaaacggatagttcattacactgtcgagctcttttcctaaaagatactcgcggcgaatactgtaggagactttattagacgcgtcttcccaaacctcgcctattataaccgcgtcagggtcttgtttttttacttcccggcgcagaattttaataaattcatccggcagttcatcggctacgtcaagtctccagccgctggcgccgcgtttaagccaggtctttataacagaatcctcatctcttaatatataatcaaggtatgaaggagtcatttcgtttacgttgggcaggttactgcagccccaccagctttcgtaattgggatagttagtaaattggtaccattctttatattgactttgtggatttttgtatgctccggtattattaccataattgccatacttgttaaaatatatgctgtcagcgcctgtatggctgaatacgccgtcgagaataactctgattccaagtttttccgcctcatcgcacagagctgtaaatttttcgtttgttccgaacatcgggtctatattcatataatctgcagtatcatacttgtggttggaatacgcgtcaaatattgggtttagatatataacgccaacacccaaactttttaagtattttagtttgtctattataccgcttaaattcccgccgtaaaaatcgttgcaggcaggccccatttcgaaaggatgggcgttaaatgagattggctcataccagtcgctgtgtattatatactcgtttcgctttttgggtataactccatttgtgtcactgtggtctccgaaaaacctgtcagtgaaaatctgatacattatttgacctttaaaccagtcaggtgttttgtagtccttatcgtaaacagttatctgatagctgttatttgccggctcggtctgcgtctgtccgactcctcccaaagaatcattattatttatatagtaaacggcttttcctcctgtctcaactataaaataataccataccaaaccttctttttcaggcataggaactgttgcggtataatagaactcgttttctgcagtattttcactgcctgatgacgaaagggactgtttttggttttccctgctgttcttaggcgccatatcataaaatatttcttcctcgttttcccaaaaccgaattttaactgcgtcaggctgagtatcagaaattatctttaaagcaagtttaactttactgccggtagctgcggcgccaaatggcattctataagctgtatcatgtgagttgtgaaaaagctgcatactatattcctccaaatttctacaatgctgtttccttaatatattatatatattataggttactacacaaacaggtattatacaacagattcttttaaaattcaaatacaaaaatataacaattgaaactattgtcactatgtgctataattaaggaaaaaatttggaggttttaatgaaatatattatatttgatatggacggggttatagtgaattccgaacctgtcattatgaaagcggcgcttgacgctcttaagaacggtggaatagaagcatctgaagaagattttataccctatatcggagccggcgaagagcattttataattgagccgtgcaaaagggcaaataaagcggaactgacagaaaaaataatggatgatatgtttagaaattttgaacaaaacatcaaagaaatgaaggttttcccatcagcaaagccgcttatcgaaaaactgaaaaatttgggatacacgctggcgcttgtgagcagcgccgcagaaagaaagcttgtggcctcgctaaaagccgccgaaattgacccgtcggtttttacggttatactttcaggaaatgatgtgacggagaagaaaccgtctcctgcaccttatttgcttgcggccgataagctgggcgctgacccagctgagtgcttggttatcgaggacgctttaagcggagtaaaatcggcaaaggctgcaggaatgcagtgcgccgcggtcacaacctcatttagtgaagagaagttaaaatcggccggagcggattatgtgactagagatataatagatatattaagtttactgaacggataaaagggtgattttgtgtttaaaacagtgtatggaacggctcgtgcggacagcggcggttatttgtttgaaagcgtcagggcgaatataaaaaatggaataaagtcatatctgctcgttccggagcagttttctgtttttaccgaacgcaaagttatagaaactttgggcgttaaggctcagactttggcggaagtgttgaccttttcaaggctttcgaatcttgtgctcagcagcctggggcctctcagactgagatacatagacggagcaggcagagaaattcttgctggcagagctttgcagcttatagaaaataaactgcagtattttaaatcaaatgttcatcagagaggattttcaagtctgatggcggggcttgtgtcggagtttaaacggtatggtctgagttttgaaagtctgcagactgtttccgaaaaggtagagaaagatgagtttaaacgaaagctggaagacttggctttgttttatgatacatacagcagattaatcaacgaaaataattctgacgcggaggataatctgtcaataatactccctaaaataaaagactttgaaattgaaacggactcgtgtctgtttataaccgaatttaagagttttacgcctctggagtgtcaagtgctgcaggaactgatgaagaagatgagtaacacagttctgtttttaagatgcgatgaccttgttcatccggacggtattttcagttcggcgtctttgacatacaaacagcttgcggaagccgctgaagcgtgcgggattgaggtcagcaagcctgagattttgccggtcaaagacggcggaaaatctgaccttatatttttgcaggacaactattttaatataaaccctgaaaaatatgacggaagcccggaaaatatctttatatattctccggaaaatcattttgacgaggtggaacagaccgcgtcaattatacatagactgtgcaggattaaaggctataagcaaagcgactttttgatattggcaagggatacagatgtgtattcaagaatcatgcctctcgtatttgataaactcggtataaatgtgtttttagacaagcggcgcagcattcttgaaaatccatatttaagatgtatttcaagcatgcttgaaatacttgcctatgggttttcttatgacagggttatggaaatagggcggagcggattcgccggagtcagcaatgaagaagagctggatgtctttgaaaattatctgctttctgtcaaccccagccacgcgatgtggaatgatgaaaatgagtggacgtataatccagataagcgcgcttatgatattgatagtataaaccgaataaaaagcgtgattttagctccgatttttgagttgaaacattcaataaggggacgtaaaaaggccagtgaaattaccgaagcggtttttaagtatatggaaagatgccgtcatcaagagataatgcgtgatatatgcaaagactattcggacaagggcatgatatatcttgccgaagaatataggcgcacatggaacagcgtggtgtcggtgcttgacagaatctctgaaattatgggcggtgagcttataacgtatgagaagttttatgatttgtttatatcggcctgcggcggaataaaaataggaatatctcctcagacgattgacggcgcagtgttcagcaaaatagatatgttcagaaacactgatgcgaaggtggttatagtccttggggtaacagacggtgttttccctagaggttatggaaacgagggtatactgacggatgcggagagagaagcgctgagggaatacggcattgatttggcaatgacagcgtcagaaaagtcgcatgacgagcagcttttggtatataatgttttatcatccccatctgacgaattatatttgcttgctccaaagtcctctgacgatggagaaagtcttttcccgtctaaaattataaccaaaattgagaatgagctttttgatatggaaagagaaaatgtgaatgacgatagcggtgagctgccggagggtaaagaaccggtatttttggcgcttgaatccgaatttatcagatgctgcggagatgtaggcaaatttgcaccaaagtggcgtgcagtctatgatttttatgctgaggatgaaaagtacggcgcacggctcgctgactttgcagagaggttgaaagccgccgaaagcggttatgaaatactgtccaaaaattcggtcgcaaaactgtacggcagagaaataatgctgagcgcttccaaaatggaaaagtataacagctgtgctttctcttattttatgagatatggtctgctggctaaaccaagagatattgcggtttttgatccgctgagtatgggtgatatactccataaatctttggaacgctttttctcctcaaaaaatgacgttgactatgagtcaataacacgggaacagtgcgagaccgaaatgcggaatatagtgagcgaaatagccacgggaaacgaagaggttatgtataaaaattcagcttactataagtatttggttatgcgtatgaccggtatcgcctcaacaaccgcgtgggaaacggtgaaatttttcagggaatccgaattccgtccatatggctttgaaataagaattggtgaaaacggcgatattccgccgcttaaagtcgaaacaaaaaacggaacagcctatgtggaaggttttattgacagggcggacagcgcagtaatcggtggaaaacgatatatcagcgtggtggattataagtcgtcggctaagaaactggacaaagaactggctgacgccggagtgagatttcagcctcttgtgtatacaaacgctgtctgtgagcagagtgaaaccgagcctgcggctatgctttatctgcagatgaacgatcctataatagacgaatctaaagcagcgacggacgaagcttttgaaaccgaggttcacagaaacgtcagcgcaaacggttgggttgtggacgatggagaggtaaataaagcgtttgataagaactatggcagcaagaaatgttatatgtcaccgaaatgcggaataccgccggatgaaatgcaaaaacggctcaaaagagccgaagaaaaaattgtagagtcagccgaaggtatactggccggagagatttcggtcagtccgtacaaaaaaagagggtttgacccatgtgcttattgcgattacagcggaatatgcggaaaaaataatagttaaaatatgcgggcggtttggcatatctttatgagccgaatctgctcgctttttgctgaataatatttgcaaactttatttcgctcaagtataccctgcggaaacaattgagtaatttcagtgtaatatacctgtaataaatttagggatgtttcacaaattttcagtagcggcatacgtttttactgaagcttaatgtaaacattacaaaaatattgctaaaattattttttgtggacaaatgattattggctagaattaggattgactttttaatcaaaaggttgtttaatagagatacaaaaaataaaatcatcaagtttgaaagacaggtaaacctgtcaggatagtacaggagggaagacagttatgaaagaattttcgtacactatcacaaacgagtatgatttagctgctaagccggcgtttgacttgataaagcttgccggagagcatgattgccgcacgtatgtcgtaaagaacgaccatgcgaccgatattaaaaagctatttattctgctcagtatcggaacaaaatgcggagatactataaagtttgtgacagacggcgttgacgagaagtccgctattgataaaatcggaaaatatgtttcctgcaatatgtaggtcaatcttttagataataaaatcagcttaaatcatacaaacttgccggttccgtgtttcggaaccggctaattttttataaaaaaagaccgccgcttaaagcggcagtctggcaatattttatttaattatgcctgaggagcgtcaaccggacatacgtttgcgcagttaccgcagtcaatacattcgtcagcattgatttcatattttgcatcgccttcagagatacatgaaaccggacattcgctagcacatacaccgcattttatgcagtcatcattgatttgataagccattatagtcacctctctatgtaaaattcaaatttattcttactcttgcattatatatcatcaaaggttttttgtcaagatttaattaagatttaagacattattttacaggttttttatagcgtctgtaatgctcttttccattgctaactttccatatttgtcaacttctgttttattcttaggtccgtgggtcagacagccagctccgccgatacagccccccacgcaggccataccctcaataaagttgatgtttcctattccctttgacgctttaagcagcgctgtacggcattcgtcaataccgtcgcatgaaacggcgtggagttcaaagtctccgttgccctgctccttgagtgcttcttgaacggcctcggcaagaccgccgcagcgggcaaatatcctgccgtaatatgatgcgttgttgagctctgattcctcaagttcagtcaggtctatctcacgcgcgtcaaataacgcctgcagttcttcgaatgtcagagcgctgtcaacatactcttttataccgtcttttctgatttccgctttctttgcagtgcatgggccaataaatacaaccttgcagtcagggtcgttctttttgatatacttggctatagccgccataggtgacggattgtgtgaaatgttctctttaagcatcgggaagtttttctccacaaattctacaaaggccggacagcaggaacttgttaaaaatcccttctccgctaattctttagcttcatcataagctaccatatcagcgcccaaagccgcttctacaacattatggaagcccagcctcttgattccggtaaccacttgaccaagcttaatattagcatatgagaactgacccgaaatagaaggagccacaaccgcataaagctttaccttgtcgtcgttggcgtattttttcagcatctccacaacttcaactatgtaggatttgtcagttatcgcgccccatgggcattgatatacgcaggctccgcagttgatacatttgctgtcgtcaataacagccgaatgctcctcgttcatgcttatcgccttgaccttgcaggctttaacgcatggtctttcggtgtgtataatagcgctgtacgggcaaactttagcgcacattccgcactgcacacatttgtctttgtcgatatgcgctttctgattttcgtcaaaggtgatagctccgcgtttgcacacgtcctcgcacctatgagccaaacagccgcggcacatgtgtgtaacttcgtagccggcaacaggacactcgtcgcaggcaatgtccagaacctcaattatgttgtcaacatttttatgtccgcctccggccataccgattctctcgcccactatagctctttccttgtaaatacagcagcgcattgtggctttgtcctttacaatagttttggctatgtcgttaaagctggtgactaggttgtcgtcgtcatatgtatgtcttgccacctcacgaagaaccttatattttaagtattgaaccttagtatcaaattttttgagtataggtttgttttggttgttcatatataatcctcccgtttttactcggctgatactgattttagccggataataaatctatatatctaaaaataattaacagtcacggtttttcccatgtcttctaaacattgtctcagttcgtcgactattttaagttttatgctgaaagaaatatttaaatttgcgtcctgatgggcgtcgttctgagccttgccgacaaacaggtttatgtcggttgcttctttaaacaggagccgggctatttcgctcgctccgtccttttgttttccccatttttcaaatagggaattgtcttcaagataattttttgcgtaatccaaaaccctggctatcgttataactccttcagtcactaagtccacaccctcgattgaggctgtcggtggaatagaagggtcgctgtagtcaggagcggccactatttctttgcccaaataccgggccgtaattttagaggtcgtgccgccgcataccacatgccgcccctgttttgaaaagaacagtgccatcaccttattgtcgtcttccgggtgctccggcggtccgaacaaaaggttgcaggtcttgcgtttccgaatctgaactgcggcaacagttgtgtcgtctcctggctctgaagcgtaaagacggttgcattcgtccgctatttcggaagctataatctttgcggtctgcttgtagttgtagttcgcctcaacataggctatgatgttttctctctgccagccatagtttaagacgcgctcaaccccggcgtatattgcaccgtcgctcatcattataaaaacatcgtcaagctcaacgggtattttagtctcataaatctttttcccctcgataatcctttcagtcatgggatattcgtaattcttcccttttctgagcagtataacaagcggattgtcaaattggattatctcggcttcagtgttcccggtgaacctcataatagtaaaggttgaataggccacgccgcgttttttgcagaccggcagtgtagccgcaacggtcgaaacgcattcatcgatactcatattctccgccatcatggtggagattattttagaggtaagcgttgagagaatattggcttttactccgctgcccaaaccgtccgcgaacaccacaatcaactcatcctcacggcgcacaatttcaaccatatcgccgcaaagttcctctccaacatggttaaggctgacatagccgacatcggcaaataaatcattcatctttattcaaagtctccttaagcttggttaaagcgattttggtttcggcggtagtctcgccgaggagagaggctatttcctgagcgacacgcatctgtttttcaacaaccttatcagtaatttcaatggcgctcatgctttgctcggcctttttctccctcataatctcctcttctgtaacatccttcattatgctcattataatgttatattcagggtcatatattatagtctcgtcaacgtattttttgtactcgctcagatatttccgtttgggttcagaatcctttttgttttcagtcattgctatcatataatctgtcggattcagtatccttacaacaggctcgcccataatatcatttgcgtttttgatattcattatctctaaggcagatttgtttatctgctgtatctctaaactgtcatttaaaacaacaatgccgttcggcgtattgttgattatggtgtctgagaaagactcggccttttccttcaaaaacggcagacacatattcatgtcagccttgccgttcagcacggcgacggccttttcacggcaggttgggtaaccgcagctgccgcagttaagttcctgctcttttgttttctttcccatttggtgcagaatttcctcaatagcagaacttcccggcattactttttttatgtattccgcgtcaaacactttcctgattccgttctcgggctgcttaacatcaaaatctgtcctgccggcagtctttccgatagtgagacaactgctgacatggaaaatgttgtcgtgtttcataaccggtccgcctatacagctgctgtcacaggcgctcatttcaacaaagcagttctcaatatttccgtcgcgtatatcctcaagggcgttcatgcagtcctctattccgtcaacgctgaaatatgaaaaatcatcgtctatatccatgctttcaataattccgcccctggtggggaaccagcgcgcgcgtccgcccccggtcaagtcttcttgtgaaaagtcgaactcaactccgctttcagccatccagtcgttaagctcgtcaaaagtcagggcgcagtccacatagtcagggtatttatcaacctcatcctttttagaaatacaagggccgataaaaaccacttttgcgcccggatgctgatttttaataagctgtccgtgcgcctgcatcggtgatataacgttagctaggtatggcagaacatcgggatagtgcttttgtataagagtgttaacgctgtggcagcacgaggagattataacgctctgctttctgttttctataagcttttcatattctctcttgacaatggttgcacctacagcggtttccccagcgtctttaaagccgagtttttttaatgcgcttctcattatctctatgttaatgcccttataatttgctatatatgacggcgcgactgaggcgtatacttcatcgcctctgtcgataaacccttttgcggacggagtatcgtctcgaagtcttttggcgttctgagggcagttaacataacaccgtccgcagagaatacattcattgggaataatctcggcgtgcccctccacgacctttattgacttcatcggacagaatctaacgcatttataacaatttttacagtttgatttttcaagctgtatacaatttttttgcatgattacacatccttagttaactgtgtttaaaacatatctggagaaaatctcgttaaagttttctttggtcactccgctgataacctggtcgtcaaccttgatgctgaccccgtcgccgcagtggccgaggcagaatgcagcggacataccgaccgtttcatccagtccgttttctttgagggcgtctttcataaggttaataatatcgtaggagccgcggagatggcaggagcttcctatacaaactttgatatccattatgtactcctttcgggcggataatattccgaaaataattatcgccaaaaatatagagccggcaaaaatccgctctgtttcatataccttgattataaaggaaacacggtatattgtcaatgatttaacaactatatttttataaaatttatggaaaattaggataaagaaaaggtaagataattttgggcaaaataaaaacgccgcagaccacgcacctctcgtaatccacagcgtttccttatggtcggggtgacaggattcgaacctg

SEQ ID NO: 3 - protein, 126 aa, Artificial Sequence
  Description of Artificial Sequence: Synthetic polypeptide
QVRLVQSGAEVKKPGASVKVSCKTSGYTFTNFGISWLRQAPGQGLEWMAWISAHNGKTNFGQKFQGRVTMTTDTFTNTVSMEMRSLRSDDTAVYYCARDYGGNIYRGDAYYALDVWGQGTTVTVSS

SEQ ID NO: 4 - protein, 112 aa, Artificial Sequence
  Description of Artificial Sequence: Synthetic polypeptide
DVVLTQSPFSLPVTLGQPASISCRSSQSLVYSDGNTYLNWFQQRPGQSPRRLIYKVSNRDSGVPDRFSGSGSGTDFTLTISRVEAEDIGVYYCMQATHWPPTFGGGTKVEIK

SEQ ID NO: 5 - protein, 128 aa, Artificial Sequence
  Description of Artificial Sequence: Synthetic polypeptide
QVTLKESGPVLVIPTETLTLTCTVSGFSLSNARMGVSWIRQPPGKALEWLAHIFSNDEKSYSTSLKSRLTISKDTSKSQVVLTMTNMDPVDTATYYCARIGGSCSGDNCYLSDWFDPWGQGTLVTVSS

SEQ ID NO: 6 - protein, 107 aa, Artificial Sequence
  Description of Artificial Sequence: Synthetic polypeptide
EIILTQSPATLSLSPGERATLSCRASQSVSNYLAWYQQKPGQAPRLLIYDASNRATGIPARFSGSGSGTDFTLTISSLEPEDFAVYYCQHRSNWPLTFGGGTKVEIK

SEQ ID NO: 7 - protein, 121 aa, Artificial Sequence
  Description of Artificial Sequence: Synthetic polypeptide
QVHMVESGGGVVQPGRSLRLSCEASGFTFNRYGMHWVRQGPGKGLEWVAAITYDGNREFYADSVKGRFTISRDNSNNVLYLEMNSLRTEDTAVYYCAKEGDSDHDYVFDSWGQGALVTVSS

SEQ ID NO: 8 - protein, 109 aa, Artificial Sequence
  Description of Artificial Sequence: Synthetic polypeptide
ETVLTQSPGTLSLSPGERATLSCRASQSVSGNYLAWYQQKVGQAPRLLIYGASRRATGIPERFSGSGSGTDFTLTISRLEPEDFAVYICQQYDSSPSWTFGQGTKVEVK

SEQ ID NO: 9 - protein, 119 aa, Artificial Sequence
  Description of Artificial Sequence: Synthetic polypeptide
QVQMVESGGGVVQPGTSLRLSCAASGFDFSSYGMHWVRQAPGKGLEWVAMISHDGTSRYYGDSVKGRFTISRDNSNHTLYLQMNSLRVEDMAVYYCASWSFYYNGVDVWGRGATVTVSS

SEQ ID NO: 10 - protein, 109 aa, Artificial Sequence
  Description of Artificial Sequence: Synthetic polypeptide
EIIMTQSPAILSVSPGERATLSCRASQSISSNLAWFQQRPGQPPRLLLYGASTRATGIPARFSGSGSGTEFTLTISSLHSEDFAVYYCQQYHRWPPSITFGQGTRLEIK

SEQ ID NO: 11 - protein, 120 aa, Artificial Sequence
  Description of Artificial Sequence: Synthetic polypeptide
QVQLVESGGGVVQPGRSLRLSCATSGFSFSTYSMHWLRQAPGKGPESVAVISNDGDQTYYAGSGKGRFTISRDNSKNTLYLQMTSLTGEDTAVYYCARDGREGYNDIDNWGQGTLVTVSS

SEQ ID NO: 12 - protein, 112 aa, Artificial Sequence
  Description of Artificial Sequence: Synthetic polypeptide
DVVMTQSPLSLPVTLGQPASISCRASQSLVRSDGDTYFIWFQQRPGQSPRRLIYKVSNRDSGVPDRFSGSGSGTDFTLKISRVEAEDVGIYYCMQGSHWPPTFGGGTRVEIK

SEQ ID NO: 13 - protein, 126 aa, Artificial Sequence
  Description of Artificial Sequence: Synthetic polypeptide
QVQLVESGGGVFQPGTSLRLSCEASGFTFTNHGMHWVRQAPGKGLEWVAVVWYDGSNDYYADSVKGRLTISRDNSKNTLYLQMNSLRVEDTAVYYCARDKGGRCSPNCYFGWLDPWGQGTLVTVSS

SEQ ID NO: 14 - protein, 109 aa, Artificial Sequence
  Description of Artificial Sequence: Synthetic polypeptide
EIVLTQSPGTLSLSPGERVTLSCRASQSVNSAYLAWYQQKPGQAPRLLIYGTSSRATGIPDRFSGSGSGTDFTLTISRLEPDDFAVYYCQQYGTSPPYTFGQGTKLQIK

SEQ ID NO: 15 - protein, 121 aa, Artificial Sequence
  Description of Artificial Sequence: Synthetic polypeptide
QVHLMESGGGVVQPGTSTTLSCAGSGFSFSNFPMQWIRQAPGKGLEWVGLILYDSSHQFYADSVKGRFTISRDNSNNTLYLRMDSLRVDDTAVYYCARGGGIRGFHYADSWGQGTLVTVSS

SEQ ID NO: 16 - protein, 107 aa, Artificial Sequence
  Description of Artificial Sequence: Synthetic polypeptide
NIQLTQSPSTLAASVGDRVTITCRASQSVTMFLAWYQQKPGKAPNLLIYDTSRLEPGVPSRFSGSGSGKEFTLTISSLRPDDFATYHCQQYVTSPWTFGQGTKVEVK

SEQ ID NO: 17 - protein, 122 aa, Artificial Sequence
  Description of Artificial Sequence: Synthetic polypeptide
DVQLVESGEDLVHPGGSLRLSCAASGFTFGSYEMHWVRQAPGKGLEWVSYISESGDVIHYADSVKGRFSVSRDNGKNSLFLQMSRLSDDDTAVYYCARGYCDAATCSWLAYWGQGTLVTVSS

SEQ ID NO: 18 - protein, 107 aa, Artificial Sequence
  Description of Artificial Sequence: Synthetic polypeptide
DIQMTQSPSSVSASVGDRVVITCRASQNILRRLAWFQKKPGKGPKLLIHDAYTLEGGVPSRFSGFGSETEFTLTINSLQPEDFAVYYCQQAYSFPLSFGQGTKVEIR

SEQ ID NO: 19 - protein, 125 aa, Artificial Sequence
  Description of Artificial Sequence: Synthetic polypeptide
EVLLVESGGGLVQPGGSLRLSCAASGFSFNSFEMNWVRQAPGKGLEWVAYISGSGNTIYYADSLEGRFLISRDNAHNRVYLQMNRLRVDDTATYYCARDQWDTWSDSHYYGMDVWGQGTTVSVSS

SEQ ID NO: 20 - protein, 115 aa, Artificial Sequence
  Description of Artificial Sequence: Synthetic polypeptide
QAVLTQPSSLSASPGASASLTCTLRSGISVDTYNIYWYQQKPGRPPHYFLRYNSDSDRHQGSGVPSRFSGSKDASANAGILLISGLQSEDEATYYCMIWHSNAVVFGGGTKLTVL

SEQ ID NO: 21 - protein, 125 aa, Artificial Sequence
  Description of Artificial Sequence: Synthetic polypeptide
EVVLVESGGGSVQPGGSLRLSCAASGFSFSSFEMNWVRQAPGKGLEWLAYISGSGNTIYYADSLEGRFIISRDNAHNRVYLQMNRLRADDTATYYCARDQWDTWSNSHYYGLDVWGQGTTVSVSS

SEQ ID NO: 22 - protein, 115 aa, Artificial Sequence
  Description of Artificial Sequence: Synthetic polypeptide
QAVLTQPSSLSASPGASASLTCTLRSGISVDSYNIYWYQQKPGRPPHYFLRYNSDSDRHQGSGVPSRFSGSKDASANAGIFLISGLQSEDEATYYCMVWHNNAVVFGGGTKLTVL

SEQ ID NO: 23 - protein, 125 aa, Artificial Sequence
  Description of Artificial Sequence: Synthetic polypeptide
EVQLVESGGGLVQPGGSLRLSCAASGFSFSSFEMNWVRQAPGKGLEWVAYISGSGSTIYYADSLKGRFTISRDNARNLVYLHMNDLRADDTAIYYCTRDQWDFWSGSHYYGMDVWGQGTAVSVSS

SEQ ID NO: 24 - protein, 115 aa, Artificial Sequence
  Description of Artificial Sequence: Synthetic polypeptide
QAVLTQPSSLSASPGASASLTCTLRSGINVDTYNIYWYQQKPGRPPHFLLRYNSDSDKLQGSGVPSRFSGSKDASANEGILLISGLQSEDEADYYCMIWHSSAVVFGGGTKLTVL

SEQ ID NO: 25 - protein, 130 aa, Artificial Sequence
  Description of Artificial Sequence: Synthetic polypeptide
EVQLVESGGGLVQPGRSLRLSCTGSGFIFGDFALSWVRQAPGKGLEWVGLIRNKVSGGTTQYAASVKDRFAISRDDSKSIAYLQMNNLKTEDSAVYFCARDGRWGWLVMNLYYYYGIDVWGQGTTVTVSS

SEQ ID NO: 26 - protein, 108 aa, Artificial Sequence
  Description of Artificial Sequence: Synthetic polypeptide
DIVLTQSPGTLSLSPGETATLSCRASQSVSNSYLAWFQQKPGQAPRLLISDASKRAAGIADRFSGSGSGTDFSLTITRLQPEDCAVYFCQQYGTSPWTFGQGTKVEIK

SEQ ID NO: 27 - protein, 130 aa, Artificial Sequence
  Description of Artificial Sequence: Synthetic polypeptide
EVQLVESGGGVVQPGRSLRLSCTASGFTFGDYAISWVRQAPGKGLEWVGLIRTKAYGGTTDYAASVKGRFTISRDDSISTAYLQVNSLKTEDTAVYYCSRDGRWEWLIMNLNYYYGMDVWGQGTTVTVSS

SEQ ID NO: 28 - protein, 108 aa, Artificial Sequence
  Description of Artificial Sequence: Synthetic polypeptide
EIVLTQSPGTLSLSPGERVTLSCRASQSVSSNYLAWYQQKPGQAPRRLIYDASNRATGIPDRFSGSGSGTDFTLTISRLEPEDFAVYFCQQYGRSPWTFGQGTKVEIK

SEQ ID NO: 29 - protein, 117 aa, Artificial Sequence
  Description of Artificial Sequence: Synthetic polypeptide
EAQMVESGGGVVQPGGSLRLSCAVSGAIVSRYYVSWVRQAAGKGLEFVSATQSGGATDYADSVKGRFIVSRDDSKNTIYLQMTNMRVEDTAIYYCVGDHGPSLALRWGQGTQVTVSS

SEQ ID NO: 30 - protein, 112 aa, Artificial Sequence
  Description of Artificial Sequence: Synthetic polypeptide
DVVMGQSPLSLPVTLGQAASLFCNSSQGPVSADGLTYLNWFQQRPGQSPRRLLYLIAERDSGVPDRFSGSGSGTDFTLTISRVEAEDIAVYYCMQSARWPYTFGQGTKLEIK

SEQ ID NO: 31 - protein, 120 aa, Artificial Sequence
  Description of Artificial Sequence: Synthetic polypeptide
QVQLQVSGPGLVKPSGTLSLTCDLSGDSISSRNWWSWVRQSPGKGLEWIGEAYGHGPTNFNPSLESRVTLSLDKSRNRLSLEMNSVTAADTAVYFCVTSSVSDNFSYDCWGQGALVTVSS

SEQ ID NO: 32 - protein, 107 aa, Artificial Sequence
  Description of Artificial Sequence: Synthetic polypeptide
EIVVTQSPDFQSVTPKEKITITCRASQSVGRSLHWYQQKPDQSPKLLIKYASQSFSGVPSRFSGSGSGTDFTLTINSLEAEDAATYYCHQTSSLPHTFGQGTKLEIK

SEQ ID NO: 33 - protein, 117 aa, Artificial Sequence
  Description of Artificial Sequence: Synthetic polypeptide
QVRLQVSGPGLVKPSGTLSLTCDFSGVTSNWWSWVRQSPGRGLEWIGEVYHGGRANYNPSLESRVTMSLDEPRSQLSLELNSVTAADTAVYFCVSSSVSNRFSYDYWGQGTLVTVSS

SEQ ID NO: 34 - protein, 107 aa, Artificial Sequence
  Description of Artificial Sequence: Synthetic polypeptide
EIVLTQSPDFQSVTPKEKITITCRASQSVGRSLHWYQQKPAQSPKLLIKYVSESFSGVPSRFSGSGSGTDFTLTITSLEAEDGATYYCHQTKSLPHTFGQGTKLEIK

SEQ ID NO: 35 - protein, 125 aa, Artificial Sequence
  Description of Artificial Sequence: Synthetic polypeptide
QVQLQESGPGLVKPSGTLSLTCVVSGGSISTSVWWTWVRQSPGKGLEWIGEIYYSGRTNYNPSLESRVTLSIDTSKNQFSLTLHSVTAADTAVYRCARGDTFPSGYYYYQGLDIWGQGATVTVSS

SEQ ID NO: 36 - protein, 108 aa, Artificial Sequence
  Description of Artificial Sequence: Synthetic polypeptide
EIVLTQSPGTLSSSPGETVTLSCRANQFVSTSHLAWYQQKPGQPPRLLIYETSTRATGIPDRFSGSGSRTDFTLTISRLEPEDFAIYYCQQYGRSPKMFGQGTTVEVK

SEQ ID NO: 37 - protein, 127 aa, Artificial Sequence
  Description of Artificial Sequence: Synthetic polypeptide
QLQLQESGPGLVRPSGTLSLTCAVSGGSISSINWWTWVRQSLGRGLEWIGEIHDRGTTNYNPSLRGRVTLLVDKSRNHFSLELTSLTAADTGVYFCARGSKQRFAYPNYAYHSMDVWGPGTTVTVSS

SEQ ID NO: 38 - protein, 111 aa, Artificial Sequence
  Description of Artificial Sequence: Synthetic polypeptide
QSVLTQPPSASGTPGQRVTISCSGGSSNLGSNYVFWYQQLPGTAPKLLIFSNDQRPSGVPDRFSGSKSGTSAALVINGLRSEDEADYYCAAWDDSRGGFYVLGTGTKVIVQ

SEQ ID NO: 39 - protein, 122 aa, Artificial Sequence
  Description of Artificial Sequence: Synthetic polypeptide
QVQLQESGPGLVKPSQTLSLTCAVSGGSISSDAYSWSWIRQPPGKGLEWIGHIFHTGGTYSNPSLKSRVSISLDKSKNQFSLRLTSVTAADTAVYYCARDYGSGSYIYFDYWGQGTLVTVSS

SEQ ID NO: 40 - protein, 107 aa, Artificial Sequence
  Description of Artificial Sequence: Synthetic polypeptide
DIQMTQSPSSLSPSVGDRVTITCRASQSISNYLNWYQQKPGKAPKLLIYAASRLQSGVPSRFSGSGSGTDYFLTISSLQPEDFATYYCQQSYKTPRTFGQGTYLEIK

SEQ ID NO: 41 - protein, 123 aa, Artificial Sequence
  Description of Artificial Sequence: Synthetic polypeptide
QVQLQESGPGLVKPSQTLSLTCTVSDGSISSGSYYWSWIRQPAGKGLEWIGRIYTSGSTNYNPSLKSRVTISVDTSKNQFSLKLSSVTAADTAVYYCARLRGAAGTEYYFDYWGQGTLVTVSS

SEQ ID NO: 42 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFALTISTLQAEDVAVYYCQQYYSTPLTFGGGTKVEIK

SEQ ID NO: 43 - protein, 119 aa, Artificial Sequence
  Description of Artificial Sequence: Synthetic polypeptide
QVQLVESGGGLVKPGGSLRLSCAGYEFTFSDYSMNWIRQAPGKGLEWVAYIGTGGSIIYYADSVKGRFTISRDNAKNSVYLQMNSLRAEDTALYYCARANSGWRAFDIWGQGRMVTVSS

SEQ ID NO: 44 - protein, 112 aa, Artificial Sequence
  Description of Artificial Sequence: Synthetic polypeptide
DILMTQSPLSLPVTPGEPASISCKSSQSLLHTNGHNYLHWFLQKPGQIPQLLIYLDSYRASGVPDRISGSGSGTDFTLKISRVEAEDVGVYYCMQALQTPYTFGQGTKLEIK

SEQ ID NO: 45 - protein, 116 aa, Artificial Sequence
  Description of Artificial Sequence: Synthetic polypeptide
QVQLVQSGAEVKKPGASVNVSCKASGYVFTSYYMHWVRQAPGQGLEWMGIINPGGGVTTYAQKFQGRVTMTRDRSSSTVYMELSGLRSDDTAIYYCARELAGLDHWGRGTLVTVSS

SEQ ID NO: 46 - protein, 112 aa, Artificial Sequence
  Description of Artificial Sequence: Synthetic polypeptide
QSVLTQPPSVSGAPGQTVTISCTGSRSNIGAGYDVHWYQQLPGTAPKLLIYNNANRPSGVPDRFSGSKSGSSASLAITGLQAEDEAHYYCHSLDSTVSGSGVFGGGTKLTVL

SEQ ID NO: 47 - protein, 125 aa, Artificial Sequence
  Description of Artificial Sequence: Synthetic polypeptide
QITLKESGPTLVKPKDTLTLTCTFSGFSLSGSGTGVGWIRQPPGKALEWLAVFFWNEDRLYNSSLESRLAITQDASKNQVVLTMTNVDPLDTATYYCAHRPLYSNTWHANWFDAWGQGILVTVSS

SEQ ID NO: 48 - protein, 108 aa, Artificial Sequence
  Description of Artificial Sequence: Synthetic polypeptide
DVQMTQSPSSVSASVGDRVTITCRATQDIGTWLAWYQQKPGRAPQFLIYSASALHDGVPSRFSGGGSGTHFTLTISGLQPEDFATYYCQHGNRFPGVSFGGGTKVEIK

SEQ ID NO: 49 - protein, 127 aa, Artificial Sequence
  Description of Artificial Sequence: Synthetic polypeptide
QVTLRESGPALVKPTETLTLTCTFSGFSLSSSGMCVSWIRQPPGKALEWLALIDWDDDKYYSASLKTRLTISKDTSKNQVVLTMTDMKPLDTGTYFCARMSRFKTSAVTTFDAFDVWGQGTAVAVSP

SEQ ID NO: 50 - protein, 111 aa, Artificial Sequence
  Description of Artificial Sequence: Synthetic polypeptide
QSVLTQPPSASGTPGQRVTISCSGGSSNIASHTVNWYQQLPGATPKLLIYGNDQRPSGVPDRFSGSKSGTSASLAISGLQSEDEADYYCATWHGSQNAFYVFGPGTKVTVL

SEQ ID NO: 51 - protein, 127 aa, Artificial Sequence
  Description of Artificial Sequence: Synthetic polypeptide
QVTLRESGPALVKPTQTLTLTCTFSGFSLSSSGMCVSWIRQPPGKALEWLALVDWDDDKYYSTSLKTRLTVSKDTSKNQVVLTMTDMKPVDTGTYYCARMSRFKTSAVTTFDAFDIWGQGTMVAVSS

SEQ ID NO: 52 - protein, 111 aa, Artificial Sequence
  Description of Artificial Sequence: Synthetic polypeptide
QSVLTQPPSASGTPGQRVTISCSGSSSNIASHTVNWYQQLPGATPKLLIYSNDQRPSGVPDRFSGSKSGTSASLAISGLQSEDEADYYCAAWHGSQNAFYVFGPGTKVTVL

SEQ ID NO: 53 - protein, 126 aa, Artificial Sequence
  Description of Artificial Sequence: Synthetic polypeptide
EVQLVESGGGLVKPGGSLKLSRAASGFTFSSYSINWVRQAPGKGLEWVASISGSGDYIYYGDSVKGRFSVSRDNAENSVYLQLNSLRIDDSGVYYCARARDISVVVPANRNWFDSWGQGTLVSVSS

SEQ ID NO: 54 - protein, 108 aa, Artificial Sequence
  Description of Artificial Sequence: Synthetic polypeptide
SYILTQSPSVSLAPGQTARITCGGHNIERKSVNWYQQRPGQAPVVVVHDDNERPSGIPERFSGSNSGNTATLTISRVEAGDEADYYCQVWDYSDAHWVIGGGTKLTVL

SEQ ID NO: 55 - protein, 124 aa, Artificial Sequence
  Description of Artificial Sequence: Synthetic polypeptide
EFQLLESGGGLAQPGGSLRLSCAASGFTLSNYAMSWVRQAPGKGLDWVSFISSGGISISYSDSAKGRFTISRDNSKNILYLQMNSLRAEDTAVYYCAKGGLMTAGFVKYGMDVWGQGTTVTVSS

SEQ ID NO: 56 - protein, 108 aa, Artificial Sequence
  Description of Artificial Sequence: Synthetic polypeptide
SYVLTQPPSVSVAPGQTARITCGGDYIGGQNVHWYHQKPGQAPVLVVYDDKNRPSGIPERFSGSNSGNTATLTISRVEAGDEADYYCQVWDHNSDQWVFGGGTALTVL

SEQ ID NO: 57 - protein, 122 aa, Artificial Sequence
  Description of Artificial Sequence: Synthetic polypeptide
DMQLVESGGGLIQPGGSLRLSCAASGFRVSSNYMSWVRQAPGKGLEWLSVLSIGDSTFYADSVKGRFTISRDNSKNMLYLQMNGLRAEDTAVYYCARSYYDVSRSWGASDVWGQGTAVTVSS

SEQ ID NO: 58 - protein, 113 aa, Artificial Sequence
  Description of Artificial Sequence: Synthetic polypeptide
DIVMTQSPDSLAVSLGERAAINCKTSQSVFYSPNNQNYLAWYQQKPGQPPKLLIYWASTRESGVPDRFSGSGSGTDFTLTISSLLAEDVAIYYCQQYYTTPLTFGGGTKVEIK

SEQ ID NO: 59 - protein, 115 aa, Artificial Sequence
  Description of Artificial Sequence: Synthetic polypeptide
EPQVVESGGDLVQPGGSLRLSCSASGFTFSNSWMSWVRQTPGKGLEWVAVINEDGSEQYYVDSVKGRFTISRDNAKSSLYVQMSSLRVEDTAVYYCARGQSLTFWGLGTLVTVSS

SEQ ID NO: 60 - protein, 112 aa, Artificial Sequence
  Description of Artificial Sequence: Synthetic polypeptide
DIVMTQSPLSLPVTLGQPASISCRSSQSLVHSDGNTYLNWFHQRPGQSPRRLIYRASNRDSGVPDRFSGSGSGSDFTLKISRVEAEDVGVYYCMQDTHWPYTFGQGTTLEIK

SEQ ID NO: 61 - protein, 124 aa, Artificial Sequence
  Description of Artificial Sequence: Synthetic polypeptide
QVKLVESGGGLVQPGGSLRLSCEASGFNFNLYWMTWVRQAPGKGLEWVANVNKDGSQKYYADSVKGRFTIARDNTNASVRLHLNSLRPNDAGVYFCVMSEGWRTGFYLGAFSAWGQGAAVTVSS

SEQ ID NO: 62 - protein, 111 aa, Artificial Sequence
  Description of Artificial Sequence: Synthetic polypeptide
QSILTQPPSVSGAPGQRVTISCTGSSPYIGTTSDVHWYQHVPGRAPRLLIYANTYRPPGVPDRFSGSKSGTSASLAITGLQAEDEAEYYCQSSDTVMSVVIFGGGTKLTVL

SEQ ID NO: 63 - protein, 121 aa, Artificial Sequence
  Description of Artificial Sequence: Synthetic polypeptide
EVQLVESGGGSVQPGGSLRLSCAASGFTFRSYWMHWVRQTPGKGLVWVSRISTDGSITTYADSVKGRFTISRDNAKNTLYLQMNSLRAEDSAVYYCARDLNIVVLAAPDYWGQGTLVTVSS

SEQ ID NO: 64 - protein, 106 aa, Artificial Sequence
  Description of Artificial Sequence: Synthetic polypeptide
SYELTQPPAVSVSPGQTASITCSGDKLGDKHVCWYQQKPGQSPVLVIYQDTKRPSGIPERFSGSTSGNTATLTISGTQAIDEADYYCQAWATSTAVFGGGTKLTVL

SEQ ID NO: 65 - protein, 123 aa, Artificial Sequence
  Description of Artificial Sequence: Synthetic polypeptide
QVRLQESGPGLVKPPQTLSLTCTVSGGSVTSGGYFWSWIRQRPGKGLEWIGCIYDSGSTSYNPSLKSRVTISLDTSENQFSLKLNSVTAADTAVYFCARAGFKGEYPEFLQHWGQGSLVTVSS

SEQ ID NO: 66 - protein, 110 aa, Artificial Sequence
  Description of Artificial Sequence: Synthetic polypeptide
QSVLTQPPSASGTPGQRVTISCFGSSSNVGSHTVNWYHQLPGTAPKLLIYNNNQRPAGVPDRFSGSKSGTSASLAISGLQSEDEADYYCGAWDDSLNGPVFGGGTKLTVL

SEQ ID NO: 67 - protein, 120 aa, Artificial Sequence
  Description of Artificial Sequence: Synthetic polypeptide
QVHLPQWGAGLLKPSETLSLTCAVYGGSFRGYYWSWIRQPPGKGLEWIGEINQRGSTTYNPSLKSRVTISVDTSKNQFSLKLSSVTAADTAVYYCARVGDVDKAMVEDYWGQGTLVTVSS

SEQ ID NO: 68 - protein, 107 aa, Artificial Sequence
  Description of Artificial Sequence: Synthetic polypeptide
DIQMTQSPSSLSASVGDRVTITCRASQGIRNYLAWFQQKPGKAPKSLIYAASSLQSGVPSRFSGSGSGTDFTLTISSLQPEDFATYYCQQYDSYPRTFGPGTKVDIK

SEQ ID NO: 69 - protein, 125 aa, Artificial Sequence
  Description of Artificial Sequence: Synthetic polypeptide
QVQLQQWGAGLLKPAETLSLTCGVYGGSFSAFSWTWIRQSPGNGLEWIGEIDHSGSVNYNPSLKSRVSVSVDTPKNQFSLKLKFVTAADTAVYFCARRRITMVRGINYRGTFDIWGQGTMVTVSS

SEQ ID NO: 70 - protein, 107 aa, Artificial Sequence
  Description of Artificial Sequence: Synthetic polypeptide
DIQMTQSPSSLSASVGDRVTIICRASQGVRYDLGWVQQKPGKAPQALIYAASRLQSGVPSRFSGSGSGTEFTLTISSLQPEDFATYYCLQHNTDPPTFGQGTKVEIK

SEQ ID NO: 71 - protein, 121 aa, Artificial Sequence
  Description of Artificial Sequence: Synthetic polypeptide
QLQLQESGPGLVKPSETLSLTCTASGGSISGSTYYWGWIRQPPGKGLEWIGNVYYTGSGYYNPSLRSRVTISVDTSENQFSLKLRSVTAADRAVYFCAAYCSGKSCSVNYWGQGTLVTVSS

SEQ ID NO: 72 - protein, 110 aa, Artificial Sequence
  Description of Artificial Sequence: Synthetic polypeptide
QSVLTQTPSASGTPGQRVTISCSGRPSNIGSNYVYWYQQLPGTTPRLLIHENTQRPSGVPDRFSGSKSGASASLAISGLRSEDEADYYCAAWDDSLNGLVFGGGTKVTVL

SEQ ID NO: 73 - protein, 122 aa, Artificial Sequence
  Description of Artificial Sequence: Synthetic polypeptide
QVQLQESGPGLVKPSETLFLTCTVSGDSITSTSYYWGWIRQPPGKGLEWVGSIYHNGATFYTPSLKSRVTISLDTSKNQFSLRLTSVTAADTSVYYCARWPSAGPKYFFDYWGQGALVTVSS

SEQ ID NO: 74 - protein, 110 aa, Artificial Sequence
  Description of Artificial Sequence: Synthetic polypeptide
QSALTQPRSVSGSPGQSVTISCTGTSSDVGGYDYVSWYQQYPGKVPKLMIYEVSKRPSGVPDRFSGSKSGNTASLTISGLRAEDEADYYCCSYSGSLLGVFGGGTKVTVL

SEQ ID NO: 75 - protein, 121 aa, Artificial Sequence
  Description of Artificial Sequence: Synthetic polypeptide
QVWLQESGPGLVKPSETLSLTCTVSGASMSNYYWNWIRQPPGKGLEWVGYVYNSGNWRYNPSLESRVTLSVDTSKNQFSLNLSSATAADTAVYYCVREARLSRGADGFDFWGQGTMVTVSS

SEQ ID NO: 76 - protein, 107 aa, Artificial Sequence
  Description of Artificial Sequence: Synthetic polypeptide
EIVMTQSPATLSVSPGERATLSCRASQTVSSNLAWYQQKPGQAPRLLIFDASSRATGIPARFSGSRSGTEFTLTIRSLQSEDFAVYYCQQYYNWPRTFGQGTKVEIK

SEQ ID NO: 77 - protein, 123 aa, Artificial Sequence
  Description of Artificial Sequence: Synthetic polypeptide
EVQLLQSGAEVKKPGESLTISCQGSGYNFSVSWINWVRQVPGKGLEWMGRIDPSDSYTNYGLSFEGHVTISVDKTINTVYLHWGRLKASDSAIYFCARPQRGVYSWENSFDIWGQGTMVTVSS

SEQ ID NO: 78 - protein, 107 aa, Artificial Sequence
  Description of Artificial Sequence: Synthetic polypeptide
DIQMTQSPTSLSASVGDRVTITCRASQPISRYVNWYQQKPGKVPKALINAAWNLETGVPSRFSGTGAQTDFTLTISGLQPDDSATYYCQQSYNTPLAFGQGTRVEIN

SEQ ID NO: 79 - protein, 121 aa, Artificial Sequence
  Description of Artificial Sequence: Synthetic polypeptide
EVQLVQSGTEVKKPGESLRISCKGSGYTFSRQWIGWVRQMPGKGLEWMGIMYPGNSDITYGPSFQGQVTISADKSINTTYLQWRSLRASDTGMYYCARTRGLGAYFGMDAWGQGTMVSVSS

SEQ ID NO: 80 - protein, 111 aa, Artificial Sequence
  Description of Artificial Sequence: Synthetic polypeptide
QSVLTQPPSVSGALGQRVTISCTGSGSNIGANYDVHWYQQLPGKVPKLLIYADTKRPSGVPDRFSGSKSGTSVSLAISGLQAEDEADYYCQSYDNSLRASLFGGGTKLTVL

SEQ ID NO: 81 - protein, 129 aa, Artificial Sequence
  Description of Artificial Sequence: Synthetic polypeptide
QLQLVQSGAEVKKPGSSVKVSCKTSGGAFSASAISWVRQAPGQGLEWMGSIIPIHDTPNYAQKFHGRITITADMSTTTATMELSSVRVEDTAIYYCATWGGRCSRTACPADWVGPLDFWDQGTPVTVSS

SEQ ID NO: 82 - protein, 108 aa, Artificial Sequence
  Description of Artificial Sequence: Synthetic polypeptide
EIVLTQSPGTLSLSPGERATLSCRASQTITSNYLGWYQKKPGQAPRLLIYNASNRATGIPDRFSGSASGTDFTLTISRVEPEDFAVYYCQQYGRSPGTFGQGTKVEIK

SEQ ID NO: 83 - protein, 129 aa, Artificial Sequence
  Description of Artificial Sequence: Synthetic polypeptide
QVQLVQSGAEVKKPGSSVKVSCKASGGTFSGHAISWVRQAPGQGLEWMGGIIPIFNTPNYAQKFRDRVTITADISTSTSYMELSSLGSDDAAVYYCARWGGHCSSTSCYADWVGPLDFWGQGTLVTVSS

SEQ ID NO: 84 - protein, 108 aa, Artificial Sequence
  Description of Artificial Sequence: Synthetic polypeptide
EIVLTQSPGTLSLSPGERATLSCRASQSVTSSYLAWYQQKPGQAPRLLIYNVFIRATGIPDRFSGSGSGTDFTLTISRLEPEDFAVYYCQQYGSSPGMFGQGTKVEIK

SEQ ID NO: 85 - protein, 131 aa, Artificial Sequence
  Description of Artificial Sequence: Synthetic polypeptide
QVQLVQSGAEVKKPGSSVRVSCKAPGGTFSSHAISWVRQAPGQGPEWMGRTIPFFGVANYAQKFQGRVTITADKSTSTAYMELSSLRSDDTAVYYCARDCSYYDTGSYLEIDCYYYAMDAWGRGTTVTVSS

SEQ ID NO: 86 - protein, 110 aa, Artificial Sequence
  Description of Artificial Sequence: Synthetic polypeptide
QSALTQPASVSGSPGQSITISCTGTSSDIGNYNYVSWYQQHPGKAPKLMIYEVTNRPSGISNRFSGSKSGNTASLTISGLQAEDEADYYCSSYTSSSTRVFGTGTKVTVL

SEQ ID NO: 87 - protein, 125 aa, Artificial Sequence
  Description of Artificial Sequence: Synthetic polypeptide
QITLKESGPTLVKPTQTLTLTCTFSGFSLSTNTVGVAWIRQPPGKALEWLALIYGDDDKRYSPSLESRLTVSKDTSKNQVVLTMTNVDPVDTGTYYCAHNRLATIRPRTYGMDVWGQGTTVTVSS

SEQ ID NO: 88 - protein, 107 aa, Artificial Sequence
  Description of Artificial Sequence: Synthetic polypeptide
DTLMTQSPSSLSASVGDRVTITCRASQSISTFLNWYQQKPGRAPKLLIYTASNLQSGVPLRFSGSGSGTDFTLTVSSLQPEDFAIYYCQQSYNAPWTFGQGTKVEIK

SEQ ID NO: 89 - protein, 121 aa, Artificial Sequence
  Description of Artificial Sequence: Synthetic polypeptide
QVQVVEFGGGLVKPGGSLRLSCATSGFAFNTFSLCWVRQAPGKGLEWVSSVSSSSSYIFYADSVKGRFTISRDNAKNSLYLQMNSLRAEDTAIYYCAREDETAMIRSFDYWGQGTLVTVSS

SEQ ID NO: 90 - protein, 107 aa, Artificial Sequence
  Description of Artificial Sequence: Synthetic polypeptide
DIQMTQSPSSLSASVGARITITCRANQSISRYLNWYQQKSGKAPKLLIFAASSLQSGVPSRFSGSGSGIDFTLTISSLQPEDFVTYYCQQSYNFPYSFGQGTKLEIK

SEQ ID NO: 91 - protein, 121 aa, Artificial Sequence
  Description of Artificial Sequence: Synthetic polypeptide
QVQVVEFGGGLVKPGGSLRLSCAASGFTFSSFSMNWVRQAPGKGLEWVSSISSSGSYIFYADSVKGRFTISRDNAKNSQYLQMNSLRAEDTGIYYCAREDETSMVRSFDYWGQGTLVTVSS

SEQ ID NO: 92 - protein, 107 aa, Artificial Sequence
  Description of Artificial Sequence: Synthetic polypeptide
DIQMTQSPSSLSASVGDRVTITCRANQSISRYLNWYQQKSGKAPKLLIFAASSLQSGVPSRFSGSGSGIDFTLTISSLQPEDFATYYCQQSYSSPYSFGQATKLEIK

SEQ ID NO: 93 - protein, 123 aa, Artificial Sequence
  Description of Artificial Sequence: Synthetic polypeptide
EVQLLEFGGGFVQPGGSLRLSCAVSGLTFSNFAMTWVRQAPGKGLDWVAGIGGSSGYTYYAESVKGRFTISRDNSKSTLYLQLNFLRVEDTATYYCVKFKGRGARENYGMDVWGQGTTVSVSS

SEQ ID NO: 94 - protein, 111 aa, Artificial Sequence
  Description of Artificial Sequence: Synthetic polypeptide
QSVLTQPPSVSGAPGQRVTISCTGRSSNIGAGYDVHWYQQLPGTAPKILIFANDNRFSWTPARFSGSRSGTSASLTITGLQPEDEADYYCQSFDNILGGCVFGTGTKVTVV

SEQ ID NO: 95 - protein, 122 aa, Artificial Sequence
  Description of Artificial Sequence: Synthetic polypeptide
EVQLVESGGDLVQPGGPLRLSVTGTGFPFSSYGMSWVRRAPGKGLTWVASISGSDDVAYYADSVQGRFVISRDNSEDTLYLDMRRLRAEDTAVYYCSRDRLMLTSYPNPAPWGQGTRVTVTS

SEQ ID NO: 96 - protein, 111 aa, Artificial Sequence
  Description of Artificial Sequence: Synthetic polypeptide
QITLTQSPSASASLGASVKLTCTLSSGHRNYAIAWHQQQPQAAPRFLMMLYSDNSYTQETGIPDRFSGSSSGAERYLTISDVQPEDEADYYCQTWGAGFEVFGGGTKLTVL

SEQ ID NO: 97 - protein, 125 aa, Artificial Sequence
  Description of Artificial Sequence: Synthetic polypeptide
DVQLVESGGAEVQPGGSLRLSCAASGFTFTDYTLHWVRQVPRRGLEWVSVMTWDGASSYADSVKGRFSVSRDNNKNSLYLHMSDLRPEDTALYYCAKNGVRFGSGTATYWYLDLWGRGTQVTVSS

SEQ ID NO: 98 - protein, 110 aa, Artificial Sequence
  Description of Artificial Sequence: Synthetic polypeptide
SSVLTQDPSVSVALGQTVTITCQGDSLRSYFANWYQQKPGQAPILVIYGQNSRPSGIPVRFSASSSGDTTSLTITGTQAEDEADYYCHSRDNSGAHLGMVFGGGTKLTVL

SEQ ID NO: 99 - protein, 121 aa, Artificial Sequence
  Description of Artificial Sequence: Synthetic polypeptide
GVQLMESGGAVIQPGGSLRLSCVASGLTFDDYTMHWVRQAPGKGLEWVSLISWDGASSYYADSVRGRFTVSRDNSKNSLYLEMKSLRSEDTAVYFCAKGFSSSSSGCIDHWGQGALVTVSS

SEQ ID NO: 100 - protein, 108 aa, Artificial Sequence
  Description of Artificial Sequence: Synthetic polypeptide
SYVLTQPPSVSVAPGQTARIPCGGDNIGSKSVHWYQQKAGQAPVLVIFHDNDRPSGIPERFSGSNSGNTATLTISRVEGGDEADYYCQVWLRSDDHHVFGTGTKVTVL

SEQ ID NO: 101 - protein, 132 aa, Artificial Sequence
  Description of Artificial Sequence: Synthetic polypeptide
EVQLVESGGGLAQTGGSLRLSCSASGFTFSEFSMHWVRQAPGGGLEYISGIRGHGRYTYYADSVKGRFIVSRDNSVNTLDLQMSSLRLEDTAVYFCVKDGNDCLNGICYTGDSDYHHGLEDWGQGTTVTVSS

SEQ ID NO: 102 - protein, 111 aa, Artificial Sequence
  Description of Artificial Sequence: Synthetic polypeptide
QSVLTQPPSASGTPGQRVTISCSGGTSNIGTNYVYWYQHFRGTAPKLLIHSNNQRPSGVPDRFSGFKSGTSASLVISGLRSEDEADYYCAAWDDALSGNYVFGTGTKVTVL

SEQ ID NO: 103 - protein, 114 aa, Artificial Sequence
  Description of Artificial Sequence: Synthetic polypeptide
EVQLVESGGGLVQPGGSLTLSCEVSGFTVSYNYMAWVRQAPGKGLEWVSFIYSDARTFYKDSVKGRFTIYRDSSKNTLYLQMSSLRGEDTAVYYCVNLYRSGWWGQGTLVTVSS

SEQ ID NO: 104 - protein, 109 aa, Artificial Sequence
  Description of Artificial Sequence: Synthetic polypeptide
QAVVTQEPSLTVSPGGTVTLTCGSSTGTVTRGHSPYWFQQKPGQAPTTLIYDTTNKHFWTPARFSGSLLGRKAALTLSGAQPEDEADYYCLLSYGGPWVFGGGTKLTVL

SEQ ID NO: 105 - protein, 118 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGGTNYNPSLKSRVTMSVDTSKNQFSLKLSSVTAADTAVYYCATYCSSISCYRGWGQGTMVTVSS

SEQ ID NO: 106 - protein, 107 aa, Artificial Sequence
  Description of Artificial Sequence: Synthetic polypeptide
QSPLPLPVTPGEPASISCRSSQSLLHSNGYTYLDWYLQKPGQSPQLLIYLGSNRASGVPDRFSGGGSGTDFTLKISRVEAEDVGVYYCMQTLQTPRTFGQGTKVEIK

SEQ ID NO: 107 - protein, 124 aa, Artificial Sequence
  Description of Artificial Sequence: Synthetic polypeptide
QVQLQESGPGLVKPSETLSLSCTVSGDSMNIYHWNWIRQPPGKGLEWIGTAHYSGSASYNPSLKSRVTISVDTSKNQFSLNLASVTAADTAVYYCARDPHDSSSGYWHHWFDPWGQGTLVTVSS

SEQ ID NO: 108 - protein, 107 aa, Artificial Sequence
  Description of Artificial Sequence: Synthetic polypeptide
EILLTQSPATLSLSPGERATLSCRANQSVSTYLNWYQQKTGQAPRLLIYEASYRATGIPARFSGSGSGTDFTLTISSLEPEDFAVYYCQQRSNWLFTFGPGTTVDIR

SEQ ID NO: 109 - protein, 127 aa, Artificial Sequence
  Description of Artificial Sequence: Synthetic polypeptide
QVQLQESGPGLVKPSGTLSLTCAVSGGSISSRSWWSWVRQPPGKGPEWIGEVSHSGSTNYNPSLKSRVTISLVTSKTQFSLKLRSVTAADTAIYYCARMTYYDFRSGYSIPYYLDFWGQGILVTVTS

SEQ ID NO: 110 - protein, 111 aa, Artificial Sequence
  Description of Artificial Sequence: Synthetic polypeptide
QSVLAQPPSVSGAPGQRVTISCTGSSSNIGAGYDVHWYQQLPGTAPKLLIYGNTNRPSGVPDRISGSKSGASVSLAINGLQAEDEADYYCQSYDSSLSGVVFGGGTRLTVL

SEQ ID NO: 111 - protein, 127 aa, Artificial Sequence
  Description of Artificial Sequence: Synthetic polypeptide
QVQLQESGPGLVKPSGTLSLTCAVSGGSISSRNWWSWVRQPPGKGLEWIGEIHHSGTTNYSPSLKSRVTISVDKSKGRFSLRLKSVTAADTAVYYCARLTYFDFRSGYSIPYYFDYWGQGTLVTVSS

SEQ ID NO: 112 - protein, 111 aa, Artificial Sequence
  Description of Artificial Sequence: Synthetic polypeptide
QSVLTQPPSVSGAPGQRVTISCTGSTSNIGANYDVHWYQRLPRTAPKLLIFSNNDRPSGVPDRFSGSKSGTSASLAITGLQAEDEADYYCQSYDSSLSGVVFGGGTKLTVL

SEQ ID NO: 113 - protein, 119 aa, Artificial Sequence
  Description of Artificial Sequence: Synthetic polypeptide
QVQLQESGPGLVRPSGTLSLTCAVSGVSIISESWWSWVRQSPGKGLECIGEIWYDGTTQYNPSLKGRVTISLDRSKNEVSLRLNSVTAADTAVYYCAKDNSGWREVDYWGQGTLVTVSS

SEQ ID NO: 114 - protein, 112 aa, Artificial Sequence
  Description of Artificial Sequence: Synthetic polypeptide
DVVLTQSPLSLPVTLGQTASISCRSSQTLVYRDGNIYLNWFQQRPGQSPRRLIYRISNRDSGVPDRFSGSGSGTFFTLTISRVEAEDVGVYYCMQGTHWPHTFGLGTNLEIK

SEQ ID NO: 115 - protein, 119 aa, Artificial Sequence
  Description of Artificial Sequence: Synthetic polypeptide
QVQLQESGPGLVKPSGTLSLTCAVSGSSIRDDSCWTWVRQPPGKGLEWIGEICQSGSPNYNPSLKSRVTMSEDDSKNQFSLKLTSVTAADTAIYYCARDTSGWRQVDYWGRGTLVTVSS

SEQ ID NO: 116 - protein, 112 aa, Artificial Sequence
  Description of Artificial Sequence: Synthetic polypeptide
DVVMTQSPLSLPVTLGQPASLSCRSSQNVAHSDGNKYVSWYHQRPGQSPRRLIYRVSNRDSGVPDRFSGSGSGTDFTLKISRVEAEDIGVYYCMQGTHSPHTFGQGTKLEIK

SEQ ID NO: 117 - protein, 121 aa, Artificial Sequence
  Description of Artificial Sequence: Synthetic polypeptide
QVRLVQSGTEVKKPGSAVKVSCEASGGSLSSFAINWVRQAPGQGLEWMGNIIPISGTPSYRQKFQDRVTITANRSMNTVYMELSRLTSEDMAVYFCAREHYDSGLGTFDLWGQGTTVIVSS

SEQ ID NO: 118 - protein, 113 aa, Artificial Sequence
  Description of Artificial Sequence: Synthetic polypeptide
DIVMTQSPESLAVSLGERATINCKSSQSVLYDSSKKNYLGWYQQKAGQPPKLLIYWASTRESGVPDRFSGSGSGTDFTLTIDSLQPEDVAVYYCQQYYSSPRTFGQGTKVEIK

SEQ ID NO: 119 - protein, 118 aa, Artificial Sequence
  Description of Artificial Sequence: Synthetic polypeptide
QVELVQSGAEVQKPGASVRVSCKASGYTFTGYYIHWVRQAPGQGLEWMGRINCHNGDTNSAQRFQGWVSMTRDTSISTAYMELRGLISDETAIYYCARDRGNGYLEYWGQGSLVTVSS

SEQ ID NO: 120 - protein, 109 aa, Artificial Sequence
  Description of Artificial Sequence: Synthetic polypeptide
QSALTQPASVSGSPGQSITISCTGTSSDIGASKFVSWYQQHPGKAPKLIIFDVNNRPSGVSNRFSGSKSGNTASLTIFGLQTEDEADYYCSTYSTTATLFGGGTKLTVL

SEQ ID NO: 121 - protein, 123 aa, Artificial Sequence
  Description of Artificial Sequence: Synthetic polypeptide
QVHLVQSGAEVKKPGASVKFSCKTSGYNFINYAMHWVRQAPGQGLEWMGWINGNGRSFYSQNFQGRVTITGDTSASTAYMELRSLRSEDTAVYFCARGSNFYSSGSYYGLDVWGQGTTVSVSS

SEQ ID NO: 122 - protein, 110 aa, Artificial Sequence
  Description of Artificial Sequence: Synthetic polypeptide
QSALTQPASVSGSPGQSITISCTGTSSDVGNYDLVSWYQHHPGKTPKLIIYDVAKRPSGVSNRFSGSKSGNTASLTISGLLAEDEGGYYCCSYAGSSLWVFGGGTKVTVL

SEQ ID NO: 123 - protein, 119 aa, Artificial Sequence
  Description of Artificial Sequence: Synthetic polypeptide
QVQLVESGGDLVRPGGSLRLSCAASGFDFSDYYMHWIRQAPGKALEWLSYMSSSRSYRNYADSVNGRFTISRDNVKNELYLEMNSLRADDTAVYYCARGGFGWPPFDSWGQGTLVTVSS

SEQ ID NO: 124 - protein, 110 aa, Artificial Sequence
  Description of Artificial Sequence: Synthetic polypeptide
QSALTQPASVSGSPGESITISCTGTNNDVGDYNSVSWYQQNPGRAPKLVIYEVNYRPSGVSDRFSGSKSGNTASLMISGLQAEDEADYYCSSYTTSSTYVFGTGTKVTVL

SEQ ID NO: 125 - protein, 119 aa, Artificial Sequence
  Description of Artificial Sequence: Synthetic polypeptide
QVQLVESGGDLVRPGGSLRLSCAASGFTFSDFYMNWIRQAPGKGPEWVAHISIGRSYTNYADSVKGRFTISRDNVRDSLYLQMNNLRDEDTAIYYCARGGTGWPPFDFWGQGAQVTVSS

SEQ ID NO: 126 - protein, 110 aa, Artificial Sequence
  Description of Artificial Sequence: Synthetic polypeptide
QSALTQPASVSGSPGQSITISCTGTSSDIGGYNSVSWYQQHPGKAPKLIIYDVNYRPSGTSNRFSGSKSGNTASLTISGLQAEDEADYFCSSYTTSVTYVFGTGTKVTVL

SEQ ID NO: 127 - protein, 125 aa, Artificial Sequence
  Description of Artificial Sequence: Synthetic polypeptide
EVQLVQSGGGLVEPGGSLRLSCAASGFTFNDAWMNWLRQTPGKGLEWLGRLRGRASGGTADYAAPVKGRFTISRGYSSNMVYLQMNSLKNEDTAVYYCATDVDTNAWYRGAPQTWGQGTLVTVSS

SEQ ID NO: 128 - protein, 107 aa, Artificial Sequence
  Description of Artificial Sequence: Synthetic polypeptide
DIQMTQSPSSLSASLGDRVTLTCRASQYIGKSLAWYHQRPGKAPKRLIYGASNLQSGVPPRFSGSGSGTEFTLTISSLQSEDFGTYYCLQDEAYPWTFGQGTKVDLK

SEQ ID NO: 129 - protein, 125 aa, Artificial Sequence
  Description of Artificial Sequence: Synthetic polypeptide
EVQLMESGGGLVEPGSSLRLSCAASGFNFKNAWMNWFRQAPGKGLEWLGRLKGKASGGTADYAAPVQGRFTMSRGDSMNMVYLQMNSLKREDTAVYYCATDVDSNNWYRGAPQTWGQGTPVTVSS

SEQ ID NO: 130 - protein, 107 aa, Artificial Sequence
  Description of Artificial Sequence: Synthetic polypeptide
DIQMTQSPSSLPAYVGDRVTITCRASQGIGNSLAWYQQKPGKAPKRLIYEAYNLQSGVPPRFSGSGSGTEFTLTISSLQPEDFATYYCLQDNDYPWTFGQGTKVEIK

SEQ ID NO: 131 - protein, 127 aa, Artificial Sequence
  Description of Artificial Sequence: Synthetic polypeptide
QVQLVESGGGLVKPGGSLTLSCAASGFAFINYNINWVRQAPGKGLEWVSSISARGTYTYYADSVEGRFTIYGDDSENSVYLQMNSLRAEDTAVYYCARDEQNQYDSGGFYYRYFDYWGRGTLVTVSS

SEQ ID NO: 132 - protein, 109 aa, Artificial Sequence
  Description of Artificial Sequence: Synthetic polypeptide
EIELTQSPGTLSLSPGESATLSCRARQSVSSSYLAWYQQRPGQAPRLLLYGASKRATGIPDRFSGSASGTDFTLTISRLEPEDFAVYYCQQYGNSLLWTFGQGTKVEIK

SEQ ID NO: 133 - protein, 118 aa, Artificial Sequence
  Description of Artificial Sequence: Synthetic polypeptide
EENIVESGGRMIQPGGSLRISCAASGFNFNDYVASWVRQTPGKGLQWVSIITGSGTRTYYADSVQGRFTISRDDSKNTLYLEMNSLRVEDTAIYYCAFPGPDSWMPAWGQGILVTVSS

SEQ ID NO: 134 - protein, 114 aa, Artificial Sequence
  Description of Artificial Sequence: Synthetic polypeptide
DVVVTQSPLSLAVTLGQPASIACSSSQSLVYSGGNYYWNWFQQRPGQSPRRLIYKNSNRDSGVPDRFSGSGSGADFTLEITRVEAEDVAIYYCMLGSYWPPAYTFGQGTKLEIK

SEQ ID NO: 135 - protein, 127 aa, Artificial Sequence
  Description of Artificial Sequence: Synthetic polypeptide
EVQLLESGGGLVQPGGSLRLSCAASRFPFSTYDMSWVRQAPGKGLEWVSAISGTGDATYYADSVNGRFTISRDNSKNTLYLQMNSLGAEDTAVYYCAKFAQYNYYYTGWRYDAFDIWGQGTMVTVSS

SEQ ID NO: 136 - protein, 111 aa, Artificial Sequence
  Description of Artificial Sequence: Synthetic polypeptide
QSALTQPASVSGPPGQSITISCIGTTTDVGSYNLVSWYQQHPGKAPKLLIYDVSKRPSGVSNRFSGSKSGNTASLTISGLQAEDEAHYYCYSYGGSRSLVLFGGGTKVTVL

SEQ ID NO: 137 - protein, 122 aa, Artificial Sequence
  Description of Artificial Sequence: Synthetic polypeptide
QVQLVESGGGVVQPGGSLRLSCAASGFAFNYYGMHWVRQAPGKGLEWVAILSYDSRNNLYADSVKGRFTISRDNSKSTLYLQMNSLRVEDTAVYYCAKELELRDQWYGMDVWGQGTTVTVSS

SEQ ID NO: 138 - protein, 105 aa, Artificial Sequence
  Description of Artificial Sequence: Synthetic polypeptide
DIQMTQSPHTLSASVGDSVTIMCRASESISRWLAWYQQKPGKAPKLLIYRASTLQTGVPSRFSGSGYGTEFTLTINNLQPDDSATYYCQQYNSYSFAQGTKLEIK

SEQ ID NO: 139 - protein, 120 aa, Artificial Sequence
  Description of Artificial Sequence: Synthetic polypeptide
QVQLVESGGGVVQPGTSLSLSCAASGFTLSDNGIHWVRQAPGKGLEWVAVIYYDGSHRYYGDSVKGRFTISRDTSKNTVHLQMNSLRAEDTAVYYCARDICGGDCFTDYWGQGTLVTVSS

SEQ ID NO: 140 - protein, 111 aa, Artificial Sequence
  Description of Artificial Sequence: Synthetic polypeptide
QTVVTQEPSLTVSPGGTVTLTCTSSTGAVTSGYSANWIQQKPGQAPKPLLYSTSRKHSWTPARFSGYLLGGKAALTLSGVQPEDEADYYCLLYYGAAHLWLFGGGTKLTVL

SEQ ID NO: 141 - protein, 124 aa, Artificial Sequence
  Description of Artificial Sequence: Synthetic polypeptide
EVQLVESGGALVQPGGSLRLSCAASGFTFSRYEMNWVRQAPGEGLEWISYIGTLDGTIYYAESVKGRFTISRDNAENSLYLQMNSLRAEDTAVYYCAKLGGDRDVRLHDAFDLWGQGTMVTVSS

SEQ ID NO: 142 - protein, 109 aa, Artificial Sequence
  Description of Artificial Sequence: Synthetic polypeptide
QSVLTQPPSVSAAPGQKVTISCSGSSSNIGSNYVSWYQQFPGTAPKLLIHENNQRPSGIPDRFSGSKSGTSATLAITGLQTGDEADYYCGTWDNSRIALFGGGTKLTVL

SEQ ID NO: 143 - protein, 116 aa, Artificial Sequence
  Description of Artificial Sequence: Synthetic polypeptide
EVQLVESGGGLVQPGGSLRLSCVASGFSFSTYSMNWVRQAPGKGLEWVAFQSRVVETIYYADSVRGRFTISRDNDKNSLYLQMNSLGDDDTGVYYCARGSSWVDYWGQGTLVTVSS

SEQ ID NO: 144 - protein, 108 aa, Artificial Sequence
  Description of Artificial Sequence: Synthetic polypeptide
QIVLTQSPATLSLSPGETATLSCRASQDIRIYLAWYQQKPGQAPKLLIYDASNRATGVPGRFSGSGSGTDFTLTISTLEPEDFAVYYCQQRSDWPPITFGQGTRLEIK

SEQ ID NO: 145 - protein, 122 aa, Artificial Sequence
  Description of Artificial Sequence: Synthetic polypeptide
EVQLVESGGGLVQPGGSLRLSCAVSGFTVSSYYMSWVRQAPGKGLEWVSIVYTGGYTDYADSVKGRFTVSRHISENTLYLQMDSLRPEDTAVYYCAREGGLCSSVSCPFGYWGQGTQVTVSS

SEQ ID NO: 146 - protein, 108 aa, Artificial Sequence
  Description of Artificial Sequence: Synthetic polypeptide
EIVLTQSPATLSLSPGERATLSCGASQSVSSNYLAWYQQKPGLAPRLLIYDASSRATGVPDRFSGSGSGTDFTLTISRLEPEDFALYYCQEYGSSPFTFGGGTKVEIK

SEQ ID NO: 147 - protein, 122 aa, Artificial Sequence
  Description of Artificial Sequence: Synthetic polypeptide
EVKLVESGGGLVQPGGSLRLSCAASGFKVSSYYMSWVRQAPGKGLEWVSVIYTGGGTDYADSVKGRFTSSRHNSENTLYLQMDSLRPEDTAVYYCAREGGLCSSISCPFAYWGPGTLVTVSS

SEQ ID NO: 148 - protein, 108 aa, Artificial Sequence
  Description of Artificial Sequence: Synthetic polypeptide
KIVLTQSPATLSLSPGERATLSCGASQSITSNYLAWYQQKPGLAPRLLIYSSATRATGIPDRFSGSGSGTDFTLTISRLEPEDFAVYYCQHYGSSPLTFGGGTKVEIK

SEQ ID NO: 149 - protein, 122 aa, Artificial Sequence
  Description of Artificial Sequence: Synthetic polypeptide
EVKLVESGGGLVQPGESLRLSCAVSGFKVSSYYMSWVRQAPGKGLEWVSVIYTGGGTDYADSVKGRFTSSRYNSENTLYLQMDNLRPEDTAVYYCAREGGLCSSISCPFGYWGPGTLVTVSS

SEQ ID NO: 150 - protein, 108 aa, Artificial Sequence
  Description of Artificial Sequence: Synthetic polypeptide
KIVLTQSPATLSLSPGERATLSCGASQSISGNYLAWYQQKPGLAPRLLIYSSSTRATGIPDRFSGSGSGTDFTLTISRLEPEDFAVYYCQHYGTSPLTFGGGSKVEIK

SEQ ID NO: 151 - protein, 117 aa, Artificial Sequence
  Description of Artificial Sequence: Synthetic polypeptide
DVQLEESGGDLVQPGGSLRLTCAVSGLTVYSNYLHWVRQIPGKGLEWVSVMYGGGTTDYADSVKGRFTISRDNSRNTLYLQMDSLRPADTAVYYCAGGYSYGSFDYWGQGTLVAVSS

SEQ ID NO: 152 - protein, 110 aa, Artificial Sequence
  Description of Artificial Sequence: Synthetic polypeptide
QSALTQPASVSGSPGQSISISCAGVGSDVAGYNYVSWYQQLPGKAPKLIIYDATHRPSGISDRFSGSKSGDTASLTISGLQAEDEGDYYCASHTSSTLWVFGGGTKVTVL

SEQ ID NO: 153 - protein, 120 aa, Artificial Sequence
  Description of Artificial Sequence: Synthetic polypeptide
QVQLQESGPGLVKPSQTLSLTCTVSGDSISSGGYYWSWIRQHPGKGLEWIGYIHNSGSTDYNPSLKSRVTISVDTSNNQLSLSLSSVTAADTAVYYCARVGRGYTYFDYWGQGTLVTVSS

SEQ ID NO: 154 - protein, 107 aa, Artificial Sequence
  Description of Artificial Sequence: Synthetic polypeptide
DIQMTQSPSSLSASVGDRVTITCRASQNIKNFLHWYQQISGKAPKLLIYVASTLQSGVPSRFSGSGSGTDFTLTISSLQPEDFATYYCQQSYSSPHTFGQGTKLEIK

SEQ ID NO: 155 - protein, 120 aa, Artificial Sequence
  Description of Artificial Sequence: Synthetic polypeptide
QLQLQESGPGLVKPSETLSLTCSVFEGSFNTENYYWGWIRQPPGKGLEWIGSIYYTGSTYYNPSLRSRVTMSIDTSKNHFSLKLSSVTASDTAVYYCVRHLRGYFGMDVWGQGTTVTVSS

SEQ ID NO: 156 - protein, 109 aa, Artificial Sequence
  Description of Artificial Sequence: Synthetic polypeptide
EIVMTQSPLTLSVSPGERATLSCRASQSISIDLAWYQQKPGQAPRLLIYGASKRATGIPARFSASGSGTEFILTISSVQSEDFAVYYCQQHTNWPPWVTFGPGTKVDIK

SEQ ID NO: 157 - protein, 120 aa, Artificial Sequence
  Description of Artificial Sequence: Synthetic polypeptide
QLQLQESGPGLVKSSETLSLTCTVSDGSISDINYYWGWMRQPPGMGLEWIGSFYYSGNFYYNPSLKSRVSISVDASKNQFSLQLSSVTAADTAVYYCARHLRGYFALDVWGPGTTVAVSS

SEQ ID NO: 158 - protein, 109 aa, Artificial Sequence
  Description of Artificial Sequence: Synthetic polypeptide
EIVMTQSPATLSVSPGERVTLSCRASQSVSVDLAWYQQKPGQAPRLLIYGASSRATGVPARFSGSGSGTEFTLTISSLQSEDFAVYYCQQYNNWPPWVTFGPGTKVDVK

SEQ ID NO: 159 - protein, 128 aa, Artificial Sequence
  Description of Artificial Sequence: Synthetic polypeptide
QVQLQESGPGLVKPSQTLSLTCTVSGGSISSGSSYWTWIRQPAGKALEWIGHIYTSGNIDYNPSLKTRVTISVDTSKSQFSLKLYSVTAADTAVYYCARESFYGSGSYSYYYYGIDVWGQGTTVTVSS

SEQ ID NO: 160 - protein, 109 aa, Artificial Sequence
  Description of Artificial Sequence: Synthetic polypeptide
EIVLTQSPGILSLSPGEGATLSCRASQSISSRYLAWYQQKPGQAPRLLIYGASSRAIGIPDKFSGSGSGTDFTLTISRLEPEDFAVYYCQQYGGSSPLTFGGGTNLEIK

SEQ ID NO: 161 - protein, 127 aa, Artificial Sequence
  Description of Artificial Sequence: Synthetic polypeptide
QMQLQESGPGLVRPSETLSLTCSVSGGPISTSSYYWGWIRQFPGKGLEWIANINHRGGAYYSPSLKSRVTISVDTSKNYFSLKLTSVTAADTAVYFCARLLRGNSGLELGVLGMDVWGQGTAVTVSS

SEQ ID NO: 162 - protein, 109 aa, Artificial Sequence
  Description of Artificial Sequence: Synthetic polypeptide
DIVLTQSPGTLSLSPGERATLSCRASRGIASVYLAWYQQKHGQAPRLLIYSASTRATGIPDRFTGSGSGTDFTLSISRLEPEDFAMYFCQYFHSSTSYSFGPGTKLELK

SEQ ID NO: 163 - protein, 126 aa, Artificial Sequence
  Description of Artificial Sequence: Synthetic polypeptide
QVQLQESGPGLVKPSQTLSLTCTVSGGSITSGSYYWSWIRQPAGKGLELIGHIYTGGSTNYNPSLQSRVTISVDTSKNQFSLKLSSVTAADTAVYYCARRVSYYGSGSYYKWFDPWGQGTLVTVSS

SEQ ID NO: 164 - protein, 107 aa, Artificial Sequence
  Description of Artificial Sequence: Synthetic polypeptide
DIQMTQSPSSLSASVGDRVTITCRASQTISSYLNWYQQKPGKAPNLLIYAASSLQSGVPSRFSSSGSGTDFTLTISNLQPEDFATYYCQETYSTLFTFGPGTKVDIK

SEQ ID NO: 165 - protein, 124 aa, Artificial Sequence
  Description of Artificial Sequence: Synthetic polypeptide
QVQLVQSGAEVKKPGASVKVSCKASGYIFSSYGITWVRQAPGQGLEWMGWISAYRGKTDYAPKLQGRVTMTIDTSTSTAYMELRSLRSDDTAVYYCARGRITIFGVVILLNDHWGQGTLVTVSS

SEQ ID NO: 166 - protein, 108 aa, Artificial Sequence
  Description of Artificial Sequence: Synthetic polypeptide
EIVLTQSPGTLSLSPGERATLSCRASQSVSSSYLGWYQQKPGQAPRLLIFDASKRATGIPDRFSGSGSGTDFTLTISRLEPEDFAVYYCQQYGTSPFTFGPGTTVDIK

SEQ ID NO: 167 - protein, 124 aa, Artificial Sequence
  Description of Artificial Sequence: Synthetic polypeptide
QVQLVQSGADVKKPGASVKISCKVSGYSFTAYYIHWVRQVPGQGLELMGWINPNSGATDYVQKFQGRVTMTRDTSSRTVNMELSRLRSEDTGVYYCARAMGDTDDLANYALDVWGQGTTVTVSS

SEQ ID NO: 168 - protein, 113 aa, Artificial Sequence
  Description of Artificial Sequence: Synthetic polypeptide
DIVMTQSPDSLAVSLGERATINCKSSQSVLYTSNNMKYLAWYQQKPGQPPKLLIYWASTRASGVPDRFSGSGSGTDFTLTISSLQAEDVAVYYCHQYYRSPRTFGQGTKVEIK

SEQ ID NO: 169 - protein, 126 aa, Artificial Sequence
  Description of Artificial Sequence: Synthetic polypeptide
QVQLVQSGAEMRKPGASVKVSCKVFGYTFSDYYIHWVRQAPGQGIEWVGRINPTSGDTNYIQKYHGRLTLTRDTSISTAYMELSRLTSDDTAMYFCARPPNPIPVAGSWATYFDYWGQGTLVTVSS

SEQ ID NO: 170 - protein, 111 aa, Artificial Sequence
  Description of Artificial Sequence: Synthetic polypeptide
QSALTQPPSASGSPGQSVTISCTGTSSDVGAYNYVSWYQQHPGKAPKLMIYEVSERPSGVPDRFSGSKSGNTASLTVSGLQAEDEAVYYCSSFTASNPFGVFGTGTEVTVL

SEQ ID NO: 171 - protein, 128 aa, Artificial Sequence
  Description of Artificial Sequence: Synthetic polypeptide
QVQLVQSGAEMKKPGSSVKVSCRASGGTFSSNAISWVRQAPGQGLEWMGEIIPILGLTNYAEKFQGRVTITADESTSTAYMELSSLRSEDTALYYCARMDGIVVPGRKYSHYYGMDVWGQGTTVTVSS

SEQ ID NO: 172 - protein, 109 aa, Artificial Sequence
  Description of Artificial Sequence: Synthetic polypeptide
EIVLTQSPGTLSLSPGERATLSCRTSQSVSSGYLAWYRQRPGQAPRLLIYATSYRATGIPGRFIATGSGTDFTLTISRLEPEDFAVYYCQHYGSSPQITFGQGTRLQIK

SEQ ID NO: 173 - protein, 122 aa, Artificial Sequence
  Description of Artificial Sequence: Synthetic polypeptide
EVQLIQSGGEVRKPGATVKISCRASGYRFIDNYIHWVRQAPGKGLEWVGRVDPEDAETKSAEKFQGRVTITADRSTGTAYISLNSLKSDDTAVYYCARGSDVDFYYYYLDVWGKGTTVIVSS

SEQ ID NO: 174 - protein, 110 aa, Artificial Sequence
  Description of Artificial Sequence: Synthetic polypeptide
ESVLTQSPGTLSLSPGERATLSCRASQTVSNYYLAWYQQKPGQAPRLLFYGASRRAPGVPDRFSGSGSGTDFTLSISRLEPEDFAVYYCQQYDGGSRTWTFGQGTKVEMK

SEQ ID NO: 175 - protein, 132 aa, Artificial Sequence
  Description of Artificial Sequence: Synthetic polypeptide
QLQLQESGPGLVKPSETLSLTCSVSGGSISNSRYCWGWIRQPPGKGLEWIGSIYYSGSTYYNPSLKSRVTISIDTSKTQFSLKLSSVTAADTAVYYCARHVGGETSGAHYILSDYYYYMDVWGKGTTVTVSS

SEQ ID NO: 176 - protein, 109 aa, Artificial Sequence
  Description of Artificial Sequence: Synthetic polypeptide
SYVLTQPPSVSVAPGKTATITCGGNNIGSKSVHWYQQRPDQAPVLVVYADSDRPSGILERISGSNSGNTATLTISRVEAGDEADYYCQVWDDSSNHYGVFGGGTKLTVL

SEQ ID NO: 177 - protein, 124 aa, Artificial Sequence
  Description of Artificial Sequence: Synthetic polypeptide
QLQLQESGPGLVRPSETLSLTCTVSGGSISSKINYWAWIRQSPGKGLEWIGSIYYTGIAYYIPSLESRVTMSVDTSKNQLSLKLTSVTAADTAVYYCARVRCSDNACKSWFEPWGQGTLVTVSS

SEQ ID NO: 178 - protein, 109 aa, Artificial Sequence
  Description of Artificial Sequence: Synthetic polypeptide
QSVLTQPPSASGTPGQRVTISCSGSWSNIAKNYVYWYQQFPGAAPKLLIYNNNQRPSGVPDRFSGSKSGTSASLAISGLRSEDDAKYFCAAWDDVLSVVFGGGTKLTVL

SEQ ID NO: 179 - protein, 121 aa, Artificial Sequence
  Description of Artificial Sequence: Synthetic polypeptide
EVQLVQSGAEVKESGEFLRISCKGSGYSFTTYWISWVRQMPGKGLEWMARIDPTDSYTVYSPSFQGHVTISTDKSISTAYLQWNSLQASDSAMYYCATYNPDSTALAFDYWGQGTLVTVSS

SEQ ID NO: 180 - protein, 108 aa, Artificial Sequence
  Description of Artificial Sequence: Synthetic polypeptide
DIPMTQSPSSLSASVGDRVTITCRASQTISTYLNWYQQKPGKAPNLLIYGASTLQSGAPSRFSGSGSGTYFTLTISSLQPEDFATYYCQQSYSTSTWTFGQGTKVEIK

SEQ ID NO: 181 - protein, 120 aa, Artificial Sequence
  Description of Artificial Sequence: Synthetic polypeptide
QVQLVQSGAEVKKPGASVKVSCKVSGYTFTSHDINWVRQLTGQGPEWMGRMSPHSGNTGYAQKFQGRLTMSRNTSIATAYLELRNLTSDDTAVYYCARVSGFWEGGFDIWGLGTMVTVSP

SEQ ID NO: 182 - protein, 113 aa, Artificial Sequence
  Description of Artificial Sequence: Synthetic polypeptide
DIVMNQSPHSLAMSLGERASINCKSGQSVLYSHTNKSYLAWYQQKPGQPPKRLIHWASTRESGAPDRFSGSGSGTDFTLTISSLQAEDVALYFCQQYHSIPLTFGGGTKVEIK

SEQ ID NO: 183 - protein, 114 aa, Artificial Sequence
  Description of Artificial Sequence: Synthetic polypeptide
EVQLLESGGGLVQPGGSLRLSCAASGFTFISYAMSWVRQAPGKGLEWVSAISGSGGSTYYADSVKGRFTISRDNSKNTLYLQMNSLRAEDTAVYYCAKIAGDDWGQGTLVTVSS

SEQ ID NO: 184 - protein, 109 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLEFTFGPGTKVDIK

SEQ ID NO: 185 - protein, 125 aa, Artificial Sequence
  Description of Artificial Sequence: Synthetic polypeptide
EVQLVESGGGLVQPGRSLRLSCTAYGHTFGDYGLSWLRQAPGKGVEGGGFIRSKAYGGTTEYAASVKDRFTISRDDTKSIAYLQMNSLKTEDTAVYYCTRVITMVRGVIKSFDYWGQGTLVTVSS

SEQ ID NO: 186 - protein, 107 aa, Artificial Sequence
  Description of Artificial Sequence: Synthetic polypeptide
DIQMTQSPSTLSASVGDRVTITCRASQSISNWLAWYQQKPGKAPKPLICQASTLESGVPSRFSGSGSGTEFTLTISSLQPDDFATYYCQQYHSYPLTFGGGTKVEIK

SEQ ID NO: 187 - protein, 120 aa, Artificial Sequence
  Description of Artificial Sequence: Synthetic polypeptide
QVQLQESGPGLVRSSETLSLNCTVSGGSLNSYYWTWVRQPPGKGLEWIGYIFYSGDTMYNPSLSSRVNISVDTTKNQVSLTLNSVAPGDTATYYCVATGTNDSGCQLRYWGQGVLVTVSS

SEQ ID NO: 188 - protein, 111 aa, Artificial Sequence
  Description of Artificial Sequence: Synthetic polypeptide
QSVLTQPPSTSGTPGQNVTISCSGGNSNIGRSYAYWYQQLPGTAPKLLIYNDDQRPSGVSDRFSGSNSGTSASLAISGLRSEDEADYYCAAWDDGLTSSWIFGGGTKLTVI

SEQ ID NO: 189 - protein, 130 aa, Artificial Sequence
  Description of Artificial Sequence: Synthetic polypeptide
QSQLQHSGPRLVKPSAPLSLPCDIPGDRVSSNNAAWNWIRQSPSRSLEWLGIIYYKSKWYSDYAVAVRGRMTINADTSKNQISLQVNSVTPEDTAMYYCARASNEYNGGRYRWMIAFDTWGPGTMVTVSS

SEQ ID NO: 190 - protein, 110 aa, Artificial Sequence
  Description of Artificial Sequence: Synthetic polypeptide
QSALTQPRSVSGSPGQSVTISCAGSSNLGGYNYVSWYQQYPGEVPKLIIYDVNTRPSGVPDRFSGSKSGNAASLTISGLQAEDEADYYCCSYAGNYSPYVFGTGTKVTVL

SEQ ID NO: 191 - protein, 125 aa, Artificial Sequence
  Description of Artificial Sequence: Synthetic polypeptide
QVQLVESGGGVVQAGRSLRLSCAASGFTFSTHEMHWVRQAPGKGLEWVAVISYDGSNKHYAESVKGRLTISRDNSKNTVLLQMNSLRAEDTAMFYCARGNSITAALEEHHDGFDIWGQGTMVIVS

SEQ ID NO: 192 - protein, 107 aa, Artificial Sequence
  Description of Artificial Sequence: Synthetic polypeptide
SYELTQPPSVSVSPGQTARITCSGDALPNRYAYWYQQKPGQAPVLVMYKDTERPSGIPERFSGSRSGTTVTLAISGVQAEDEADYYCQSTDTIGTYVFGTATKVTVL

SEQ ID NO: 193 - protein, 119 aa, Artificial Sequence
  Description of Artificial Sequence: Synthetic polypeptide
QVQLVQSGAEVKKPGASVRVSCKASGYTFTYYYLHWVRQAPGQGLEWMGWINPISGGTNYAQKFQGRVTMTRDTSVGTAYMELSRLRSDDTAVYYCARNGGDSRYFDLWGRGTLVTVSS

SEQ ID NO: 194 - protein, 107 aa, Artificial Sequence
  Description of Artificial Sequence: Synthetic polypeptide
DIQLTQSPSSLSASVGDRVTITCRASQTISSYLNWYQQKPGKAPDLLIYTASNLHSGVPSRFSGSGSGTDFTLTISSLQPEDFTTYYCQQSYNSPYTFGRGTKLQIK
